United States Patent 9,061,059 (MODIFIED POLYNUCLEOTIDES FOR TREATING PROTEIN DEFICIENCY) - sequence listing, part 41

SEQ ID NO: 74653 - DNA, 1389 bp, Artificial Sequence
  Description of Artificial Sequence: Synthetic coding sequence
atgagcctgcccagcagacagaccgccatcatcgtgaacccccccccccccgagtacatcaacaccaagaagaacggcagactgaccaaccagctgcagtacctgcagaaggtggtgctgaaggacctgtggaagcacagcttcagctggcccttccagagacccgtggacgccgtgaagctgcagctgcccgactactacaccatcatcaagaaccccatggacctgaacaccatcaagaagagactggagaacaagtactacgccaaggccagcgagtgcatcgaggacttcaacaccatgttcagcaactgctacctgtacaacaagcccggcgacgacatcgtgctgatggcccaggccctggagaagctgttcatgcagaagctgagccagatgccccaggaggagcaggtggtgggcgtgaaggagagaatcaagaagggcacccagcagaacatcgccgtgagcagcgccaaggagaagagcagccccagcgccaccgagaaggtgttcaagcagcaggagatccccagcgtgttccccaagaccagcatcagccccctgaacgtggtgcagggcgccagcgtgaacagcagcagccagaccgccgcccaggtgaccaagggcgtgaagagaaaggccgacaccaccacccccgccaccagcgccgtgaaggccagcagcgagttcagccccaccttcaccgagaagagcgtggccctgccccccatcaaggagaacatgcccaagaacgtgctgcccgacagccagcagcagtacaacgtggtgaagaccgtgaaggtgaccgagcagctgagacactgcagcgagatcctgaaggagatgctggccaagaagcacttcagctacgcctggcccttctacaaccccgtggacgtgaacgccctgggcctgcacaactactacgacgtggtgaagaaccccatggacctgggcaccatcaaggagaagatggacaaccaggagtacaaggacgcctacaagttcgccgccgacgtgagactgatgttcatgaactgctacaagtacaacccccccgaccacgaggtggtgaccatggccagaatgctgcaggacgtgttcgagacccacttcagcaagatccccatcgagcccgtggagagcatgcccctgtgctacatcaagaccgacatcaccgagaccaccggcagagagaacaccaacgaggccagcagcgagggcaacagcagcgacgacagcgaggacgagagagtgaagagactggccaagctgcaggagcagctgaaggccgtgcaccagcagctgcaggtgctgagccaggtgcccttcagaaagctgaacaagaagaaggagaagagcaagaaggagaagaagaaggagtag

SEQ ID NO: 74654 - DNA, 468 bp, Artificial Sequence
  Description of Artificial Sequence: Synthetic coding sequence
atgagcctgcccagcagacagaccgccatcatcgtgaacccccccccccccgagtacatcaacaccaagaagaacggcagactgaccaaccagctgcagtacctgcagaaggtggtgctgaaggacctgtggaagcacagcttcagctggcccttccagagacccgtggacgccgtgaagctgcagctgcccgactactacaccatcatcaagaaccccatggacctgaacaccatcaagaagagactggagaacaagtactacgccaaggccagcgagtgcatcgaggacttcaacaccatgttcagcaactgctacctgtacaacaagcccggcgacgacatcgtgctgatggcccaggccctggagaagctgttcatgcagaagctgagccagatgccccaggaggagcaggtggtgggcgtgaaggagagaatcaagaagggcacccagcagaacatcgcctag

SEQ ID NO: 74655 - DNA, 603 bp, Artificial Sequence
  Description of Artificial Sequence: Synthetic coding sequence
atgagcctgcccagcagacagaccgccatcatcgtgaacccccccccccccgagtacatcaacaccaagaagaacggcagactgaccaaccagctgcagtacctgcagaaggtggtgctgaaggacctgtggaagcacagcttcagctggcccttccagagacccgtggacgccgtgaagctgcagctgcccgactactacaccatcatcaagaaccccatggacctgaacaccatcaagaagagactggagaacaagtactacgccaaggccagcgagtgcatcgaggacttcaacaccatgttcagcaactgctacctgtacaacaagcccggcgacgacatcgtgctgatggcccaggccctggagaagctgttcatgcagaagctgagccagatgccccaggaggagcaggtggtgggcgtgaaggagagaatcaagaagggcacccagcagaacatcgccgtgagcagcgccaaggagaagagcagccccagcgccaccgagaaggtgttcaagcagcaggagatccccagcgtgttccccaagaccagcatcagccccctgaacgtggtgcagggcgccagcgtgaacagcagctag

SEQ ID NO: 74656 - DNA, 468 bp, Artificial Sequence; identical to SEQ ID NO: 74654
  Description of Artificial Sequence: Synthetic coding sequence

SEQ ID NO: 74657 - DNA, 159 bp, Artificial Sequence
  Description of Artificial Sequence: Synthetic coding sequence
atgagcctgcccagcagacagaccgccatcatcgtgaacccccccccccccgagtacatcaacaccaagaagaacggcagactgaccaaccagctgcagtacctgcagaaggtggtgctgaaggacctgtggaagcacagcttcagctggcccttctag

SEQ ID NO: 74658 - DNA, 291 bp, Artificial Sequence
  Description of Artificial Sequence: Synthetic coding sequence
atgagcctgcccagcagacagaccgccatcatcgtgaacccccccccccccgagtacatcaacaccaagaagaacggcagactgaccaaccagctgcagtacctgcagaaggtggtgctgaaggacctgtggaagcacagcttcagctggcccttccagagacccgtggacgccgtgaagctgcagctgcccgactactacaccatcatcaagaaccccatggacctgaacaccatcaagaagagactggagaacaagtactacgccaaggccagcgagtgcatcgagtag

SEQ ID NO: 74659 - DNA, 99 bp, Artificial Sequence
  Description of Artificial Sequence: Synthetic coding sequence
atgagcctgcccagcagacagaccgccatcatcgtgaacccccccccccccgagtacatcaacaccaagaagaacggcagactgaccaaccagctgtag

SEQ ID NO: 74660 - DNA, 1398 bp, Artificial Sequence
  Description of Artificial Sequence: Synthetic coding sequence
atgagcctgcccagcagacagaccgccatcatcgtgaacccccccccccccgagtacatcaacaccaagaagaacggcagactgaccaaccagctgcagtacctgcagaaggtggtgctgaaggacctgtggaagcacagcttcagctggcccttccagagacccgtggacgccgtgaagctgcagctgcccgactactacaccatcatcaagaaccccatggacctgaacaccatcaagaagagactggagaacaagtactacgccaaggccagcgagtgcatcgaggacttcaacaccatgttcagcaactgctacctgtacaacaagcccggcgacgacatcgtgctgatggcccaggccctggagaagctgttcatgcagaagctgagccagatgccccaggaggagcaggtggtgggcgtgaaggagagaatcaagaagggcacccagcagaacatcgccgtgagcagcgccaaggagaagagcagccccagcgccaccgagaaggtgttcaagcagcaggagatccccagcgtgttccccaagaccagcatcagccccctgaacgtggtgcagggcgccagcgtgaacagcagcagccagaccgccgcccaggtgaccaagggcgtgaagagaaaggccgacaccaccacccccgccaccagcgccgtgaaggccagcagcgagttcagccccaccttcaccgagaagagcgtggccctgccccccatcaaggagaacatgcccaagaacgtgctgcccgacagccagcagcagtacaacgtggtgaagaccgtgaaggtgaccgagcagctgagacactgcagcgagatcctgaaggagatgctggccaagaagcacttcagctacgcctggcccttctacaaccccgtggacgtgaacgccctgggcctgcacaactactacgacgtggtgaagaaccccatggacctgggcaccatcaaggagaagatggacaaccaggagtacaaggacgcctacaagttcgccgccgacgtgagactgatgttcatgaactgctacaagtacaacccccccgaccacgaggtggtgaccatggccagaatgctgcaggacgtgttcgagacccacttcagcaagatccccatcgagcccgtggagagcatgcccctgtgctacatcaagaccgacatcaccgagaccaccggcagagagaacaccaacgaggccagcagcgagggcaacagcagcgacgacagcgaggacgagagagtgaagagactggccaagctgcaggagcagctgaaggccgtgcaccagcagctgcaggtgctgagccaggtgcccttcagaaagctgaacaagaagaaggagaagagcaagaaggagaagaagaaggagaagaagaagtag

SEQ ID NO: 74661 - DNA, 303 bp, Artificial Sequence
  Description of Artificial Sequence: Synthetic coding sequence
atgagcctgcccagcagacagaccgccatcatcgtgaacccccccccccccgagtacatcaacaccaagaagaacggcagactgaccaaccagctgcagtacctgcagaaggtggtgctgaaggacctgtggaagcacagcttcagctggcccttccagagacccgtggacgccgtgaagctgcagctgcccgactactacaccatcatcaagaaccccatggacctgaacaccatcaagaagagactggagaacaagtactacgccaaggccagcgagtgcatcgaggacttcaacacctag

SEQ ID NO: 74662 - DNA, 5550 bp, Artificial Sequence
  Description of Artificial Sequence: Synthetic coding sequence
atggccgtgagcagactggacagactgttcatcctgctggacaccggcaccacccccgtgaccagaaaggccgccgcccagcagctgggcgaggtggtgaagctgcacccccacgagctgaacaacctgctgagcaaggtgctgatctacctgagaagcgccaactgggacaccagaatcgccgccggccaggccgtggaggccatcgtgaagaacgtgcccgagtggaaccccgtgcccagaaccagacaggagcccaccagcgagagcagcatggaggacagccccaccaccgagagactgaacttcgacagattcgacatctgcagactgctgcagcacggcgccagcctgctgggcagcgccggcgccgagttcgaggtgcaggacgagaagagcggcgaggtggaccccaaggagagaatcgccagacagagaaagctgctgcagaagaagctgggcctgaacatgggcgaggccatcggcatgagcaccgaggagctgttcaacgacgaggacctggactacacccccaccagcgccagcttcgtgaacaagcagcccaccctgcaggccgccgagctgatcgacagcgagttcagagccggcatgagcaacagacagaagaacaaggccaagagaatggccaagctgttcgccaagcagagaagcagagacgccgtggagaccaacgagaagagcaacgacagcaccgacggcgagcccgaggagaagagaagaaagatcgccaacgtggtgatcaaccagagcgccaacgacagcaaggtgctgatcgacaacatccccgacagcagcagcctgatcgaggagaccaacgagtggcccctggagagcttctgcgaggagctgtgcaacgacctgttcaaccccagctgggaggtgagacacggcgccggcaccggcctgagagagatcctgaaggcccacggcaagagcggcggcaagatgggcgacagcaccctggaggagatgatccagcagcaccaggagtggctggaggacctggtgatcagactgctgtgcgtgttcgccctggacagattcggcgacttcgtgagcgacgaggtggtggcccccgtgagagagacctgcgcccagaccctgggcgtggtgctgaagcacatgaacgagaccggcgtgcacaagaccgtggacgtgctgctgaagctgctgacccaggagcagtgggaggtgagacacggcggcctgctgggcatcaagtacgccctggccgtgagacaggacgtgatcaacaccctgctgcccaaggtgctgaccagaatcatcgagggcctgcaggacctggacgacgacgtgagagccgtggccgccgccagcctggtgcccgtggtggagagcctggtgtacctgcagacccagaaggtgcccttcatcatcaacaccctgtgggacgccctgctggagctggacgacctgaccgccagcaccaacagcatcatgaccctgctgagcagcctgctgacctacccccaggtgcagcagtgcagcatccagcagagcctgaccgtgctggtgcccagagtgtggcccttcctgcaccacaccatcagcagcgtgagaagagccgccctggagaccctgttcaccctgctgagcacccaggaccagaacagcagcagctggctgatccccatcctgcccgacatgctgagacacatcttccagttctgcgtgctggagagcagccaggagatcctggacctgatccacaaggtgtggatggagctgctgagcaaggccagcgtgcagtacgtggtggccgccgcctgcccctggatgggcgcctggctgtgcctgatgatgcagcccagccacctgcccatcgacctgaacatgctgctggaggtgaaggccagagccaaggagaagaccggcggcaaggtgagacagggccagagccagaacaaggaggtgctgcaggagtacatcgccggcgccgacaccatcatggaggaccccgccaccagagacttcgtggtgatgagagccagaatgatggccgccaagctgctgggcgccctgtgctgctgcatctgcgaccccggcgtgaacgtggtgacccaggagatcaagcccgccgagagcctgggccagctgctgctgttccacctgaacagcaagagcgccctgcagagaatcagcgtggccctggtgatctgcgagtgggccgccctgcagaaggagtgcaaggccgtgaccctggccgtgcagcccagactgctggacatcctgagcgagcacctgtactacgacgagatcgccgtgcccttcaccagaatgcagaacgagtgcaagcagctgatcagcagcctggccgacgtgcacatcgaggtgggcaacagagtgaacaacaacgtgctgaccatcgaccaggccagcgacctggtgaccaccgtgttcaacgaggccaccagcagcttcgacctgaacccccaggtgctgcagcagctggacagcaagagacagcaggtgcagatgaccgtgaccgagaccaaccaggagtggcaggtgctgcagctgagagtgcacaccttcgccgcctgcgccgtggtgagcctgcagcagctgcccgagaagctgaaccccatcatcaagcccctgatggagaccatcaagaaggaggagaacaccctggtgcagaactacgccgcccagtgcatcgccaagctgctgcagcagtgcaccaccagaaccccctgccccaacagcaagatcatcaagaacctgtgcagcagcctgtgcgtggacccctacctgaccccctgcgtgacctgccccgtgcccacccagagcggccaggagaacagcaagggcagcaccagcgagaaggacggcatgcaccacaccgtgaccaagcacagaggcatcatcaccctgtacagacaccagaaggccgccttcgccatcaccagcagaagaggccccacccccaaggccgtgaaggcccagatcgccgacctgcccgccggcagcagcggcaacatcctggtggagctggacgaggcccagaagccctacctggtgcagagaagaggcgccgagttcgccctgaccaccatcgtgaagcacttcggcggcgagatggccgtgaagctgccccacctgtgggacgccatggtgggccccctgagaaacaccatcgacatcaacaacttcgacggcaagagcctgctggacaagggcgacagccccgcccaggagctggtgaacagcctgcaggtgttcgagaccgccgccgccagcatggacagcgagctgcaccccctgctggtgcagcacctgccccacctgtacatgtgcctgcagtaccccagcaccgccgtgagacacatggccgccagatgcgtgggcgtgatgagcaagatcgccaccatggagaccatgaacatcttcctggagaaggtgctgccctggctgggcgccatcgacgacagcgtgaagcaggagggcgccatcgaggccctggcctgcgtgatggagcagctggacgtgggcatcgtgccctacatcgtgctgctggtggtgcccgtgctgggcagaatgagcgaccagaccgacagcgtgagattcatggccacccagtgcttcgccaccctgatcagactgatgcccctggaggccggcatccccgacccccccaacatgagcgccgagctgatccagctgaaggccaaggagagacacttcctggagcagctgctggacggcaagaagctggagaactacaagatccccgtgcccatcaacgccgagctgagaaagtaccagcaggacggcgtgaactggctggccttcctgaacaagtacaagctgcacggcatcctgtgcgacgacatgggcctgggcaagaccctgcagagcatctgcatcctggccggcgaccactgccacagagcccaggagtacgccagaagcaagctggccgagtgcatgcccctgcccagcctggtggtgtgcccccccaccctgaccggccactgggtggacgaggtgggcaagttctgcagcagagagtacctgaaccccctgcactacaccggcccccccaccgagagaatcagactgcagcaccaggtgaagagacacaacctgatcgtggccagctacgacgtggtgagaaacgacatcgacttcttcagaaacatcaagttcaactactgcatcctggacgagggccacgtgatcaagaacggcaagaccaagctgagcaaggccgtgaagcagctgaccgccaactacagaatcatcctgagcggcacccccatccagaacaacgtgctggagctgtggagcctgttcgacttcctgatgcccggcttcctgggcaccgagagacagttcgccgccagatacggcaagcccatcctggccagcagagacgccagaagcagcagcagagagcaggaggccggcgtgctggccatggacgccctgcacagacaggtgctgcccttcctgctgagaagaatgaaggaggacgtgctgcaggacctgccccccaagatcatccaggactactactgcaccctgagccccctgcaggtgcagctgtacgaggacttcgccaagagcagagccaagtgcgacgtggacgagaccgtgagcagcgccaccctgagcgaggagaccgagaagcccaagctgaaggccaccggccacgtgttccaggccctgcagtacctgagaaagctgtgcaaccaccccgccctggtgctgaccccccagcaccccgagttcaagaccaccgccgagaagctggccgtgcagaacagcagcctgcacgacatccagcacgcccccaagctgagcgccctgaagcagctgctgctggactgcggcctgggcaacggcagcaccagcgagagcggcaccgagagcgtggtggcccagcacagaatcctgatcttctgccagctgaagagcatgctggacatcgtggagcacgacctgctgaagccccacctgcccagcgtgacctacctgagactggacggcagcatcccccccggccagagacacagcatcgtgagcagattcaacaacgaccccagcatcgacgtgctgctgctgaccacccacgtgggcggcctgggcctgaacctgaccggcgccgacaccgtggtgttcgtggagcacgactggaaccccatgagagacctgcaggccatggacagagcccacagaatcggccagaagagagtggtgaacgtgtacagactgatcaccagaggcaccctggaggagaagatcatgggcctgcagaagttcaagatgaacatcgccaacaccgtgatcagccaggagaacagcagcctgcagagcatgggcaccgaccagctgctggacctgttcaccctggacaaggacggcaaggccgagaaggccgacaccagcaccagcggcaaggccagcatgaagagcatcctggagaacctgagcgacctgtgggaccaggagcagtacgacagcgagtacagcctggagaacttcatgcacagcctgaagtag

SEQ ID NO: 74663 - DNA, 2100 bp, Artificial Sequence
  Description of Artificial Sequence: Synthetic coding sequence
aagctgtggttcaagaacaccgaggactacagaagaaccgccctgaccagactgaccagcggcgtgatggagcagctggacgtgggcatcgtgccctacatcgtgctgctggtggtgcccgtgctgggcagaatgagcgaccagaccgacagcgtgagattcatggccacccagtgcttcgccaccctgatcagactgatgcccctggaggccggcatccccgacccccccaacatgagcgccgagctgatccagctgaaggccaaggagagacacttcctggagcagctgctggacggcaagaagctggagaactacaagatccccgtgcccatcaacgccgagctgagaaagtaccagcaggacggcgtgaactggctggccttcctgaacaagtacaagctgcacggcatcctgtgcgacgacatgggcctgggcaagaccctgcagagcatctgcatcctggccggcgaccactgccacagagcccaggagtacgccagaagcaagctggccgagtgcatgcccctgcccagcctggtggtgtgcccccccaccctgaccggccactgggtggacgaggtgggcaagttctgcagcagagagtacctgaaccccctgcactacaccggcccccccaccgagagaatcagactgcagcaccaggtgaagagacacaacctgatcgtggccagctacgacgtggtgagaaacgacatcgacttcttcagaaacatcaagttcaactactgcatcctggacgagggccacgtgatcaagaacggcaagaccaagctgagcaaggccgtgaagcagctgaccgccaactacagaatcatcctgagcggcacccccatccagaacaacgtgctggagctgtggagcctgttcgacttcctgatgcccggcttcctgggcaccgagagacagttcgccgccagatacggcaagcccatcctggccagcagagacgccagaagcagcagcagagagcaggaggccggcgtgctggccatggacgccctgcacagacaggtgctgcccttcctgctgagaagaatgaaggaggacgtgctgcaggacctgccccccaagatcatccaggactactactgcaccctgagccccctgcaggtgcagctgtacgaggacttcgccaagagcagagccaagtgcgacgtggacgagaccgtgagcagcgccaccctgagcgaggagaccgagaagcccaagctgaaggccaccggccacgtgttccaggccctgcagtacctgagaaagctgtgcaaccaccccgccctggtgctgaccccccagcaccccgagttcaagaccaccgccgagaagctggccgtgcagaacagcagcctgcacgacatccagcacgcccccaagctgagcgccctgaagcagctgctgctggactgcggcctgggcaacggcagcaccagcgagagcggcaccgagagcgtggtggcccagcacagaatcctgatcttctgccagctgaagagcatgctggacatcgtggagcacgacctgctgaagccccacctgcccagcgtgacctacctgagactggacggcagcatcccccccggccagagacacagcatcgtgagcagattcaacaacgaccccagcatcgacgtgctgctgctgaccacccacgtgggcggcctgggcctgaacctgaccggcgccgacaccgtggtgttcgtggagcacgactggaaccccatgagagacctgcaggccatggacagagcccacagaatcggccagaagagagtggtgaacgtgtacagactgatcaccagaggcaccctggaggagaagatcatgggcctgcagaagttcaagatgaacatcgccaacaccgtgatcagccaggagaacagcagcctgcagagcatgggcaccgaccagctgctggacctgttcaccctggacaaggacggcaaggccgagaaggccgacaccagcaccagcggcaaggccagcatgaagagcatcctggagaacctgagcgacctgtgggaccaggagcagtacgacagcgagtacagcctggagaacttcatgcacagcctgaagtag

SEQ ID NO: 74664 - DNA, 2034 bp, Artificial Sequence
  Description of Artificial Sequence: Synthetic coding sequence
atggagcagctggacgtgggcatcgtgccctacatcgtgctgctggtggtgcccgtgctgggcagaatgagcgaccagaccgacagcgtgagattcatggccacccagtgcttcgccaccctgatcagactgatgcccctggaggccggcatccccgacccccccaacatgagcgccgagctgatccagctgaaggccaaggagagacacttcctggagcagctgctggacggcaagaagctggagaactacaagatccccgtgcccatcaacgccgagctgagaaagtaccagcaggacggcgtgaactggctggccttcctgaacaagtacaagctgcacggcatcctgtgcgacgacatgggcctgggcaagaccctgcagagcatctgcatcctggccggcgaccactgccacagagcccaggagtacgccagaagcaagctggccgagtgcatgcccctgcccagcctggtggtgtgcccccccaccctgaccggccactgggtggacgaggtgggcaagttctgcagcagagagtacctgaaccccctgcactacaccggcccccccaccgagagaatcagactgcagcaccaggtgaagagacacaacctgatcgtggccagctacgacgtggtgagaaacgacatcgacttcttcagaaacatcaagttcaactactgcatcctggacgagggccacgtgatcaagaacggcaagaccaagctgagcaaggccgtgaagcagctgaccgccaactacagaatcatcctgagcggcacccccatccagaacaacgtgctggagctgtggagcctgttcgacttcctgatgcccggcttcctgggcaccgagagacagttcgccgccagatacggcaagcccatcctggccagcagagacgccagaagcagcagcagagagcaggaggccggcgtgctggccatggacgccctgcacagacaggtgctgcccttcctgctgagaagaatgaaggaggacgtgctgcaggacctgccccccaagatcatccaggactactactgcaccctgagccccctgcaggtgcagctgtacgaggacttcgccaagagcagagccaagtgcgacgtggacgagaccgtgagcagcgccaccctgagcgaggagaccgagaagcccaagctgaaggccaccggccacgtgttccaggccctgcagtacctgagaaagctgtgcaaccaccccgccctggtgctgaccccccagcaccccgagttcaagaccaccgccgagaagctggccgtgcagaacagcagcctgcacgacatccagcacgcccccaagctgagcgccctgaagcagctgctgctggactgcggcctgggcaacggcagcaccagcgagagcggcaccgagagcgtggtggcccagcacagaatcctgatcttctgccagctgaagagcatgctggacatcgtggagcacgacctgctgaagccccacctgcccagcgtgacctacctgagactggacggcagcatcccccccggccagagacacagcatcgtgagcagattcaacaacgaccccagcatcgacgtgctgctgctgaccacccacgtgggcggcctgggcctgaacctgaccggcgccgacaccgtggtgttcgtggagcacgactggaaccccatgagagacctgcaggccatggacagagcccacagaatcggccagaagagagtggtgaacgtgtacagactgatcaccagaggcaccctggaggagaagatcatgggcctgcagaagttcaagatgaacatcgccaacaccgtgatcagccaggagaacagcagcctgcagagcatgggcaccgaccagctgctggacctgttcaccctggacaaggacggcaaggccgagaaggccgacaccagcaccagcggcaaggccagcatgaagagcatcctggagaacctgagcgacctgtgggaccaggagcagtacgacagcgagtacagcctggagaacttcatgcacagcctgaagtag

SEQ ID NO: 74665 - DNA, 1233 bp, Artificial Sequence
  Description of Artificial Sequence: Synthetic coding sequence
atgggcgccaacgccagcaactacccccacagctgcagccccagagtgggcggcaacagccaggcccagcagaccttcatcggcaccagcagctacagccagcagggctacggctgcgagagcaagctgtacagcctggaccacggccacgagaagccccaggacaagaagaagagaaccagcggcctggccaccctgaagaagaagttcatcaagagaagaaagagcaacagaagcgccgaccacgccaagcagatgagagagctgctgagcggctgggacgtgagagacgtgaacgccctggtggaggagtacgagggcaccagcgccctgaaggagctgagcctgcaggccagcctggccagacccgaggccagaaccctgcagaaggacatggccgacctgtacgagtacaagtactgcaccgacgtggacctgatcttccaggagacctgcttccccgtgcacagagccatcctggccgccagatgccccttcttcaagaccctgctgagcagcagccccgagtacggcgccgagatcatcatggacatcaacaccgccggcatcgacatgcccatgttcagcgccctgctgcactacctgtacaccggcgagttcggcatggaggacagcagattccagaacgtggacatcctggtgcagctgagcgaggagttcggcacccccaacagcctggacgtggacatgagaggcctgttcgactacatgtgctactacgacgtggtgctgagcttcagcagcgacagcgagctggtggaggccttcggcggcaaccagaactgcctggacgaggagctgaaggcccacaaggccgtgatcagcgccagaagccccttcttcagaaacctgctgcagagaagaatcagaaccggcgaggagatcaccgacagaaccctgagaacccccaccagaatcatcctggacgagagcatcatccccaagaagtacgccaccgtgatcctgcactgcatgtacaccgacgtggtggacctgagcgtgctgcactgcagccccagcgtgggcagcctgagcgaggtgcaggccctggtggccggcaagcccaacatgaccagagccgaggaggccatggagctgtaccacatcgccctgttcctggagttcaacatgctggcccaggaggagaccaccgtgatcagacccgcctgcgccgccgagctgagcaacagctgcctgctgccccagagctag

SEQ ID NO: 74666 - DNA, 3399 bp, Artificial Sequence
  Description of Artificial Sequence: Synthetic coding sequence
atgggcgccaacgccagcaactacccccacagctgcagccccagagtgggcggcaacagccaggcccagcagaccttcatcggcaccagcagctacagccagcagggctacggctgcgagagcaagctgtacagcctggaccacggccacgagaagccccaggacaagaagaagagaaccagcggcctggccaccctgaagaagaagttcatcaagagaagaaagagcaacagaagcgccgaccacgccaagcagatgagagagctgctgagcggctgggacgtgagagacgtgaacgccctggtggaggagtacgagggcaccagcgccctgaaggagctgagcctgcaggccagcctggccagacccgaggccagaaccctgcagaaggacatggccgacctgtacgagtacaagtactgcaccgacgtggacctgatcttccaggagacctgcttccccgtgcacagagccatcctggccgccagatgccccttcttcaagaccctgctgagcagcagccccgagtacggcgccgagatcatcatggacatcaacaccgccggcatcgacatgcccatgttcagcgccctgctgcactacctgtacaccggcgagttcggcatggaggacagcagattccagaacgtggacatcctggtgcagctgagcgaggagttcggcacccccaacagcctggacgtggacatgagaggcctgttcgactacatgtgctactacgacgtggtgctgagcttcagcagcgacagcgagctggtggaggccttcggcggcaaccagaactgcctggacgaggagctgaaggcccacaaggccgtgatcagcgccagaagccccttcttcagaaacctgctgcagagaagaatcagaaccggcgaggagatcaccgacagaaccctgagaacccccaccagaatcatcctggacgagagcatcatccccaagaagtacgccaccgtgatcctgcactgcatgtacaccgacgtggtggacctgagcgtgctgcactgcagccccagcgtgggcagcctgagcgaggtgcaggccctggtggccggcaagcccaacatgaccagagccgaggaggccatggagctgtaccacatcgccctgttcctggagttcaacatgctggcccagggctgcgaggacatcatcgccgagagcatcagcctggacaccctgatcgccatcctgaagtggagcagccacccctacggcagcaagtgggtgcacagacaggccctgcacttcctgtgcgaggagttcagccaggtgatgaccagcgacgtgttctacgagctgagcaaggaccacctgctgaccgccatccagagcgactacctgcaggccagcgagcaggacatcctgaagtacctgatcaagtggggcgagcaccagctgatgaagagaatcgccgacagagagcccaacctgctgagcggcaccgcccacagcgtgaacaagagaggcgtgaagagaagagacctggacatggaggagctgagagagatcctgagcagcctgctgcccttcgtgagaatcgagcacatcctgcccatcaacagcgaggtgctgagcgacgccatgaagagaggcctgatcagcaccccccccagcgacatgctgcccaccaccgagggcggcaagagcaacgcctggctgagacagaagaacgccggcatctacgtgagacccagactgttcagcccctacgtggaggaggccaagagcgtgctggacgagatgatggtggagcagaccgacctggtgagactgagaatggtgagaatgagcaacgtgcccgacaccctgtacatggtgaacaacgccgtgccccagtgctgccacatgatcagccaccagcagatcagcagcaaccagagcagcccccccagcgtggtggccaacgagatccccgtgcccagactgctgatcatgaaggacatggtgagaagactgcaggagctgagacacaccgagcaggtgcagagagcctacgccctgaactgcggcgagggcgccaccgtgagctacgagatccagatcagagtgctgagagagttcggcctggccgacgccgccgccgagctgctgcagaacccccacaagttcttccccgacgagagattcggcgacgagagccccctgctgaccatgagacagcccggcagatgcagagtgaacagcaccccccccgccgagaccatgttcaccgacctggacagcttcgtggccttccacccccccctgcccccccccccccccccctaccacccccccgccacccccatccacaaccagctgaaggccggctggaagcagagaccccccagccagcaccccagcagaagcttcagctacccctgcaaccacagcctgttccacagcagaaccgcccccaaggccggccccccccccgtgtacctgcccagcgtgaaggccgccccccccgactgcaccagcaccgccggcctgggcagacagaccgtggccgccgccgccgccaccaccaccagcaccgccaccgccgccgccgccgccgccagcgagaagcaggtgagaacccagcccgtgctgaacgacctgatgcccgacatcgccgtgggcgtgagcaccctgagcctgaaggacagaagactgcccgagctggccgtggacaccgagctgagccagagcgtgagcgaggccggccccggccccccccagcacctgagctgcatcccccagagacacacccacaccagcagaaagaagcacaccctggagcagaagaccgacaccagagagaacccccaggagtaccccgacttctacgacttcagcaacgccgcctgcagacccagcacccccgccctgagcagaagaacccccagccccagccagggcggctacttcggccccgacctgtacagccacaacaaggccagccccagcggcctgaagagcgcctacctgcccggccagaccagccccaagaagcaggaggaggccagaagagagtaccccctgagccccgacggccacctgcacagacagaagaacgagcccatccacctggacgtggtggagcagcccccccagagaagcgacttccccctggccgcccccgagaacgccagcaccggccccgcccacgtgagaggcagaaccgccgtggagaccgacctgaccttcggcctgacccccaacagacccagcctgagcgcctgcagcagcgaggcccccgaggagagaagcggcagaagactggccgacagcgagagcctgggccacggcgcccagagaaacaccgacctggagagagaggacagcatcagcagaggcagaagaagccccagcaagcccgacttcctgtacaagaagagcgccctgtag

SEQ ID NO: 74667 - DNA, 2121 bp, Artificial Sequence
  Description of Artificial Sequence: Synthetic coding sequence
atgtacaccgacgtggtggacctgagcgtgctgcactgcagccccagcgtgggcagcctgagcgaggtgcaggccctggtggccggcaagcccaacatgaccagagccgaggaggccatggagctgtaccacatcgccctgttcctggagttcaacatgctggcccaggagcccaacctgctgagcggcaccgcccacagcgtgaacaagagaggcgtgaagagaagagacctggacatggaggagctgagagagatcctgagcagcctgctgcccttcgtgagaatcgagcacatcctgcccatcaacagcgaggtgctgagcgacgccatgaagagaggcctgatcagcaccccccccagcgacatgctgcccaccaccgagggcggcaagagcaacgcctggctgagacagaagaacgccggcatctacgtgagacccagactgttcagcccctacgtggaggaggccaagagcgtgctggacgagatgatggtggagcagaccgacctggtgagactgagaatggtgagaatgagcaacgtgcccgacaccctgtacatggtgaacaacgccgtgccccagtgctgccacatgatcagccaccagcagatcagcagcaaccagagcagcccccccagcgtggtggccaacgagatccccgtgcccagactgctgatcatgaaggacatggtgagaagactgcaggagctgagacacaccgagcaggtgcagagagcctacgccctgaactgcggcgagggcgccaccgtgagctacgagatccagatcagagtgctgagagagttcggcctggccgacgccgccgccgagctgctgcagaacccccacaagttcttccccgacgagagattcggcgacgagagccccctgctgaccatgagacagcccggcagatgcagagtgaacagcaccccccccgccgagaccatgttcaccgacctggacagcttcgtggccttccacccccccctgcccccccccccccccccctaccacccccccgccacccccatccacaaccagctgaaggccggctggaagcagagaccccccagccagcaccccagcagaagcttcagctacccctgcaaccacagcctgttccacagcagaaccgcccccaaggccggccccccccccgtgtacctgcccagcgtgaaggccgccccccccgactgcaccagcaccgccggcctgggcagacagaccgtggccgccgccgccgccaccaccaccagcaccgccaccgccgccgccgccgccgccagcgagaagcaggtgagaacccagcccgtgctgaacgacctgatgcccgacatcgccgtgggcgtgagcaccctgagcctgaaggacagaagactgcccgagctggccgtggacaccgagctgagccagagcgtgagcgaggccggccccggccccccccagcacctgagctgcatcccccagagacacacccacaccagcagaaagaagcacaccctggagcagaagaccgacaccagagagaacccccaggagtaccccgacttctacgacttcagcaacgccgcctgcagacccagcacccccgccctgagcagaagaacccccagccccagccagggcggctacttcggccccgacctgtacagccacaacaaggccagccccagcggcctgaagagcgcctacctgcccggccagaccagccccaagaagcaggaggaggccagaagagagtaccccctgagccccgacggccacctgcacagacagaagaacgagcccatccacctggacgtggtggagcagcccccccagagaagcgacttccccctggccgcccccgagaacgccagcaccggccccgcccacgtgagaggcagaaccgccgtggagaccgacctgaccttcggcctgacccccaacagacccagcctgagcgcctgcagcagcgaggcccccgaggagagaagcggcagaagactggccgacagcgagagcctgggccacggcgcccagagaaacaccgacctggagagagaggacagcatcagcagaggcagaagaagccccagcaagcccgacttcctgtacaagaagagcgccctgtag

SEQ ID NO: 74668 - DNA, 2346 bp, Artificial Sequence
  Description of Artificial Sequence: Synthetic coding sequence
atggccggcggcgccggcgccggcgccgacggcggcgccggcggcggcggcggcggcggcgacggcagcggccccagcggcagcagcagcggcggcagaagcctgagaggctgcgaggacatcatcgccgagagcatcagcctggacaccctgatcgccatcctgaagtggagcagccacccctacggcagcaagtgggtgcacagacaggccctgcacttcctgtgcgaggagttcagccaggtgatgaccagcgacgtgttctacgagctgagcaaggaccacctgctgaccgccatccagagcgactacctgcaggccagcgagcaggacatcctgaagtacctgatcaagtggggcgagcaccagctgatgaagagaatcgccgacagagagcccaacctgctgagcggcaccgcccacagcgtgaacaagagaggcgtgaagagaagagacctggacatggaggagctgagagagatcctgagcagcctgctgcccttcgtgagaatcgagcacatcctgcccatcaacagcgaggtgctgagcgacgccatgaagagaggcctgatcagcaccccccccagcgacatgctgcccaccaccgagggcggcaagagcaacgcctggctgagacagaagaacgccggcatctacgtgagacccagactgttcagcccctacgtggaggaggccaagagcgtgctggacgagatgatggtggagcagaccgacctggtgagactgagaatggtgagaatgagcaacgtgcccgacaccctgtacatggtgaacaacgccgtgccccagtgctgccacatgatcagccaccagcagatcagcagcaaccagagcagcccccccagcgtggtggccaacgagatccccgtgcccagactgctgatcatgaaggacatggtgagaagactgcaggagctgagacacaccgagcaggtgcagagagcctacgccctgaactgcggcgagggcgccaccgtgagctacgagatccagatcagagtgctgagagagttcggcctggccgacgccgccgccgagctgctgcagaacccccacaagttcttccccgacgagagattcggcgacgagagccccctgctgaccatgagacagcccggcagatgcagagtgaacagcaccccccccgccgagaccatgttcaccgacctggacagcttcgtggccttccacccccccctgcccccccccccccccccctaccacccccccgccacccccatccacaaccagctgaaggccggctggaagcagagaccccccagccagcaccccagcagaagcttcagctacccctgcaaccacagcctgttccacagcagaaccgcccccaaggccggccccccccccgtgtacctgcccagcgtgaaggccgccccccccgactgcaccagcaccgccggcctgggcagacagaccgtggccgccgccgccgccaccaccaccagcaccgccaccgccgccgccgccgccgccagcgagaagcaggtgagaacccagcccgtgctgaacgacctgatgcccgacatcgccgtgggcgtgagcaccctgagcctgaaggacagaagactgcccgagctggccgtggacaccgagctgagccagagcgtgagcgaggccggccccggccccccccagcacctgagctgcatcccccagagacacacccacaccagcagaaagaagcacaccctggagcagaagaccgacaccagagagaacccccaggagtaccccgacttctacgacttcagcaacgccgcctgcagacccagcacccccgccctgagcagaagaacccccagccccagccagggcggctacttcggccccgacctgtacagccacaacaaggccagccccagcggcctgaagagcgcctacctgcccggccagaccagccccaagaagcaggaggaggccagaagagagtaccccctgagccccgacggccacctgcacagacagaagaacgagcccatccacctggacgtggtggagcagcccccccagagaagcgacttccccctggccgcccccgagaacgccagcaccggccccgcccacgtgagaggcagaaccgccgtggagaccgacctgaccttcggcctgacccccaacagacccagcctgagcgcctgcagcagcgaggcccccgaggagagaagcggcagaagactggccgacagcgagagcctgggccacggcgcccagagaaacaccgacctggagagagaggacagcatcagcagaggcagaagaagccccagcaagcccgacttcctgtacaagaagagcgccctgtag

SEQ ID NO: 74669 - DNA, 168 bp, Artificial Sequence
  Description of Artificial Sequence: Synthetic coding sequence
atgggcgccaacgccagcaactacccccacagctgcagccccagagtgggcggcaacagccaggcccagcagaccttcatcggcaccagcagctacagccagcagggctacggctgcgagagcaagctgtacagcctggaccacggccacgagaagccccaggactag

SEQ ID NO: 74670 - DNA, 1635 bp, Artificial Sequence
  Description of Artificial Sequence: Synthetic coding sequence
atgagagagagccagcccgaggccgagatccccctgcaggacaccaccgccgaggccttcaccatgctgctgaagtacatctacaccggcagagccaccctgaccgacgagaaggaggaggtgctgctggacttcctgagcctggcccacaagtacggcttccccgagctggaggacagcaccagcgagtacctgtgcaccatcctgaacatccagaacgtgtgcatgaccttcgacgtggccagcctgtacagcctgcccaagctgacctgcatgtgctgcatgttcatggacagaaacgcccaggaggtgctgagcagcgagggcttcctgagcctgagcaagaccgccctgctgaacatcgtgctgagagacagcttcgccgcccccgagaaggacatcttcctggccctgctgaactggtgcaagcacaacagcaaggagaaccacgccgagatcatgcaggccgtgagactgcccctgatgagcctgaccgagctgctgaacgtggtgagacccagcggcctgctgagccccgacgccatcctggacgccatcaaggtgagaagcgagagcagagacatggacctgaactacagaggcatgctgatccccgaggagaacatcgccaccatgaagtacggcgcccaggtggtgaagggcgagctgaagagcgccctgctggacggcgacacccagaactacgacctggaccacggcttcagcagacaccccatcgacgacgactgcagaagcggcatcgagatcaagctgggccagcccagcatcatcaaccacatcagaatcctgctgtgggacagagacagcagaagctacagctacttcatcgaggtgagcatggacgagctggactgggtgagagtgatcgaccacagccagtacctgtgcagaagctggcagaagctgtacttccccgccagagtgtgcagatacatcagaatcgtgggcacccacaacaccgtgaacaagatcttccacatcgtggccttcgagtgcatgttcaccaacaagaccttcaccctggagaagggcctgatcgtgcccatggagaacgtggccaccatcgccgactgcgccagcgtgatcgagggcgtgagcagaagcagaaacgccctgctgaacggcgacaccaagaactacgactgggacagcggctacacctgccaccagctgggcagcggcgccatcgtggtgcagctggcccagccctacatgatcggcagcatcagactgctgctgtgggactgcgacgacagaagctacagctactacgtggaggtgagcaccaaccagcagcagtggaccatggtggccgacagaaccaaggtgagctgcaagagctggcagagcgtgaccttcgagagacagcccgccagcttcatcagaatcgtgggcacccacaacaccgccaacgaggtgttccactgcgtgcacttcgagtgccccgagcagcagagcagccagaaggaggagaacagcgaggagagcggcaccggcgacaccagcctggccggccagcagctggacagccacgccctgagagcccccagcggcagcagcctgcccagcagccccggcagcaacagcagaagccccaacagacagcaccagtag

SEQ ID NO: 74671 - DNA, 1839 bp, Artificial Sequence
  Description of Artificial Sequence: Synthetic coding sequence
atgagcaacagccaccccctgagacccttcaccgccgtgggcgagatcgaccacgtgcacatcctgagcgagcacatcggcgccctgctgatcggcgaggagtacggcgacgtgaccttcgtggtggagaagaagagattccccgcccacagagtgatcctggccgccagatgccagtacttcagagccctgctgtacggcggcatgagagagagccagcccgaggccgagatccccctgcaggacaccaccgccgaggccttcaccatgctgctgaagtacatctacaccggcagagccaccctgaccgacgagaaggaggaggtgctgctggacttcctgagcctggcccacaagtacggcttccccgagctggaggacagcaccagcgagtacctgtgcaccatcctgaacatccagaacgtgtgcatgaccttcgacgtggccagcctgtacagcctgcccaagctgacctgcatgtgctgcatgttcatggacagaaacgcccaggaggtgctgagcagcgagggcttcctgagcctgagcaagaccgccctgctgaacatcgtgctgagagacagcttcgccgcccccgagaaggacatcttcctggccctgctgaactggtgcaagcacaacagcaaggagaaccacgccgagatcatgcaggccgtgagactgcccctgatgagcctgaccgagctgctgaacgtggtgagacccagcggcctgctgagccccgacgccatcctggacgccatcaaggtgagaagcgagagcagagacatggacctgaactacagaggcatgctgatccccgaggagaacatcgccaccatgaagtacggcgcccaggtggtgaagggcgagctgaagagcgccctgctggacggcgacacccagaactacgacctggaccacggcttcagcagacaccccatcgacgacgactgcagaagcggcatcgagatcaagctgggccagcccagcatcatcaaccacatcagaatcctgctgtgggacagagacagcagaagctacagctacttcatcgaggtgagcatggacgagctggactgggtgagagtgatcgaccacagccagtacctgtgcagaagctggcagaagctgtacttccccgccagagtgtgcagatacatcagaatcgtgggcacccacaacaccgtgaacaagatcttccacatcgtggccttcgagtgcatgttcaccaacaagaccttcaccctggagaagggcctgatcgtgcccatggagaacgtggccaccatcgccgactgcgccagcgtgatcgagggcgtgagcagaagcagaaacgccctgctgaacggcgacaccaagaactacgactgggacagcggctacacctgccaccagctgggcagcggcgccatcgtggtgcagctggcccagccctacatgatcggcagcatcagactgctgctgtgggactgcgacgacagaagctacagctactacgtggaggtgagcaccaaccagcagcagtggaccatggtggccgacagaaccaaggtgagctgcaagagctggcagagcgtgaccttcgagagacagcccgccagcttcatcagaatcgtgggcacccacaacaccgccaacgaggtgttccactgcgtgcacttcgagtgccccgagcagcagagcagccagaaggaggagaacagcgaggagagcggcaccggcgacaccagcctggccggccagcagctggacagccacgccctgagagcccccagcggcagcagcctgcccagcagccccggcagcaacagcagaagccccaacagacagcaccagtag

SEQ ID NO: 74672 - DNA, 1635 bp, Artificial Sequence; identical to SEQ ID NO: 74670
  Description of Artificial Sequence: Synthetic coding sequence

SEQ ID NO: 74673 - DNA, 1839 bp, Artificial Sequence; identical to SEQ ID NO: 74671
  Description of Artificial Sequence: Synthetic coding sequence

SEQ ID NO: 74674 - DNA, 279 bp, Artificial Sequence
  Description of Artificial Sequence: Synthetic coding sequence
atgagcaacagccaccccctgagacccttcaccgccgtgggcgagatcgaccacgtgcacatcctgagcgagcacatcggcgccctgctgatcggcgaggagtacggcgacgtgaccttcgtggtggagaagaagagattccccgcccacagagtgatcctggccgccagatgccagtacttcagagccctgctgtacggcggcatgagagagagccagcccgaggccgagatccccctgcaggacaccaccgccgaggccttcaccatgctgctgtag

SEQ ID NO: 74675 - DNA, 1749 bp, Artificial Sequence
  Description of Artificial Sequence: Synthetic coding sequence
atgtgcagagccctgctgtacggcggcatgagagagagccagcccgaggccgagatccccctgcaggacaccaccgccgaggccttcaccatgctgctgaagtacatctacaccggcagagccaccctgaccgacgagaaggaggaggtgctgctggacttcctgagcctggcccacaagtacggcttccccgagctggaggacagcaccagcgagtacctgtgcaccatcctgaacatccagaacgtgtgcatgaccttcgacgtggccagcctgtacagcctgcccaagctgacctgcatgtgctgcatgttcatggacagaaacgcccaggaggtgctgagcagcgagggcttcctgagcctgagcaagaccgccctgctgaacatcgtgctgagagacagcttcgccgcccccgagaaggacatcttcctggccctgctgaactggtgcaagcacaacagcaaggagaaccacgccgagatcatgcaggccgtgagactgcccctgatgagcctgaccgagctgctgaacgtggtgagacccagcggcctgctgagccccgacgccatcctggacgccatcaaggtgagaagcgagagcagagacatggacctgaactacagaggcatgctgatccccgaggagaacatcgccaccatgaagtacggcgcccaggtggtgaagggcgagctgaagagcgccctgctggacggcgacacccagaactacgacctggaccacggcttcagcagacaccccatcgacgacgactgcagaagcggcatcgagatcaagctgggccagcccagcatcatcaaccacatcagaatcctgctgtgggacagagacagcagaagctacagctacttcatcgaggtgagcatggacgagctggactgggtgagagtgatcgaccacagccagtacctgtgcagaagctggcagaagctgtacttccccgccagagtgtgcagcggcgacggcgtgagcctgtggtgccccctgtggagcagaacccccgagctgaagcagagcagcctgctgggcctgcccaagtgcagatacatcagaatcgtgggcacccacaacaccgtgaacaagatcttccacatcgtggccttcgagtgcatgttcaccaacaagaccttcaccctggagaagggcctgatcgtgcccatggagaacgtggccaccatcgccgactgcgccagcgtgatcgagggcgtgagcagaagcagaaacgccctgctgaacggcgacaccaagaactacgactgggacagcggctacacctgccaccagctgggcagcggcgccatcgtggtgcagctggcccagccctacatgatcggcagcatcagactgctgctgtgggactgcgacgacagaagctacagctactacgtggaggtgagcaccaaccagcagcagtggaccatggtggccgacagaaccaaggtgagctgcaagagctggcagagcgtgaccttcgagagacagcccgccagcttcatcagaatcgtgggcacccacaacaccgccaacgaggtgttccactgcgtgcacttcgagtgccccgagcagcagagcagccagaaggaggagaacagcgaggagagcggcaccggcgacaccagcctggccggccagcagctggacagccacgccctgagagcccccagcggcagcagcctgcccagcagccccggcagcaacagcagaagccccaacagacagcaccagtag

SEQ ID NO: 74676 - DNA, 2211 bp, Artificial Sequence
  Description of Artificial Sequence: Synthetic coding sequence
atgagcctgagcgagaacagcgtgttcgcctacgagagcagcgtgcacagcaccaacgtgctgctgagcctgaacgaccagagaaagaaggacgtgctgtgcgacgtgaccatcttcgtggagggccagagattcagagcccacagaagcgtgctggccgcctgcagcagctacttccacagcagaatcgtgggccaggccgacggcgagctgaacatcaccctgcccgaggaggtgaccgtgaagggcttcgagcccctgatccagttcgcctacaccgccaagctgatcctgagcaaggagaacgtggacgaggtgtgcaagtgcgtggagttcctgagcgtgcacaacatcgaggagagctgcttccagttcctgaagttcaagttcctggacagcaccgccgaccagcaggagtgccccagaaagaagtgcttcagcagccactgccagaagaccgacctgaagctgagcctgctggaccagagagacctggagaccgacgaggtggaggagttcctggagaacaagaacgtgcagaccccccagtgcaagctgagaagataccagggcaacgccaaggccagcccccccctgcaggacagcgccagccagacctacgagagcatgtgcctggagaaggacgccgccctggccctgcccagcctgtgccccaagtacagaaagttccagaaggccttcggcaccgacagagtgagaaccggcgagagcagcgtgaaggacatccacgccagcgtgcagcccaacgagagaagcgagaacgagtgcctgggcggcgtgcccgagtgcagagacctgcaggtgatgctgaagtgcgacgagagcaagctggccatggagcccgaggagaccaagaaggaccccgccagccagtgccccaccgagaagagcgaggtgacccccttcccccacaacagcagcatcgacccccacggcctgtacagcctgagcctgctgcacacctacgaccagtacggcgacctgaacttcgccggcatgcagaacaccaccgtgctgaccgagaagcccctgagcggcaccgacgtgcaggagaagaccttcggcgagagccaggacctgcccctgaagagcgacctgggcaccagagaggacagcagcgtggccagcagcgacagaagcagcgtggagagagaggtggccgagcacctggccaagggcttctggagcgacatctgcagcaccgacaccccctgccagatgcagctgagccccgccgtggccaaggacggcagcgagcagatcagccagaagagaagcgagtgcccctggctgggcatcagaatcagcgagagccccgagcccggccagagaaccttcaccaccctgagcagcgtgaactgccccttcatcagcaccctgagcaccgagggctgcagcagcaacctggagatcggcaacgacgactacgtgagcgagccccagcaggagccctgcccctacgcctgcgtgatcagcctgggcgacgacagcgagaccgacaccgagggcgacagcgagagctgcagcgccagagagcaggagtgcgaggtgaagctgcccttcaacgcccagagaatcatcagcctgagcagaaacgacttccagagcctgctgaagatgcacaagctgacccccgagcagctggactgcatccacgacatcagaagaagaagcaagaacagaatcgccgcccagagatgcagaaagagaaagctggactgcatccagaacctggagagcgagatcgagaagctgcagagcgagaaggagagcctgctgaaggagagagaccacatcctgagcaccctgggcgagaccaagcagaacctgaccggcctgtgccagaaggtgtgcaaggaggccgccctgagccaggagcagatccagatcctggccaagtacagcgccgccgactgccccctgagcttcctgatcagcgagaaggacaagagcacccccgacggcgagctggccctgcccagcatcttcagcctgagcgacagaccccccgccgtgctgcccccctgcgccagaggcaacagcgagcccggctacgccagaggccaggagagccagcagatgagcaccgccaccagcgagcaggccggccccgccgagcagtgcagacagagcggcggcatcagcgacttctgccagcagatgaccgacaagtgcaccaccgacgagtag

SEQ ID NO: 74677 - DNA, 2211 bp, Artificial Sequence; identical to SEQ ID NO: 74676
  Description of Artificial Sequence: Synthetic coding sequence

SEQ ID NO: 74678 - DNA, 513 bp, Artificial Sequence
  Description of Artificial Sequence: Synthetic coding sequence
atgagcctgagcgagaacagcgtgttcgcctacgagagcagcgtgcacagcaccaacgtgctgctgagcctgaacgaccagagaaagaaggacgtgctgtgcgacgtgaccatcttcgtggagggccagagattcagagcccacagaagcgtgctggccgcctgcagcagctacttccacagcagaatcgtgggccaggccgacggcgagctgaacatcaccctgcccgaggaggtgaccgtgaagggcttcgagcccctgatccagttcgcctacaccgccaagctgatcctgagcaaggagaacgtggacgaggtgtgcaagtgcgtggagttcctgagcgtgcacaacatcgaggagagctgcttccagttcctgaagttcaagttcctggacagcaccgccgaccagcaggagtgccccagaaagaagtgcttcagcagccactgccagaagaccgacctgaagctgagcctgctggaccagagagacctggagaccgacgaggtgtag

SEQ ID NO: 74679 - DNA, 663 bp, Artificial Sequence
  Description of Artificial Sequence: Synthetic coding sequence
atgagcctgagcgagaacagcgtgttcgcctacgagagcagcgtgcacagcaccaacgtgctgctgagcctgaacgaccagagaaagaaggacgtgctgtgcgacgtgaccatcttcgtggagggccagagattcagagcccacagaagcgtgctggccgcctgcagcagctacttccacagcagaatcgtgggccaggccgacggcgagctgaacatcaccctgcccgaggaggtgaccgtgaagggcttcgagcccctgatccagttcgcctacaccgccaagctgatcctgagcaaggagaacgtggacgaggtgtgcaagtgcgtggagttcctgagcgtgcacaacatcgaggagagctgcttccagttcctgaagttcaagttcctggacagcaccgccgaccagcaggagtgccccagaaagaagtgcttcagcagccactgccagaagaccgacctgaagctgagcctgctggaccagagagacctggagaccgacgaggtggaggagttcctggagaacaagaacgtgcagaccccccagtgcaagctgagaagataccagggcaacgccaaggccagcccccccctgcaggacagcgccagccagacctacgagagcatgtgcctggagaaggacgccgccctggccctgtag

SEQ ID NO: 74680 - DNA, 678 bp, Artificial Sequence
  Description of Artificial Sequence: Synthetic coding sequence
atgagcctgagcgagaacagcgtgttcgcctacgagagcagcgtgcacagcaccaacgtgctgctgagcctgaacgaccagagaaagaaggacgtgctgtgcgacgtgaccatcttcgtggagggccagagattcagagcccacagaagcgtgctggccgcctgcagcagctacttccacagcagaatcgtgggccaggccgacggcgagctgaacatcaccctgcccgaggaggtgaccgtgaagggcttcgagcccctgatccagttcgcctacaccgccaagctgatcctgagcaaggagaacgtggacgaggtgtgcaagtgcgtggagttcctgagcgtgcacaacatcgaggagagctgcttccagttcctgaagttcaagttcctggacagcaccgccgaccagcaggagtgccccagaaagaagtgcttcagcagccactgccagaagaccgacctgaagctgagcctgctggaccagagagacctggagaccgacgaggtggaggagttcctggagaacaagaacgtgcagaccccccagtgcaagctgagaagataccagggcaacgccaaggccagcccccccctgcaggacagcgccagccagacctacgagagcatgtgcctggagaaggacgccgccctggccctgcccagcctgtgcccctag

SEQ ID NO: 74681 - DNA, 78 bp, Artificial Sequence
  Description of Artificial Sequence: Synthetic coding sequence
atgagcctgagcgagaacagcgtgttcgcctacgagagcagcgtgcacagcaccaacgtgctgctgagcctgaactag

SEQ ID NO: 74682 - DNA, 78 bp, Artificial Sequence; identical to SEQ ID NO: 74681
  Description of Artificial Sequence: Synthetic coding sequence

SEQ ID NO: 74683 - DNA, 78 bp, Artificial Sequence; identical to SEQ ID NO: 74681
  Description of Artificial Sequence: Synthetic coding sequence

SEQ ID NO: 74684 - DNA, 78 bp, Artificial Sequence; identical to SEQ ID NO: 74681
  Description of Artificial Sequence: Synthetic coding sequence

SEQ ID NO: 74685 - DNA, 78 bp, Artificial Sequence; identical to SEQ ID NO: 74681
  Description of Artificial Sequence: Synthetic coding sequence

SEQ ID NO: 74686 - DNA, 2526 bp, Artificial Sequence
  Description of Artificial Sequence: Synthetic coding sequence
atgagcgtggacgagaagcccgacagccccatgtacgtgtacgagagcaccgtgcactgcaccaacatcctgctgggcctgaacgaccagagaaagaaggacatcctgtgcgacgtgaccctgatcgtggagagaaaggagttcagagcccacagagccgtgctggccgcctgcagcgagtacttctggcaggccctggtgggccagaccaagaacgacctggtggtgagcctgcccgaggaggtgaccgccagaggcttcggccccctgctgcagttcgcctacaccgccaagctgctgctgagcagagagaacatcagagaggtgatcagatgcgccgagttcctgagaatgcacaacctggaggacagctgcttcagcttcctgcagacccagctgctgaacagcgaggacggcctgttcgtgtgcagaaaggacgccgcctgccagagaccccacgaggactgcgagaacagcgccggcgaggaggaggacgaggaggaggagaccatggacagcgagaccgccaagatggcctgccccagagaccagatgctgcccgagcccatcagcttcgaggccgccgccatccccgtggccgagaaggaggaggccctgctgcccgagcccgacgtgcccaccgacaccaaggagagcagcgagaaggacgccctgacccagtaccccagatacaagaagtaccagctggcctgcaccaagaacgtgtacaacgccagcagccacagcaccagcggcttcgccagcaccttcagagaggacaacagcagcaacagcctgaagcccggcctggccagaggccagatcaagagcgagccccccagcgaggagaacgaggaggagagcatcaccctgtgcctgagcggcgacgagcccgacgccaaggacagagccggcgacgtggagatggacagaaagcagcccagccccgcccccacccccaccgcccccgccggcgccgcctgcctggagagaagcagaagcgtggccagccccagctgcctgagaagcctgttcagcatcaccaagagcgtggagctgagcggcctgcccagcaccagccagcagcacttcgccagaagccccgcctgccccttcgacaagggcatcacccagggcgacctgaagaccgactacacccccttcaccggcaactacggccagccccacgtgggccagaaggaggtgagcaacttcaccatgggcagccccctgagaggccccggcctggaggccctgtgcaagcaggagggcgagctggacagaagaagcgtgatcttcagcagcagcgcctgcgaccaggtgagcaccagcgtgcacagctacagcggcgtgagcagcctggacaaggacctgagcgagcccgtgcccaagggcctgtgggtgggcgccggccagagcctgcccagcagccaggcctacagccacggcggcctgatggccgaccacctgcccggcagaatgagacccaacaccagctgccccgtgcccatcaaggtgtgccccagaagcccccccctggagaccagaaccagaaccagcagcagctgcagcagctacagctacgccgaggacggcagcggcggcagcccctgcagcctgcccctgtgcgagttcagcagcagcccctgcagccagggcgccagattcctggccaccgagcaccaggagcccggcctgatgggcgacggcatgtacaaccaggtgagaccccagatcaagtgcgagcagagctacggcaccaacagcagcgacgagagcggcagcttcagcgaggccgacagcgagagctgccccgtgcaggacagaggccaggaggtgaagctgcccttccccgtggaccagatcaccgacctgcccagaaacgacttccagatgatgatcaagatgcacaagctgaccagcgagcagctggagttcatccacgacgtgagaagaagaagcaagaacagaatcgccgcccagagatgcagaaagagaaagctggactgcatccagaacctggagtgcgagatcagaaagctggtgtgcgagaaggagaagctgctgagcgagagaaaccagctgaaggcctgcatgggcgagctgctggacaacttcagctgcctgagccaggaggtgtgcagagacatccagagccccgagcagatccaggccctgcacagatactgccccgtgctgagacccatggacctgcccaccgccagcagcatcaaccccgcccccctgggcgccgagcagaacatcgccgccagccagtgcgccgtgggcgagaacgtgccctgctgcctggagcccggcgccgccccccccggccccccctgggcccccagcaacaccagcgagaactgcaccagcggcagaagactggagggcaccgaccccggcaccttcagcgagagaggcccccccctggagcccagaagccagaccgtgaccgtggacttctgccaggagatgaccgacaagtgcaccaccgacgagcagcccagaaaggactacacctag

SEQ ID NO: 74687 - DNA, 2526 bp, Artificial Sequence; identical to SEQ ID NO: 74686
  Description of Artificial Sequence: Synthetic coding sequence

SEQ ID NO: 74688 - DNA, 246 bp, Artificial Sequence
  Description of Artificial Sequence: Synthetic coding sequence
atgagcgtggacgagaagcccgacagccccatgtacgtgtacgagagcaccgtgcactgcaccaacatcctgctgggcctgaacgaccagagaaagaaggacatcctgtgcgacgtgaccctgatcgtggagagaaaggagttcagagcccacagagccgtgctggccgcctgcagcgagtacttctggcaggccctggtgggccagaccaagaacgacctggtggtgagcctgcccgaggagtag

SEQ ID NO: 74689 - DNA, 246 bp, Artificial Sequence; identical to SEQ ID NO: 74688
  Description of Artificial Sequence: Synthetic coding sequence

SEQ ID NO: 74690 - DNA, 2526 bp, Artificial Sequence; identical to SEQ ID NO: 74686
  Description of Artificial Sequence: Synthetic coding sequence

SEQ ID NO: 74691 - DNA, 477 bp, Artificial Sequence
  Description of Artificial Sequence: Synthetic coding sequence
atgagccacggcaagggcaccgacatgctgcccgagatcgccgccgccgtgggcttcctgagcagcctgctgagaaccagaggctgcgtgagcgagcagagactgaaggtgttcagcggcgccctgcaggaggccctgaccgagcactacaagcaccactggttccccgagaagcccagcaagggcagcggctacagatgcatcagaatcaaccacaagatggaccccatcatcagcagagtggccagccagatcggcctgagccagccccagctgcaccagctgctgcccagcgagctgaccctgtgggtggacccctacgaggtgagctacagaatcggcgaggacggcagcatctgcgtgctgtacgaggaggcccccctggccgccagctgcggcctgctgacctgcaagaaccaggtgctgctgggcagaagcagccccagcaagaactacgtgatggccgtgagcagctag

SEQ ID NO: 74692 - DNA, 3258 bp, Artificial Sequence
  Description of Artificial Sequence: Synthetic coding sequence
atggacacccccgagaacgtgctgcagatgctggaggcccacatgcagagctacaagggcaacgaccccctgggcgagtgggagagatacatccagtgggtggaggagaacttccccgagaacaaggagtacctgatcaccctgctggagcacctgatgaaggagttcctggacaagaagaagtaccacaacgaccccagattcatcagctactgcctgaagttcgccgagtacaacagcgacctgcaccagttcttcgagttcctgtacaaccacggcatcggcaccctgagcagccccctgtacatcgcctgggccggccacctggaggcccagggcgagctgcagcacgccagcgccgtgctgcagagaggcatccagaaccaggccgagcccagagagttcctgcagcagcagtacagactgttccagaccagactgaccgagacccacctgcccgcccaggccagaaccagcgagcccctgcacaacgtgcaggtgctgaaccagatgatcaccagcaagagcaaccccggcaacaacatggcctgcatcagcaagaaccagggcagcgagctgagcggcgtgatcagcagcgcctgcgacaaggagagcaacatggagagaagagtgatcaccatcagcaagagcgagtacagcgtgcacagcagcctggccagcaaggtggacgtggagcaggtggtgatgtactgcaaggagaagctgatcagaggcgagagcgagttcagcttcgaggagctgagagcccagaagtacaaccagagaagaaagcacgagcagtgggtgaacgaggacagacactacatgaagagaaaggaggccaacgccttcgaggagcagctgctgaagcagaagatggacgagctgcacaagaagctgcaccaggtggtggagaccagccacgaggacctgcccgccagccaggagagaagcgaggtgaaccccgccagaatgggccccagcgtgggcagccagcaggagctgagagccccctgcctgcccgtgacctaccagcagacccccgtgaacatggagaagaaccccagagaggccccccccgtggtgccccccctggccaacgccatcagcgccgccctggtgagccccgccaccagccagagcatcgccccccccgtgcccctgaaggcccagaccgtgaccgacagcatgttcgccgtggccagcaaggacgccggctgcgtgaacaagagcacccacgagttcaagccccagagcggcgccgagatcaaggagggctgcgagacccacaaggtggccaacaccagcagcttccacaccacccccaacaccagcctgggcatggtgcaggccacccccagcaaggtgcagcccagccccaccgtgcacaccaaggaggccctgggcttcatcatgaacatgttccaggcccccaccctgcccgacatcagcgacgacaaggacgagtggcagagcctggaccagaacgaggacgccttcgaggcccagttccagaagaacgtgagaagcagcggcgcctggggcgtgaacaagatcatcagcagcctgagcagcgccttccacgtgttcgaggacggcaacaaggagaactacggcctgccccagcccaagaacaagcccaccggcgccagaaccttcggcgagagaagcgtgagcagactgcccagcaagcccaaggaggaggtgccccacgccgaggagttcctggacgacagcaccgtgtggggcatcagatgcaacaagaccctggcccccagccccaagagccccggcgacttcaccagcgccgcccagctggccagcacccccttccacaagctgcccgtggagagcgtgcacatcctggaggacaaggagaacgtggtggccaagcagtgcacccaggccaccctggacagctgcgaggagaacatggtggtgcccagcagagacggcaagttcagccccatccaggagaagagccccaagcaggccctgagcagccacatgtacagcgccagcctgctgagactgagccagcccgccgccggcggcgtgctgacctgcgaggccgagctgggcgtggaggcctgcagactgaccgacaccgacgccgccatcgccgaggacccccccgacgccatcgccggcctgcaggccgagtggatgcagatgagcagcctgggcaccgtggacgcccccaacttcatcgtgggcaacccctgggacgacaagctgatcttcaagctgctgagcggcctgagcaagcccgtgagcagctaccccaacaccttcgagtggcagtgcaagctgcccgccatcaagcccaagaccgagttccagctgggcagcaagctggtgtacgtgcaccacctgctgggcgagggcgccttcgcccaggtgtacgaggccacccagggcgacctgaacgacgccaagaacaagcagaagttcgtgctgaaggtgcagaagcccgccaacccctgggagttctacatcggcacccagctgatggagagactgaagcccagcatgcagcacatgttcatgaagttctacagcgcccacctgttccagaacggcagcgtgctggtgggcgagctgtacagctacggcaccctgctgaacgccatcaacctgtacaagaacacccccgagaaggtgatgccccagggcctggtgatcagcttcgccatgagaatgctgtacatgatcgagcaggtgcacgactgcgagatcatccacggcgacatcaagcccgacaacttcatcctgggcaacggcttcctggagcaggacgacgaggacgacctgagcgccggcctggccctgatcgacctgggccagagcatcgacatgaagctgttccccaagggcaccatcttcaccgccaagtgcgagaccagcggcttccagtgcgtggagatgctgagcaacaagccctggaactaccagatcgactacttcggcgtggccgccaccgtgtactgcatgctgttcggcacctacatgaaggtgaagaacgagggcggcgagtgcaagcccgagggcctgttcagaagactgccccacctggacatgtggaacgagttcttccacgtgatgctgaacatccccgactgccaccacctgcccagcctggacctgctgagacagaagctgaagaaggtgttccagcagcactacaccaacaagatcagagccctgagaaacagactgatcgtgctgctgctggagtgcaagagaagcagaaagtag

SEQ ID NO: 74693 - DNA, 3087 bp, Artificial Sequence
  Description of Artificial Sequence: Synthetic coding sequence
atggacacccccgagaacgtgctgcagatgctggaggcccacatgcagagctacaagggcaacgaccccctgggcgagtgggagagatacatccagtgggtggaggagaacttccccgagaacaaggagtacctgatcaccctgctggagcacctgatgaaggagttcctggacaagaagaagtaccacaacgaccccagattcatcagctactgcctgaagttcgccgagtacaacagcgacctgcaccagttcttcgagttcctgtacaaccacggcatcggcaccctgagcagccccctgtacatcgcctgggccggccacctggaggcccagggcgagctgcagcacgccagcgccgtgctgcagagaggcatccagaaccaggccgagcccagagagttcctgcagcagcagtacagactgttccagaccagactgaccgagacccacctgcccgcccaggccagaaccagcgagcccctgcacaacgtgcaggtgctgaaccagatgatcaccagcaagagcaaccccggcaacaacatggcctgcatcagcaagaaccagggcagcgagctgagcggcgtgatcagcagcgcctgcgacaaggagagcaacatggagagaagagtgatcaccatcagcaagagcgagtacagcgtgcacagcagcctggccagcaaggtggacgtggagcaggtggtgatgtactgcaaggagaagctgatcagaggcgagagcgagttcagcttcgaggagctgagagcccagaagtacaaccagagaagaaagcacgagcagtgggtgaacgaggacagacactacatgaagagaaaggaggccaacgccttcgaggagcagctgctgaagcagaagatggacgagctgcacaagaagctgcaccaggtggtggagaccagccacgaggacctgcccgccagccaggagagaagcgaggtgaaccccgccagaatgggccccagcgtgggcagccagcaggagctgagagccccctgcctgcccgtgacctaccagcagacccccgtgaacatggagaagaaccccagagaggccccccccgtggtgccccccctggccaacgccatcagcgccgccctggtgagccccgccaccagccagagcatcgccccccccgtgcccctgaaggcccagaccgtgaccgacagcatgttcgccgtggccagcaaggacgccggctgcgtgaacaagagcacccacgagttcaagccccagagcggcgccgagatcaaggagggctgcgagacccacaaggtggccaacaccagcagcttccacaccacccccaacaccagcctgggcatggtgcaggccacccccagcaaggtgcagcccagccccaccgtgcacaccaaggaggccctgggcttcatcatgaacatgttccaggcccccaccctgcccgacatcagcgacgacaaggacgagtggcagagcctggaccagaacgaggacgccttcgaggcccagttccagaagaacgtgagaagcagcggcgcctggggcgtgaacaagatcatcagcagcctgagcagcgccttccacgtgttcgaggacggcaacaaggagaactacggcctgccccagcccaagaacaagcccaccggcgccagaaccttcggcgagagaagcgtgagcagactgcccagcaagcccaaggaggaggtgccccacgccgaggagttcctggacgacagcaccgtgtggggcatcagatgcaacaagaccctggcccccagccccaagagccccggcgacttcaccagcgccgcccagctggccagcacccccttccacaagctgcccgtggagagcgtgcacatcctggaggacaaggagaacgtggtggccaagcagtgcacccaggccaccctggacagctgcgaggagaacatggtggtgcccagcagagacggcaagttcagccccatccaggagaagagccccaagcaggccctgagcagccacatgtacagcgccagcctgctgagactgagccagcccgccgccggcggcgtgctgacctgcgaggccgagctgggcgtggaggcctgcagactgaccgacaccgacgccgccatcgccgaggacccccccgacgccatcgccggcctgcaggccgagtggatgcagatgagcagcctgggcaccgtggacgcccccaacttcatcgtgggcaacccctgggacgacaagctgatcttcaagctgctgagcggcctgagcaagcccgtgagcagctaccccaacaccttcgagtggcagtgcaagctgcccgccatcaagcccaagaccgagttccagctgggcagcaagctggtgtacgtgcaccacctgctgggcgagggcgccttcgcccaggtgtacgaggccacccagggcgacctgaacgacgccaagaacaagcagaagttcgtgctgaaggtgcagaagcccgccaacccctgggagttctacatcggcacccagctgatggagagactgaagcccagcatgcagcacatgttcatgaagttctacagcgcccacctgttccagaacggcagcgtgctggtgggcgagctgtacagctacggcaccctgctggacgacgaggacgacctgagcgccggcctggccctgatcgacctgggccagagcatcgacatgaagctgttccccaagggcaccatcttcaccgccaagtgcgagaccagcggcttccagtgcgtggagatgctgagcaacaagccctggaactaccagatcgactacttcggcgtggccgccaccgtgtactgcatgctgttcggcacctacatgaaggtgaagaacgagggcggcgagtgcaagcccgagggcctgttcagaagactgccccacctggacatgtggaacgagttcttccacgtgatgctgaacatccccgactgccaccacctgcccagcctggacctgctgagacagaagctgaagaaggtgttccagcagcactacaccaacaagatcagagccctgagaaacagactgatcgtgctgctgctggagtgcaagagaagcagaaagtag

SEQ ID NO: 74694 - DNA, 3198 bp, Artificial Sequence
  Description of Artificial Sequence: Synthetic coding sequence
atggacacccccgagaacgtgctgcagtacatccagtgggtggaggagaacttccccgagaacaaggagtacctgatcaccctgctggagcacctgatgaaggagttcctggacaagaagaagtaccacaacgaccccagattcatcagctactgcctgaagttcgccgagtacaacagcgacctgcaccagttcttcgagttcctgtacaaccacggcatcggcaccctgagcagccccctgtacatcgcctgggccggccacctggaggcccagggcgagctgcagcacgccagcgccgtgctgcagagaggcatccagaaccaggccgagcccagagagttcctgcagcagcagtacagactgttccagaccagactgaccgagacccacctgcccgcccaggccagaaccagcgagcccctgcacaacgtgcaggtgctgaaccagatgatcaccagcaagagcaaccccggcaacaacatggcctgcatcagcaagaaccagggcagcgagctgagcggcgtgatcagcagcgcctgcgacaaggagagcaacatggagagaagagtgatcaccatcagcaagagcgagtacagcgtgcacagcagcctggccagcaaggtggacgtggagcaggtggtgatgtactgcaaggagaagctgatcagaggcgagagcgagttcagcttcgaggagctgagagcccagaagtacaaccagagaagaaagcacgagcagtgggtgaacgaggacagacactacatgaagagaaaggaggccaacgccttcgaggagcagctgctgaagcagaagatggacgagctgcacaagaagctgcaccaggtggtggagaccagccacgaggacctgcccgccagccaggagagaagcgaggtgaaccccgccagaatgggccccagcgtgggcagccagcaggagctgagagccccctgcctgcccgtgacctaccagcagacccccgtgaacatggagaagaaccccagagaggccccccccgtggtgccccccctggccaacgccatcagcgccgccctggtgagccccgccaccagccagagcatcgccccccccgtgcccctgaaggcccagaccgtgaccgacagcatgttcgccgtggccagcaaggacgccggctgcgtgaacaagagcacccacgagttcaagccccagagcggcgccgagatcaaggagggctgcgagacccacaaggtggccaacaccagcagcttccacaccacccccaacaccagcctgggcatggtgcaggccacccccagcaaggtgcagcccagccccaccgtgcacaccaaggaggccctgggcttcatcatgaacatgttccaggcccccaccctgcccgacatcagcgacgacaaggacgagtggcagagcctggaccagaacgaggacgccttcgaggcccagttccagaagaacgtgagaagcagcggcgcctggggcgtgaacaagatcatcagcagcctgagcagcgccttccacgtgttcgaggacggcaacaaggagaactacggcctgccccagcccaagaacaagcccaccggcgccagaaccttcggcgagagaagcgtgagcagactgcccagcaagcccaaggaggaggtgccccacgccgaggagttcctggacgacagcaccgtgtggggcatcagatgcaacaagaccctggcccccagccccaagagccccggcgacttcaccagcgccgcccagctggccagcacccccttccacaagctgcccgtggagagcgtgcacatcctggaggacaaggagaacgtggtggccaagcagtgcacccaggccaccctggacagctgcgaggagaacatggtggtgcccagcagagacggcaagttcagccccatccaggagaagagccccaagcaggccctgagcagccacatgtacagcgccagcctgctgagactgagccagcccgccgccggcggcgtgctgacctgcgaggccgagctgggcgtggaggcctgcagactgaccgacaccgacgccgccatcgccgaggacccccccgacgccatcgccggcctgcaggccgagtggatgcagatgagcagcctgggcaccgtggacgcccccaacttcatcgtgggcaacccctgggacgacaagctgatcttcaagctgctgagcggcctgagcaagcccgtgagcagctaccccaacaccttcgagtggcagtgcaagctgcccgccatcaagcccaagaccgagttccagctgggcagcaagctggtgtacgtgcaccacctgctgggcgagggcgccttcgcccaggtgtacgaggccacccagggcgacctgaacgacgccaagaacaagcagaagttcgtgctgaaggtgcagaagcccgccaacccctgggagttctacatcggcacccagctgatggagagactgaagcccagcatgcagcacatgttcatgaagttctacagcgcccacctgttccagaacggcagcgtgctggtgggcgagctgtacagctacggcaccctgctgaacgccatcaacctgtacaagaacacccccgagaaggtgatgccccagggcctggtgatcagcttcgccatgagaatgctgtacatgatcgagcaggtgcacgactgcgagatcatccacggcgacatcaagcccgacaacttcatcctgggcaacggcttcctggagcaggacgacgaggacgacctgagcgccggcctggccctgatcgacctgggccagagcatcgacatgaagctgttccccaagggcaccatcttcaccgccaagtgcgagaccagcggcttccagtgcgtggagatgctgagcaacaagccctggaactaccagatcgactacttcggcgtggccgccaccgtgtactgcatgctgttcggcacctacatgaaggtgaagaacgagggcggcgagtgcaagcccgagggcctgttcagaagactgccccacctggacatgtggaacgagttcttccacgtgatgctgaacatccccgactgccaccacctgcccagcctggacctgctgagacagaagctgaagaaggtgttccagcagcactacaccaacaagatcagagccctgagaaacagactgatcgtgctgctgctggagtgcaagagaagcagaaagtag

SEQ ID NO: 74695 - DNA, 2475 bp, Artificial Sequence
  Description of Artificial Sequence: Synthetic coding sequence
atggacacccccgagaacgtgctgcagatgctggaggcccacatgcagagctacaagggcaacgaccccctgggcgagtgggagagatacatccagtgggtggaggagaacttccccgagaacaaggagtacctgatcaccctgctggagcacctgatgaaggagttcctggacaagaagaagtaccacaacgaccccagattcatcagctactgcctgaagttcgccgagtacaacagcgacctgcaccagttcttcgagttcctgtacaaccacggcatcggcaccctgagcagccccctgtacatcgcctgggccggccacctggaggcccagggcgagctgcagcacgccagcgccgtgctgcagagaggcatccagaaccaggccgagcccagagagttcctgcagcagcagtacagactgttccagaccagactgaccgagacccacctgcccgcccaggccagaaccagcgagcccctgcacaacgtgcaggtgctgaaccagatgatcaccagcaagagcaaccccggcaacaacatggcctgcatcagcaagaaccagggcagcgagctgagcggcgtgatcagcagcgcctgcgacaaggagagcaacatggagagaagagtgatcaccatcagcaagagcgagtacagcgtgcacagcagcctggccagcaaggtggacgtggagcaggtggtgatgtactgcaaggagaagctgatcagaggcgagagcgagttcagcttcgaggagctgagagcccagaagtacaaccagagaagaaagcacgagcagtgggtgaacgaggacagacactacatgaagagaaaggaggccaacgccttcgaggagcagctgctgaagcagaagatggacgagctgcacaagaagctgcaccaggtggtggagaccagccacgaggacctgcccgccagccaggagagaagcgaggtgaaccccgccagaatgggccccagcgtgggcagccagcaggagctgagagccccctgcctgcccgtgacctaccagcagacccccgtgaacatggagaagaaccccagagaggccccccccgtggtgccccccctggccaacgccatcagcgccgccctggtgagccccgccaccagccagagcatcgccccccccgtgcccctgaaggcccagaccgtgaccgacagcatgttcgccgtggccagcaaggacgccggctgcgtgaacaagagcacccacgagttcaagccccagagcggcgccgagatcaaggagggctgcgagacccacaaggtggccaacaccagcagcttccacaccacccccaacaccagcctgggcatggtgcaggccacccccagcaaggtgcagcccagccccaccgtgcacaccaaggaggccctgggcttcatcatgaacatgttccaggcccccaccctgcccgacatcagcgacgacaaggacgagtggcagagcctggaccagaacgaggacgccttcgaggcccagttccagaagaacgtgagaagcagcggcgcctggggcgtgaacaagatcatcagcagcctgagcagcgccttccacgtgttcgaggacggcaacaaggagaactacggcctgccccagcccaagaacaagcccaccggcgccagaaccttcggcgagagaagcgtgagcagactgcccagcaagcccaaggaggaggtgccccacgccgaggagttcctggacgacagcaccgtgtggggcatcagatgcaacaagaccctggcccccagccccaagagccccggcgacttcaccagcgccgcccagctggccagcacccccttccacaagctgcccgtggagagcgtgcacatcctggaggacaaggagaacgtggtggccaagcagtgcacccaggccaccctggacagctgcgaggagaacatggtggtgcccagcagagacggcaagttcagccccatccaggagaagagccccaagcaggccctgagcagccacatgtacagcgccagcctgctgagactgagccagcccgccgccggcggcgtgctgacctgcgaggccgagctgggcgtggaggcctgcagactgaccgacaccgacgccgccatcgccgaggacccccccgacgccatcgccggcctgcaggccgagtggatgcagatgagcagcctgggcaccgtggacgcccccaacttcatcgtgggcaacccctgggacgacaagctgatcttcaagctgctgagcggcctgagcaagcccgtgagcagctaccccaacaccttcgagtggcagtgcaagctgcccgccatcaagcccaagaccgagttccagctgggcagcaagctggtgtacgtgcaccacctgctgggcgagggcgccttcgcccaggtgtacgaggccacccagggcgacctgaacgacgccaagaacaagcagaagttcgtgctgaaggtgaagagctag

SEQ ID NO: 74696 - DNA, 981 bp, Artificial Sequence
  Description of Artificial Sequence: Synthetic coding sequence
atgaccggcagcaacgagttcaagctgaaccagccccccgaggacggcatcagcagcgtgaagttcagccccaacaccagccagttcctgctggtgagcagctgggacaccagcgtgagactgtacgacgtgcccgccaacagcatgagactgaagtaccagcacaccggcgccgtgctggactgcgccttctacgaccccacccacgcctggagcggcggcctggaccaccagctgaagatgcacgacctgaacaccgaccaggagaacctggtgggcacccacgacgcccccatcagatgcgtggagtactgccccgaggtgaacgtgatggtgaccggcagctgggaccagaccgtgaagctgtgggaccccagaaccccctgcaacgccggcaccttcagccagcccgagaaggtgtacaccctgagcgtgagcggcgacagactgatcgtgggcaccgccggcagaagagtgctggtgtgggacctgagaaacatgggctacgtgcagcagagaagagagagcagcctgaagtaccagaccagatgcatcagagccttccccaacaagcagggctacgtgctgagcagcatcgagggcagagtggccgtggagtacctggaccccagccccgaggtgcagaagaagaagtacgccttcaagtgccacagactgaaggagaacaacatcgagcagatctaccccgtgaacgccatcagcttccacaacatccacaacaccttcgccaccggcggcagcgacggcttcgtgaacatctgggaccccttcaacaagaagagactgtgccagttccacagataccccaccagcatcgccagcctggccttcagcaacgacggcaccaccctggccatcgccagcagctacatgtacgagatggacgacaccgagcaccccgaggacggcatcttcatcagacaggtgaccgacgccgagaccaagcccaagagcacctag

SEQ ID NO: 74697 - DNA, 987 bp, Artificial Sequence
  Description of Artificial Sequence: Synthetic coding sequence
atgaccggcagcaacgagttcaagctgaaccagccccccgaggacggcatcagcagcgtgaagttcagccccaacaccagccagttcctgctggtgagcagctgggacaccagcgtgagactgtacgacgtgcccgccaacagcatgagactgaagtaccagcacaccggcgccgtgctggactgcgccttctacgaccccacccacgcctggagcggcggcctggaccaccagctgaagatgcacgacctgaacaccgaccaggagaacctggtgggcacccacgacgcccccatcagatgcgtggagtactgccccgaggtgaacgtgatggtgaccggcagctgggaccagaccgtgaagctgtgggaccccagaaccccctgcaacgccggcaccttcagccagcccgagaaggtgtacaccctgagcgtgagcggcgacagactgatcgtgggcaccgccggcagaagagtgctggtgtgggacctgagaaacatgggctacgtgcagcagagaagagagagcagcctgaagtaccagaccagatgcatcagagccttccccaacaagcagggctacgtgctgagcagcatcgagggcagagtggccgtggagtacctggaccccagccccgaggtgcagaagaagaagtacgccttcaagtgccacagactgaaggagaacaacatcgagcagatctaccccgtgaacgccatcagcttccacaacatccacaacaccttcgccaccggcggcagcgacggcttcgtgaacatctgggaccccttcaacaagaagagactgtgccagttccacagataccccaccagcatcgccagcctggccttcagcaacgacggcaccaccctggccatcgccagcagctacatgtacgagatggacgacaccgagcaccccgaggacggcatcttcatcagacaggtgaccgacgccgagaccaagcccaagagcccctgcacctag

SEQ ID NO: 74698 - DNA, 747 bp, Artificial Sequence
  Description of Artificial Sequence: Synthetic coding sequence
atgcacgacctgaacaccgaccaggagaacctggtgggcacccacgacgcccccatcagatgcgtggagtactgccccgaggtgaacgtgatggtgaccggcagctgggaccagaccgtgaagctgtgggaccccagaaccccctgcaacgccggcaccttcagccagcccgagaaggtgtacaccctgagcgtgagcggcgacagactgatcgtgggcaccgccggcagaagagtgctggtgtgggacctgagaaacatgggctacgtgcagcagagaagagagagcagcctgaagtaccagaccagatgcatcagagccttccccaacaagcagggctacgtgctgagcagcatcgagggcagagtggccgtggagtacctggaccccagccccgaggtgcagaagaagaagtacgccttcaagtgccacagactgaaggagaacaacatcgagcagatctaccccgtgaacgccatcagcttccacaacatccacaacaccttcgccaccggcggcagcgacggcttcgtgaacatctgggaccccttcaacaagaagagactgtgccagttccacagataccccaccagcatcgccagcctggccttcagcaacgacggcaccaccctggccatcgccagcagctacatgtacgagatggacgacaccgagcaccccgaggacggcatcttcatcagacaggtgaccgacgccgagaccaagcccaagagcccctgcacctag

SEQ ID NO: 74699 - DNA, 1164 bp, Artificial Sequence
  Description of Artificial Sequence: Synthetic coding sequence
atggcctgcaccatccagaaggccgaggccctggacggcgcccacctgatgcagatcctgtggtacgacgaggaggagagcctgtaccccgccgtgtggctgagagacaactgcccctgcagcgactgctacctggacagcgccaaggccagaaagctgctggtggaggccctggacgtgaacatcggcatcaagggcctgatcttcgacagaaagaaggtgtacatcacctggcccgacgagcactacagcgagttccaggccgactggctgaagaagagatgcttcagcaagcaggccagagccaagctgcagagagagctgttcttccccgagtgccagtactggggcagcgagctgcagctgcccaccctggacttcgaggacgtgctgagatacgacgagcacgcctacaagtggctgagcaccctgaagaaggtgggcatcgtgagactgaccggcgccagcgacaagcccggcgaggtgagcaagctgggcaagagaatgggcttcctgtacctgaccttctacggccacacctggcaggtgcaggacaagatcgacgccaacaacgtggcctacaccaccggcaagctgagcttccacaccgactaccccgccctgcaccacccccccggcgtgcagctgctgcactgcatcaagcagaccgtgaccggcggcgacagcgagatcgtggacggcttcaacgtgtgccagaagctgaagaagaacaacccccaggccttccagatcctgagcagcaccttcgtggacttcaccgacatcggcgtggactactgcgacttcagcgtgcagagcaagcacaagatcatcgagctggacgacaagggccaggtggtgagaatcaacttcaacaacgccaccagagacaccatcttcgacgtgcccgtggagagagtgcagcccttctacgccgccctgaaggagttcgtggacctgatgaacagcaaggagagcaagttcaccttcaagatgaaccccggcgacgtgatcaccttcgacaactggagactgctgcacggcagaagaagctacgaggccggcaccgagatcagcagacacctggagggcgcctacgccgactgggacgtggtgatgagcagactgagaatcctgagacagagagtggagaacggcaactag

SEQ ID NO: 74700 - DNA, 1164 bp, Artificial Sequence; identical to SEQ ID NO: 74699
  Description of Artificial Sequence: Synthetic coding sequence

SEQ ID NO: 74701 - DNA, 1164 bp, Artificial Sequence; identical to SEQ ID NO: 74699
  Description of Artificial Sequence: Synthetic coding sequence

SEQ ID NO: 74702 - DNA, 1164 bp, Artificial Sequence; identical to SEQ ID NO: 74699
  Description of Artificial Sequence: Synthetic coding sequence

SEQ ID NO: 74703 - DNA, 207 bp, Artificial Sequence
  Description of Artificial Sequence: Synthetic coding sequence
atggcctgcaccatccagaaggccgaggccctggacggcgcccacctgatgcagatcctgtggtacgacgaggaggagagcctgtaccccgccgtgtggctgagagacaactgcccctgcagcgactgctacctggacagcgccaaggccagaaagctgctggtggaggccctggacgtgaacatcggcatcaagggcctgatctag

SEQ ID NO: 74704 - DNA, 771 bp, Artificial Sequence
  Description of Artificial Sequence: Synthetic coding sequence
atggagcccgccgccgccctgcacttcagcctgcccgccagcctgctgctgctgctgctgctgctgctgctgagcctgtgcgccctggtgagcgcccagttcaccgtggtgggccccgccaaccccatcctggccatggtgggcgagaacaccaccctgagatgccacctgagccccgagaagaacgccgaggacatggaggtgagatggttcagaagccagttcagccccgccgtgttcgtgtacaagggcggcagagagagaaccgaggagcagatggaggagtacagaggcagaatcaccttcgtgagcaaggacatcaacagaggcagcgtggccctggtgatccacaacgtgaccgcccaggagaacggcatctacagatgctacttccaggagggcagaagctacgacgaggccatcctgagactggtggtggccgagagcttcatgcccagcgccagcccctggatggtggccctggccgtgatcctgaccgccagcccctggatggtgagcatgaccgtgatcctggccgtgttcatcatcttcatggccgtgagcatctgctgcatcaagaagctgcagagagagaagaagatcctgagcggcgagaagaaggtggagcaggaggagaaggagatcgcccagcagctgcaggaggagctgagatggagaagaaccttcctgcacgccggctacgagctgcccggcatcagaggccccagctggaagagacccctgcacggcgagccccccagcgccttctag

SEQ ID NO: 74705 - DNA, 942 bp, Artificial Sequence
  Description of Artificial Sequence: Synthetic coding sequence
atggagcccgccgccgccctgcacttcagcctgcccgccagcctgctgctgctgctgctgctgctgctgctgagcctgtgcgccctggtgagcgagagcttcatgcccagcgccagcccctggatggtggccctggccgtgatcctgaccgccagcccctggatggtgagcatgaccgtgatcctggccgtgttcatcatcttcatggccgtgagcatctgctgcatcaagaagctgcagagagagaagaagatcctgagcggcgagaagaaggtggagcaggaggagaaggagatcgcccagcagctgcaggaggagctgagatggagaagaaccttcctgcacgccgccgacgtggtgctggaccccgacaccgcccaccccgagctgttcctgagcgaggacagaagaagcgtgagaagaggcccctacagacagagagtgcccgacaaccccgagagattcgacagccagccctgcgtgctgggctgggagagcttcgccagcggcaagcactactgggaggtggaggtggagaacgtgatggtgtggaccgtgggcgtgtgcagacacagcgtggagagaaagggcgaggtgctgctgatcccccagaacggcttctggaccctggagatgttcggcaaccagtacagagccctgagcagccccgagagaatcctgcccctgaaggagagcctgtgcagagtgggcgtgttcctggactacgaggccggcgacgtgagcttctacaacatgagagacagaagccacatctacacctgccccagaagcgccttcaccgtgcccgtgagacccttcttcagactgggcagcgacgacagccccatcttcatctgccccgccctgaccggcgccagcggcgtgatggtgcccgaggagggcctgaagctgcacagagtgggcacccaccagagcctgtag

SEQ ID NO: 74706 - DNA, 1608 bp, Artificial Sequence
  Description of Artificial Sequence: Synthetic coding sequence
atggtgggcgaggacgccgacctgccctgccacctgttccccaccatgagcgccgagaccatggagctgagatgggtgagcagcagcctgagacaggtggtgaacgtgtacgccgacggcaaggaggtggaggacagacagagcgccccctacagaggcagaaccagcatcctgagagacggcatcaccgccggcaaggccgccctgagaatccacaacgtgaccgccagcgacagcggcaagtacctgtgctacttccaggacggcgacttctacgagaaggccctggtggagctgaaggtggccgccctgggcagcgacctgcacatcgaggtgaagggctacgaggacggcggcatccacctggagtgcagaagcaccggctggtacccccagccccagatcaagtggagcgacaccaagggcgagaacatccccgccgtggaggcccccgtggtggccgacggcgtgggcctgtacgccgtggccgccagcgtgatcatgagaggcagcagcggcggcggcgtgagctgcatcatcagaaacagcctgctgggcctggagaagaccgccagcatcagcatcgccgaccccttcttcagaagcgcccagccctggatcgccgccctggccggcaccctgcccatcagcctgctgctgctggccggcgccagctacttcctgtggagacagcagaaggagaagatcgccctgagcagagagaccgagagagagagagagatgaaggagatgggctacgccgccaccgagcaggagatcagcctgagagagtggagaaagatccagtacatggccagaggcgagaagagcctggcctaccacgagtggaagatggccctgttcaagcccgccgacgtgatcctggaccccgacaccgccaacgccatcctgctggtgagcgaggaccagagaagcgtgcagagagccgaggagcccagagacctgcccgacaaccccgagagattcgagtggagatactgcgtgctgggctgcgagaacttcaccagcggcagacactactgggaggtggaggtgggcgacagaaaggagtggcacatcggcgtgtgcagcaagaacgtggagagaaagaagggctgggtgaagatgacccccgagaacggctactggaccatgggcctgaccgacggcaacaagtacagagccctgaccgagcccagaaccaacctgaagctgcccgagccccccagaaaggtgggcatcttcctggactacgagaccggcgagatcagcttctacaacgccaccgacggcagccacatctacaccttcccccacgccagcttcagcgagcccctgtaccccgtgttcagaatcctgaccctggagcccaccgccctgaccatctgccccatccccaaggaggtggagagcagccccgaccccgacctggtgcccgaccacagcctggagacccccctgacccccggcctggccaacgagagcggcgagccccaggccgaggtgaccagcctgctgctgcccgcccaccccggcgccgaggtgagccccagcgccaccaccaaccagaaccacaagctgcaggccagaaccgaggccctgtactag

SEQ ID NO: 74707 - DNA, 1581 bp, Artificial Sequence
  Description of Artificial Sequence: Synthetic coding sequence
atggccgtgttccccagcagcggcctgcccagatgcctgctgaccctgatcctgctgcagctgcccaagctggacagcgcccccttcgacgtgatcggcccccccgagcccatcctggccgtggtgggcgaggacgccgagctgccctgcagactgagccccaacgccagcgccgagcacctggagctgagatggttcagaaagaaggtgagccccgccgtgctggtgcacagagacggcagagagcaggaggccgagcagatgcccgagtacagaggcagagccaccctggtgcaggacggcatcgccaagggcagagtggccctgagaatcagaggcgtgagagtgagcgacgacggcgagtacacctgcttcttcagagaggacggcagctacgaggaggccctggtgcacctgaaggtggccgccctgggcagcgacccccacatcagcatgcaggtgcaggagaacggcgagatctgcctggagtgcaccagcgtgggctggtaccccgagccccaggtgcagtggagaaccagcaagggcgagaagttccccagcaccagcgagagcagaaaccccgacgaggagggcctgttcaccgtggccgccagcgtgatcatcagagacaccagcgccaagaacgtgagctgctacatccagaacctgctgctgggccaggagaagaaggtggagatcagcatccccgccagcagcctgcccagactgaccccctggatcgtggccgtggccgtgatcctgatggtgctgggcctgctgaccatcggcagcatcttcttcacctggagactgtacaacgagagacccagagagagaagaaacgagttcagcagcaaggagagactgctggaggagctgaagtggaagaaggccaccctgcacgccgtggacgtgaccctggaccccgacaccgcccacccccacctgttcctgtacgaggacagcaagagcgtgagactggaggacagcagacagaagctgcccgagaagaccgagagattcgacagctggccctgcgtgctgggcagagagaccttcaccagcggcagacactactgggaggtggaggtgggcgacagaaccgactgggccatcggcgtgtgcagagagaacgtgatgaagaagggcttcgaccccatgacccccgagaacggcttctgggccgtggagctgtacggcaacggctactgggccctgacccccctgagaacccccctgcccctggccggcccccccagaagagtgggcatcttcctggactacgagagcggcgacatcagcttctacaacatgaacgacggcagcgacatctacaccttcagcaacgtgaccttcagcggccccctgagacccttcttctgcctgtggagcagcggcaagaagcccctgaccatctgccccatcgccgacggccccgagagagtgaccgtgatcgccaacgcccaggacctgagcaaggagatccccctgagccccatgggcgaggacagcgcccccagagacgccgacaccctgcacagcaagctgatccccacccagcccagccagggcgccccctag

SEQ ID NO: 74708 - DNA, 1485 bp, Artificial Sequence
  Description of Artificial Sequence: Synthetic coding sequence
atggccgtgttccccagcagcggcctgcccagatgcctgctgaccctgatcctgctgcagctgcccaagctggacagcgcccccttcgacgtgatcggcccccccgagcccatcctggccgtggtgggcgaggacgccgagctgccctgcagactgagccccaacgccagcgccgagcacctggagctgagatggttcagaaagaaggtgagccccgccgtgctggtgcacagagacggcagagagcaggaggccgagcagatgcccgagtacagaggcagagccaccctggtgcaggacggcatcgccaagggcagagtggccctgagaatcagaggcgtgagagtgagcgacgacggcgagtacacctgcttcttcagagaggacggcagctacgaggaggccctggtgcacctgaaggtggccgccctgggcagcgacccccacatcagcatgcaggtgcaggagaacggcgagatctgcctggagtgcaccagcgtgggctggtaccccgagccccaggtgcagtggagaaccagcaagggcgagaagttccccagcaccagcgagagcagaaaccccgacgaggagggcctgttcaccgtggccgccagcgtgatcatcagagacaccagcgccaagaacgtgagctgctacatccagaacctgctgctgggccaggagaagaaggtggagatcagcatccccgccagcagcctgcccagactgaccccctggatcgtggccgtggccgtgatcctgatggtgctgggcctgctgaccatcggcagcatcttcttcacctggagactgtacaacgagagacccagagagagaagaaacgagttcagcagcaaggagagactgctggaggagctgaagtggaagaaggccaccctgcacgccgtggacgtgaccctggaccccgacaccgcccacccccacctgttcctgtacgaggacagcaagagcgtgagactggaggacagcagacagaagctgcccgagaagaccgagagattcgacagctggccctgcgtgctgggcagagagaccttcaccagcggcagacactactgggaggtggaggtgggcgacagaaccgactgggccatcggcgtgtgcagagagaacgtgatgaagaagggcttcgaccccatgacccccgagaacggcttctgggccgtggagctgtacggcaacggctactgggccctgacccccctgagaacccccctgcccctggccggcccccccagaagagtgggcatcttcctggactacgagagcggcgacatcagcttctacaacatgaacgacggcagcgacatctacaccttcagcaacgtgaccgtgatcgccaacgcccaggacctgagcaaggagatccccctgagccccatgggcgaggacagcgcccccagagacgccgacaccctgcacagcaagctgatccccacccagcccagccagggcgccccctag

SEQ ID NO: 74709 - DNA, 1590 bp, Artificial Sequence
  Description of Artificial Sequence: Synthetic coding sequence
atggagagcgccgccgccctgcacttcagcagacccgccagcctgctgctgctgctgctgagcctgtgcgccctggtgagcgcccagttcatcgtggtgggccccaccgaccccatcctggccaccgtgggcgagaacaccaccctgagatgccacctgagccccgagaagaacgccgaggacatggaggtgagatggttcagaagccagttcagccccgccgtgttcgtgtacaagggcggcagagagagaaccgaggagcagatggaggagtacagaggcagaaccaccttcgtgagcaaggacatcagcagaggcagcgtggccctggtgatccacaacatcaccgcccaggagaacggcacctacagatgctacttccaggagggcagaagctacgacgaggccatcctgcacctggtggtggccggcctgggcagcaagcccctgatcagcatgagaggccacgaggacggcggcatcagactggagtgcatcagcagaggctggtaccccaagcccctgaccgtgtggagagacccctacggcggcgtggcccccgccctgaaggaggtgagcatgcccgacgccgacggcctgttcatggtgaccaccgccgtgatcatcagagacaagagcgtgagaaacatgagctgcagcatcaacaacaccctgctgggccagaagaaggagagcgtgatcttcatccccgagagcttcatgcccagcgtgagcccccccatcgccgtgtgcatctactggatcaacaagctgcagaaggagaagaagatcctgagcggcgagaaggagttcgagagagagaccagagagatcgccctgaaggagctggagaaggagagagtgcagaaggaggaggagctgcaggtgaaggagaagctgcaggaggagctgagatggagaagaaccttcctgcacgccgtggacgtggtgctggaccccgacaccgcccaccccgacctgttcctgagcgaggacagaagaagcgtgagaagatgccccttcagacacctgggcgagagcgtgcccgacaaccccgagagattcgacagccagccctgcgtgctgggcagagagagcttcgccagcggcaagcactactgggaggtggaggtggagaacgtgatcgagtggaccgtgggcgtgtgcagagacagcgtggagagaaagggcgaggtgctgctgatcccccagaacggcttctggaccctggagatgcacaagggccagtacagagccgtgagcagccccgacagaatcctgcccctgaaggagagcctgtgcagagtgggcgtgttcctggactacgaggccggcgacgtgagcttctacaacatgagagacagaagccacatctacacctgccccagaagcgccttcagcggccccgacaccagccagagcggcgacccccccgagcccatcgagagcatcccctggagccacagccacgtggacaagccctggagcagccagcagcccccccacaacacccacctgcccgccgccagcttcacccccaccaccgacctgagccccagcttcctgctgctgaccagactgtgcttctag

SEQ ID NO: 74710 - DNA, 1584 bp, Artificial Sequence
  Description of Artificial Sequence: Synthetic coding sequence
atggagagcgccgccgccctgcacttcagcagacccgccagcctgctgctgctgctgctgagcctgtgcgccctggtgagcgcccagttcatcgtggtgggccccaccgaccccatcctggccaccgtgggcgagaacaccaccctgagatgccacctgagccccgagaagaacgccgaggacatggaggtgagatggttcagaagccagttcagccccgccgtgttcgtgtacaagggcggcagagagagaaccgaggagcagatggaggagtacagaggcagaaccaccttcgtgagcaaggacatcagcagaggcagcgtggccctggtgatccacaacatcaccgcccaggagaacggcacctacagatgctacttccaggagggcagaagctacgacgaggccatcctgcacctggtggtggccggcctgggcagcaagcccctgatcagcatgagaggccacgaggacggcggcatcagactggagtgcatcagcagaggctggtaccccaagcccctgaccgtgtggagagacccctacggcggcgtggcccccgccctgaaggaggtgagcatgcccgacgccgacggcctgttcatggtgaccaccgccgtgatcatcagagacaagagcgtgagaaacatgagctgcagcatcaacaacaccctgctgggccagaagaaggagagcgtgatcttcatccccgagagcttcatgcccagcgtgagcccctgcgccgtggccctgcccatcatcgtggtgatcctgatgatccccatcgccgtgtgcatctactggatcaacaagctgcagaaggagaagaagatcctgagcggcgagaaggagttcgagagagagaccagagagatcgccctgaaggagctggagaaggagagagtgcagaaggaggaggagctgcaggtgaaggagaagctgcaggaggagctgagatggagaagaaccttcctgcacgccgtggacgtggtgctggaccccgacaccgcccaccccgacctgttcctgagcgaggacagaagaagcgtgagaagatgccccttcagacacctgggcgagagcgtgcccgacaaccccgagagattcgacagccagccctgcgtgctgggcagagagagcttcgccagcggcaagcactactgggaggtggaggtggagaacgtgatcgagtggaccgtgggcgtgtgcagagacagcgtggagagaaagggcgaggtgctgctgatcccccagaacggcttctggaccctggagatgcacaagggccagtacagagccgtgagcagccccgacagaatcctgcccctgaaggagagcctgtgcagagtgggcgtgttcctggactacgaggccggcgacgtgagcttctacaacatgagagacagaagccacatctacacctgccccagaagcgccttcagcgtgcccgtgagacccttcttcagactgggctgcgaggacagccccatcttcatctgccccgccctgaccggcgccaacggcgtgaccgtgcccgaggagggcctgaccctgcacagagtgggcacccaccagagcctgtag

SEQ ID NO: 74711 - DNA, 1005 bp, Artificial Sequence
  Description of Artificial Sequence: Synthetic coding sequence
atggagagcgccgccgccctgcacttcagcagacccgccagcctgctgctgctgctgctgagcctgtgcgccctggtgagcgcccagttcatcgtggtgggccccaccgaccccatcctggccaccgtgggcgagaacaccaccctgagatgccacctgagccccgagaagaacgccgaggacatggaggtgagatggttcagaagccagttcagccccgccgtgttcgtgtacaagggcggcagagagagaaccgaggagcagatggaggagtacagaggcagaaccaccttcgtgagcaaggacatcagcagaggcagcgtggccctggtgatccacaacatcaccgcccaggagaacggcacctacagatgctacttccaggagggcagaagctacgacgaggccatcctgcacctggtggtggccggcctgggcagcaagcccctgatcagcatgagaggccacgaggacggcggcatcagactggagtgcatcagcagaggctggtaccccaagcccctgaccgtgtggagagacccctacggcggcgtggcccccgccctgaaggaggtgagcatgcccgacgccgacggcctgttcatggtgaccaccgccgtgatcatcagagacaagagcgtgagaaacatgagctgcagcatcaacaacaccctgctgggccagaagaaggagagcgtgatcttcatccccgagagcttcatgcccagcgtgagcccctgcgccgtggccctgcccatcatcgtggtgatcctgatgatccccatcgccgtgtgcatctactggatcaacaagctgcagaaggagaagaagatcctgagcggcgagaaggagttcgagagagagaccagagagatcgccctgaaggagctggagaaggagagagtgcagaaggaggaggagctgcaggtgaaggagaagctgcaggaggagctgagatggagaagaaccttcctgcacgccgagctgcagttcttcagcaactag

SEQ ID NO: 74712 - DNA, 993 bp, Artificial Sequence
  Description of Artificial Sequence: Synthetic coding sequence
atggagagcgccgccgccctgcacttcagcagacccgccagcctgctgctgctgctgctgagcctgtgcgccctggtgagcgcccagttcatcgtggtgggccccaccgaccccatcctggccaccgtgggcgagaacaccaccctgagatgccacctgagccccgagaagaacgccgaggacatggaggtgagatggttcagaagccagttcagccccgccgtgttcgtgtacaagggcggcagagagagaaccgaggagcagatggaggagtacagaggcagaaccaccttcgtgagcaaggacatcagcagaggcagcgtggccctggtgatccacaacatcaccgcccaggagaacggcacctacagatgctacttccaggagggcagaagctacgacgaggccatcctgcacctggtggtggccggcctgggcagcaagcccctgatcagcatgagaggccacgaggacggcggcatcagactggagtgcatcagcagaggctggtaccccaagcccctgaccgtgtggagagacccctacggcggcgtggcccccgccctgaaggaggtgagcatgcccgacgccgacggcctgttcatggtgaccaccgccgtgatcatcagagacaagagcgtgagaaacatgagctgcagcatcaacaacaccctgctgggccagaagaaggagagcgtgatcttcatccccgagagcttcatgcccagcgtgagcccctgcgccgtggccctgcccatcatcgtggtgatcctgatgatccccatcgccgtgtgcatctactggatcaacaagctgcagaaggagaagaagatcctgagcggcgagaaggagttcgagagagagaccagagagatcgccctgaaggagctggagaaggagagagtgcagaaggaggaggagctgcaggtgaaggagaagctgcaggaggagctgagatggagaagaaccttcctgcacgccggccccgtgtag

SEQ ID NO: 74713 - DNA, 1401 bp, Artificial Sequence
  Description of Artificial Sequence: Synthetic coding sequence
atggaggtgagatggttcagaagccagttcagccccgccgtgttcgtgtacaagggcggcagagagagaaccgaggagcagatggaggagtacagaggcagaaccaccttcgtgagcaaggacatcagcagaggcagcgtggccctggtgatccacaacatcaccgcccaggagaacggcacctacagatgctacttccaggagggcagaagctacgacgaggccatcctgcacctggtggtggccggcctgggcagcaagcccctgatcagcatgagaggccacgaggacggcggcatcagactggagtgcatcagcagaggctggtaccccaagcccctgaccgtgtggagagacccctacggcggcgtggcccccgccctgaaggaggtgagcatgcccgacgccgacggcctgttcatggtgaccaccgccgtgatcatcagagacaagagcgtgagaaacatgagctgcagcatcaacaacaccctgctgggccagaagaaggagagcgtgatcttcatccccgagagcttcatgcccagcgtgagcccctgcgccgtggccctgcccatcatcgtggtgatcctgatgatccccatcgccgtgtgcatctactggatcaacaagctgcagaaggagaagaagatcctgagcggcgagaaggagttcgagagagagaccagagagatcgccctgaaggagctggagaaggagagagtgcagaaggaggaggagctgcaggtgaaggagaagctgcaggaggagctgagatggagaagaaccttcctgcacgccgtggacgtggtgctggaccccgacaccgcccaccccgacctgttcctgagcgaggacagaagaagcgtgagaagatgccccttcagacacctgggcgagagcgtgcccgacaaccccgagagattcgacagccagccctgcgtgctgggcagagagagcttcgccagcggcaagcactactgggaggtggaggtggagaacgtgatcgagtggaccgtgggcgtgtgcagagacagcgtggagagaaagggcgaggtgctgctgatcccccagaacggcttctggaccctggagatgcacaagggccagtacagagccgtgagcagccccgacagaatcctgcccctgaaggagagcctgtgcagagtgggcgtgttcctggactacgaggccggcgacgtgagcttctacaacatgagagacagaagccacatctacacctgccccagaagcgccttcagcgtgcccgtgagacccttcttcagactgggctgcgaggacagccccatcttcatctgccccgccctgaccggcgccaacggcgtgaccgtgcccgaggagggcctgaccctgcacagagtgggcacccaccagagcctgtag

SEQ ID NO: 74714 - DNA, 1224 bp, Artificial Sequence
  Description of Artificial Sequence: Synthetic coding sequence
atggagcccgccgccgccctgcacttcagcctgcccgccagcctgctgctgctgctgctgctgctgctgctgagcctgtgcgccctggtgagcggcctgggcagcaagcccctgatcgagatcaaggcccaggaggacggcagcatctggctggagtgcatcagcggcggctggtaccccgagcccctgaccgtgtggagagacccctacggcgaggtggtgcccgccctgaaggaggtgagcatcgccgacgccgacggcctgttcatggtgaccaccgccgtgatcatcagagacaagtacgtgagaaacgtgagctgcagcgtgaacaacaccctgctgggccaggagaaggagaccgtgatcttcatccccgagagcttcatgcccagcgccagcccctggatggtggccctggccgtgatcctgaccgccagcccctggatggtgagcatgaccgtgatcctggccgtgttcatcatcttcatggccgtgagcatctgctgcatcaagaagctgcagagagagaagaagatcctgagcggcgagaagaaggtggagcaggaggagaaggagatcgcccagcagctgcaggaggagctgagatggagaagaaccttcctgcacgccgccgacgtggtgctggaccccgacaccgcccaccccgagctgttcctgagcgaggacagaagaagcgtgagaagaggcccctacagacagagagtgcccgacaaccccgagagattcgacagccagccctgcgtgctgggctgggagagcttcgccagcggcaagcactactgggaggtggaggtggagaacgtgatggtgtggaccgtgggcgtgtgcagacacagcgtggagagaaagggcgaggtgctgctgatcccccagaacggcttctggaccctggagatgttcggcaaccagtacagagccctgagcagccccgagagaatcctgcccctgaaggagagcctgtgcagagtgggcgtgttcctggactacgaggccggcgacgtgagcttctacaacatgagagacagaagccacatctacacctgccccagaagcgccttcaccgtgcccgtgagacccttcttcagactgggcagcgacgacagccccatcttcatctgccccgccctgaccggcgccagcggcgtgatggtgcccgaggagggcctgaagctgcacagagtgggcacccaccagagcctgtag

SEQ ID NO: 74715 - DNA, 1572 bp, Artificial Sequence
  Description of Artificial Sequence: Synthetic coding sequence
atggagcccgccgccgccctgcacttcagcctgcccgccagcctgctgctgctgctgctgctgctgctgctgagcctgtgcgccctggtgagcgcccagttcaccgtggtgggccccgccaaccccatcctggccatggtgggcgagaacaccaccctgagatgccacctgagccccgagaagaacgccgaggacatggaggtgagatggttcagaagccagttcagccccgccgtgttcgtgtacaagggcggcagagagagaaccgaggagcagatggaggagtacagaggcagaatcaccttcgtgagcaaggacatcaacagaggcagcgtggccctggtgatccacaacgtgaccgcccaggagaacggcatctacagatgctacttccaggagggcagaagctacgacgaggccatcctgagactggtggtggccggcctgggcagcaagcccctgatcgagatcaaggcccaggaggacggcagcatctggctggagtgcatcagcggcggctggtaccccgagcccctgaccgtgtggagagacccctacggcgaggtggtgcccgccctgaaggaggtgagcatcgccgacgccgacggcctgttcatggtgaccaccgccgtgatcatcagagacaagtacgtgagaaacgtgagctgcagcgtgaacaacaccctgctgggccaggagaaggagaccgtgatcttcatccccgagagcttcatgcccagcgccagcccctggatggtggccctggccgtgatcctgaccgccagcccctggatggtgagcatgaccgtgatcctggccgtgttcatcatcttcatggccgtgagcatctgctgcatcaagaagctgcagagagagaagaagatcctgagcggcgagaagaaggtggagcaggaggagaaggagatcgcccagcagctgcaggaggagctgagatggagaagaaccttcctgcacgccgccgacgtggtgctggaccccgacaccgcccaccccgagctgttcctgagcgaggacagaagaagcgtgagaagaggcccctacagacagagagtgcccgacaaccccgagagattcgacagccagccctgcgtgctgggctgggagagcttcgccagcggcaagcactactgggaggtggaggtggagaacgtgatggtgtggaccgtgggcgtgtgcagacacagcgtggagagaaagggcgaggtgctgctgatcccccagaacggcttctggaccctggagatgttcggcaaccagtacagagccctgagcagccccgagagaatcctgcccctgaaggagagcctgtgcagagtgggcgtgttcctggactacgaggccggcgacgtgagcttctacaacatgagagacagaagccacatctacacctgccccagaagcgccttcaccgtgcccgtgagacccttcttcagactgggcagcgacgacagccccatcttcatctgccccgccctgaccggcgccagcggcgtgatggtgcccgaggagggcctgaagctgcacagagtgggcacccaccagagcctgtag

SEQ ID NO: 74716 - DNA, 1572 bp, Artificial Sequence; identical to SEQ ID NO: 74715
  Description of Artificial Sequence: Synthetic coding sequence

SEQ ID NO: 74717 - DNA, 1011 bp, Artificial Sequence
  Description of Artificial Sequence: Synthetic coding sequence
atggagcccgccgccgccctgcacttcagcctgcccgccagcctgctgctgctgctgctgctgctgctgctgagcctgtgcgccctggtgagcgcccagttcaccgtggtgggccccgccaaccccatcctggccatggtgggcgagaacaccaccctgagatgccacctgagccccgagaagaacgccgaggacatggaggtgagatggttcagaagccagttcagccccgccgtgttcgtgtacaagggcggcagagagagaaccgaggagcagatggaggagtacagaggcagaatcaccttcgtgagcaaggacatcaacagaggcagcgtggccctggtgatccacaacgtgaccgcccaggagaacggcatctacagatgctacttccaggagggcagaagctacgacgaggccatcctgagactggtggtggccggcctgggcagcaagcccctgatcgagatcaaggcccaggaggacggcagcatctggctggagtgcatcagcggcggctggtaccccgagcccctgaccgtgtggagagacccctacggcgaggtggtgcccgccctgaaggaggtgagcatcgccgacgccgacggcctgttcatggtgaccaccgccgtgatcatcagagacaagtacgtgagaaacgtgagctgcagcgtgaacaacaccctgctgggccaggagaaggagaccgtgatcttcatccccgagagcttcatgcccagcgccagcccctggatggtggccctggccgtgatcctgaccgccagcccctggatggtgagcatgaccgtgatcctggccgtgttcatcatcttcatggccgtgagcatctgctgcatcaagaagctgcagagagagaagaagatcctgagcggcgagaagaaggtggagcaggaggagaaggagatcgcccagcagctgcaggaggagctgagatggagaagaaccttcctgcacgccgacgtgaacctgaccggcctgagaaacacctag

SEQ ID NO: 74718 - DNA, 333 bp, Artificial Sequence
  Description of Artificial Sequence: Synthetic coding sequence
atggagcccgccgccgccctgcacttcagcctgcccgccagcctgctgctgctgctgctgctgctgctgctgagcctgtgcgccctggtgagcggcctgggcagcaagcccctgatcgagatcaaggcccaggaggacggcagcatctggctggagtgcatcagcggcggctggtaccccgagcccctgaccgtgtggagagacccctacggcgaggtggtgcccgccctgaaggaggtgagcatcgccgacgccgacggcctgttcatggtgaccaccgccgtgatcatcagagacaagtacgtgagaaacgtgagctgcagcgtgaactag

SEQ ID NO: 74719 - DNA, 555 bp, Artificial Sequence
  Description of Artificial Sequence: Synthetic coding sequence
atggagcccgccgccgccctgcacttcagcctgcccgccagcctgctgctgctgctgctgctgctgctgctgagcctgtgcgccctggtgagcggcctgggcagcaagcccctgatcgagatcaaggcccaggaggacggcagcatctggctggagtgcatcagcggcggctggtaccccgagcccctgaccgtgtggagagacccctacggcgaggtggtgcccgccctgaaggaggtgagcatcgccgacgccgacggcctgttcatggtgaccaccgccgtgatcatcagagacaagtacgtgagaaacgtgagctgcagcgtgaacaacaccctgctgggccaggagaaggagaccgtgatcttcatccccgagagcttcatgcccagcgccagcccctggatggtggccctggccgtgatcctgaccgccagcccctggatggtgagcatgaccgtgatcctggccgtgttcatcatcttcatggccgtgagcatctgctgcatcaagaagctgcagagagagaagaagatcctgagcggcgagaagtag

SEQ ID NO: 74720 - DNA, 720 bp, Artificial Sequence
  Description of Artificial Sequence: Synthetic coding sequence
atggagcccgccgccgccctgcacttcagcctgcccgccagcctgctgctgctgctgctgctgctgctgctgagcctgtgcgccctggtgagcgcccagttcaccgtggtgggccccgccaaccccatcctggccatggtgggcgagaacaccaccctgagatgccacctgagccccgagaagaacgccgaggacatggaggtgagatggttcagaagccagttcagccccgccgtgttcgtgtacaagggcggcagagagagaaccgaggagcagatggaggagtacagaggcagaatcaccttcgtgagcaaggacatcaacagaggcagcgtggccctggtgatccacaacgtgaccgcccaggagaacggcatctacagatgctacttccaggagggcagaagctacgacgaggccatcctgagactggtggtggccggcctgggcagcaagcccctgatcgagatcaaggcccaggaggacggcagcatctggctggagtgcatcagcggcggctggtaccccgagcccctgaccgtgtggagagacccctacggcgaggtggtgcccgccctgaaggaggtgagcatcgccgacgccgacggcctgttcatggtgaccaccgccgtgatcatcagagacaagtacgtgagaaacgtgagctgcagcgtgaacaacaccctgctgggccaggagaaggagaccgtgatcttctag

SEQ ID NO: 74721 - DNA, 291 bp, Artificial Sequence
  Description of Artificial Sequence: Synthetic coding sequence
atggagcccgccgccgccctgcacttcagcctgcccgccagcctgctgctgctgctgctgctgctgctgctgagcctgtgcgccctggtgagcgcccagttcaccgtggtgggccccgccaaccccatcctggccatggtgggcgagaacaccaccctgagatgccacctgagccccgagaagaacgccgaggacatggaggtgagatggttcagaagccagttcagccccgccgtgttcgtgtacaagggcggcagagagagaaccgaggagcagatggaggagtactag

SEQ ID NO: 74722 - DNA, 1542 bp, Artificial Sequence
  Description of Artificial Sequence: Synthetic coding sequence
atgaagatggccagcttcctggccttcctgctgctgaacttcagagtgtgcctgctgctgctgcagctgctgatgccccacagcgcccagttcagcgtgctgggccccagcggccccatcctggccatggtgggcgaggacgccgacctgccctgccacctgttccccaccatgagcgccgagaccatggagctgaagtgggtgagcagcagcctgagacaggtggtgaacgtgtacgccgacggcaaggaggtggaggacagacagagcgccccctacagaggcagaaccagcatcctgagagacggcatcaccgccggcaaggccgccctgagaatccacaacgtgaccgccagcgacagcggcaagtacctgtgctacttccaggacggcgacttctacgagaaggccctggtggagctgaaggtggccgccctgggcagcgacctgcacgtggacgtgaagggctacaaggacggcggcatccacctggagtgcagaagcaccggctggtacccccagccccagatccagtggagcaacaacaagggcgagaacatccccaccgtggaggcccccgtggtggccgacggcgtgggcctgtacgccgtggccgccagcgtgatcatgagaggcagcagcggcgagggcgtgagctgcaccatcagaagcagcctgctgggcctggagaagaccgccagcatcagcatcgccgaccccttcttcagaagcgcccagagatggatcgccgccctggccggcaccctgcccgtgctgctgctgctgctgggcggcgccggctacttcctgtggcagcagcaggaggagaagaagacccagttcagaaagaagaagagagagcaggagctgagagagatggcctggagcaccatgaagcaggagcagagcaccagagtgaagctgctggaggagctgagatggagaagcatccagtacgccagcagaggcgagagacacagcgcctacaacgagtggaagaaggccctgttcaagcccgccgacgtgatcctggaccccaagaccgccaaccccatcctgctggtgagcgaggaccagagaagcgtgcagagagccaaggagccccaggacctgcccgacaaccccgagagattcaactggcactactgcgtgctgggctgcgagagcttcatcagcggcagacactactgggaggtggaggtgggcgacagaaaggagtggcacatcggcgtgtgcagcaagaacgtgcagagaaagggctgggtgaagatgacccccgagaacggcttctggaccatgggcctgaccgacggcaacaagtacagaaccctgaccgagcccagaaccaacctgaagctgcccaagccccccaagaaggtgggcgtgttcctggactacgagaccggcgacatcagcttctacaacgccgtggacggcagccacatccacaccttcctggacgtgagcttcagcgaggccctgtaccccgtgttcagaatcctgaccctggagcccaccgccctgaccatctgccccgcctag

SEQ ID NO: 74723 - DNA, 1386 bp, Artificial Sequence
  Description of Artificial Sequence: Synthetic coding sequence
atgaagatggccagcttcctggccttcctgctgctgaacttcagagtgtgcctgctgctgctgcagctgctgatgccccacagcgcccagttcagcgtgctgggccccagcggccccatcctggccatggtgggcgaggacgccgacctgccctgccacctgttccccaccatgagcgccgagaccatggagctgaagtgggtgagcagcagcctgagacaggtggtgaacgtgtacgccgacggcaaggaggtggaggacagacagagcgccccctacagaggcagaaccagcatcctgagagacggcatcaccgccggcaaggccgccctgagaatccacaacgtgaccgccagcgacagcggcaagtacctgtgctacttccaggacggcgacttctacgagaaggccctggtggagctgaaggtggccgacggcgtgggcctgtacgccgtggccgccagcgtgatcatgagaggcagcagcggcgagggcgtgagctgcaccatcagaagcagcctgctgggcctggagaagaccgccagcatcagcatcgccgaccccttcttcagaagcgcccagagatggatcgccgccctggccggcaccctgcccgtgctgctgctgctgctgggcggcgccggctacttcctgtggcagcagcaggaggagaagaagacccagttcagaaagaagaagagagagcaggagctgagagagatggcctggagcaccatgaagcaggagcagagcaccagagtgaagctgctggaggagctgagatggagaagcatccagtacgccagcagaggcgagagacacagcgcctacaacgagtggaagaaggccctgttcaagcccgccgacgtgatcctggaccccaagaccgccaaccccatcctgctggtgagcgaggaccagagaagcgtgcagagagccaaggagccccaggacctgcccgacaaccccgagagattcaactggcactactgcgtgctgggctgcgagagcttcatcagcggcagacactactgggaggtggaggtgggcgacagaaaggagtggcacatcggcgtgtgcagcaagaacgtgcagagaaagggctgggtgaagatgacccccgagaacggcttctggaccatgggcctgaccgacggcaacaagtacagaaccctgaccgagcccagaaccaacctgaagctgcccaagccccccaagaaggtgggcgtgttcctggactacgagaccggcgacatcagcttctacaacgccgtggacggcagccacatccacaccttcctggacgtgagcttcagcgaggccctgtaccccgtgttcagaatcctgaccctggagcccaccgccctgaccatctgccccgcctag

SEQ ID NO: 74724 - DNA, 1137 bp, Artificial Sequence
  Description of Artificial Sequence: Synthetic coding sequence
atgaagatggccagcttcctggccttcctgctgctgaacttcagagtgtgcctgctgctgctgcagctgctgatgccccacagcgcccagttcagcgtgctgggccccagcggccccatcctggccatggtgggcgaggacgccgacctgccctgccacctgttccccaccatgagcgccgagaccatggagctgaagtgggtgagcagcagcctgagacaggtggtgaacgtgtacgccgacggcaaggaggtggaggacagacagagcgccccctacagaggcagaaccagcatcctgagagacggcatcaccgccggcaaggccgccctgagaatccacaacgtgaccgccagcgacagcggcaagtacctgtgctacttccaggacggcgacttctacgagaaggccctggtggagctgaaggtggccgccctgggcagcgacctgcacgtggacgtgaagggctacaaggacggcggcatccacctggagtgcagaagcaccggctggtacccccagccccagatccagtggagcaacaacaagggcgagaacatccccaccgtggaggcccccgtggtggccgacggcgtgggcctgtacgccgtggccgccagcgtgatcatgagaggcagcagcggcgagggcgtgagctgcaccatcagaagcagcctgctgggcctggagaagaccgccagcatcagcatcgccgaccccttcttcagaagcgcccagagatggatcgccgccctggccggcaccctgcccgtgctgctgctgctgctgggcggcgccggctacttcctgtggcagcagcaggaggagaagaagacccagttcagaaagaagaagagagagcaggagctgagagagatggcctggagcaccatgaagcaggagcagagcaccagagtgaagctgctggaggagctgagatggagaagcatccagtacgccagcagaggcgagagacacagcgcctacaacgagtggaagaaggccctgttcaagcccggcccccccatcggccagacccagcagcagaccagaggccagggcagccccgtggccctgagccaggagagcgcccagagaaccgacagctggggccccgaggagggcggcgagagctag

SEQ ID NO: 74725 - DNA, 132 bp, Artificial Sequence
  Description of Artificial Sequence: Synthetic coding sequence
atgaagatggccagcttcctggccttcctgctgctgaacttcagagtgtgcctgctgctgctgcagctgctgatgccccacagcgcccagttcagcgtgctgggccccagcggccccatcctggccatgtag

SEQ ID NO: 74726 - DNA, 360 bp, Artificial Sequence
  Description of Artificial Sequence: Synthetic coding sequence
atgaagatggccagcttcctggccttcctgctgctgaacttcagagtgtgcctgctgctgctgcagctgctgatgccccacagcgcccagttcagcgtgctgggccccagcggccccatcctggccatggtgggcgaggacgccgacctgccctgccacctgttccccaccatgagcgccgagaccatggagctgaagtgggtgagcagcagcctgagacaggtggtgaacgtgtacgccgacggcaaggaggtggaggacagacagagcgccccctacagaggcagaaccagcatcctgagagacggcatcaccgccggcaaggccgccctgagaatccacaacgtgaccgccagctag

SEQ ID NO: 74727 - DNA, 1059 bp, Artificial Sequence
  Description of Artificial Sequence: Synthetic coding sequence
atgaagatggccagcttcctggccttcctgctgctgaacttcagagtgtgcctgctgctgctgcagctgctgatgccccacagcgcccagttcagcgtgctgggccccagcggccccatcctggccatggtgggcgaggacgccgacctgccctgccacctgttccccaccatgagcgccgagaccatggagctgaagtgggtgagcagcagcctgagacaggtggtgaacgtgtacgccgacggcaaggaggtggaggacagacagagcgccccctacagaggcagaaccagcatcctgagagacggcatcaccgccggcaaggccgccctgagaatccacaacgtgaccgccagcgacagcggcaagtacctgtgctacttccaggacggcgacttctacgagaaggccctggtggagctgaaggtggccgccctgggcagcgacctgcacgtggacgtgaagggctacaaggacggcggcatccacctggagtgcagaagcaccggctggtacccccagccccagatccagtggagcaacaacaagggcgagaacatccccaccgtggaggcccccgtggtggccgacggcgtgggcctgtacgccgtggccgccagcgtgatcatgagaggcagcagcggcgagggcgtgagctgcaccatcagaagcagcctgctgggcctggagaagaccgccagcatcagcatcgccgaccccttcttcagaagcgcccagagatggatcgccgccctggccggcaccctgcccgtgctgctgctgctgctgggcggcgccggctacttcctgtggcagcagcaggaggagaagaagacccagttcagaaagaagaagagagagcaggagctgagagagatggcctggagcaccatgaagcaggagcagagcaccagagtgaagctgctggaggagctgagatggagaagcatccagtacgccagcagaggcgagagacacagcgcctacaacgagtggaagaaggccctgttcaagcccggcgaggagatgctgcagatgagactgcacttcgtgaagtag

SEQ ID NO: 74728 - DNA, 279 bp, Artificial Sequence
  Description of Artificial Sequence: Synthetic coding sequence
atgaagatggccagcttcctggccttcctgctgctgaacttcagagtgtgcctgctgctgctgcagctgctgatgccccacagcgcccagttcagcgtgctgggccccagcggccccatcctggccatggtgggcgaggacgccgacctgccctgccacctgttccccaccatgagcgccgagaccatggagctgaagtgggtgagcagcagcctgagacaggtggtgaacgtgtacgccgacggcaaggaggtggaggacagacagagcgccccctag

SEQ ID NO: 74729 - DNA, 1005 bp, Artificial Sequence
  Description of Artificial Sequence: Synthetic coding sequence
atgaagatggccagcagcctggccttcctgctgctgaacttccacgtgagcctgctgctggtgcagctgctgaccccctgcagcgcccagttcagcgtgctgggccccagcggccccatcctggccatggtgggcgaggacgccgacctgccctgccacctgttccccaccatgagcgccgagaccatggagctgaagtgggtgagcagcagcctgagacaggtggtgaacgtgtacgccgacggcaaggaggtggaggacagacagagcgccccctacagaggcagaaccagcatcctgagagacggcatcaccgccggcaaggccgccctgagaatccacaacgtgaccgccagcgacagcggcaagtacctgtgctacttccaggacggcgacttctacgagaaggccctggtggagctgaaggtggccgccctgggcagcaacctgcacgtggaggtgaagggctacgaggacggcggcatccacctggagtgcagaagcaccggctggtacccccagccccagatccagtggagcaacgccaagggcgagaacatccccgccgtggaggcccccgtggtggccgacggcgtgggcctgtacgaggtggccgccagcgtgatcatgagaggcggcagcggcgagggcgtgagctgcatcatcagaaacagcctgctgggcctggagaagaccgccagcatcagcatcgccgaccccttcttcagaagcgcccagccctggatcgccgccctggccggcaccctgcccatcctgctgctgctgctggccggcgccagctacttcctgtggagacagcagaaggagatcaccgccctgagcagcgagatcgagagcgagcaggagatgaaggagatgggctacgccgccaccgagagagagatcagcctgagagagagcctgcaggaggagctgaagagaaagaagatccagtacctgaccagaggcgaggagagcagcagcgacaccaacaagagcgcctag

SEQ ID NO: 74730 - DNA, 1005 bp, Artificial Sequence; identical to SEQ ID NO: 74729
  Description of Artificial Sequence: Synthetic coding sequence

SEQ ID NO: 74731 - DNA, 936 bp, Artificial Sequence
  Description of Artificial Sequence: Synthetic coding sequence
atgggcatccccagagcccagttcagcgtgctgggccccagcggccccatcctggccatggtgggcgaggacgccgacctgccctgccacctgttccccaccatgagcgccgagaccatggagctgaagtgggtgagcagcagcctgagacaggtggtgaacgtgtacgccgacggcaaggaggtggaggacagacagagcgccccctacagaggcagaaccagcatcctgagagacggcatcaccgccggcaaggccgccctgagaatccacaacgtgaccgccagcgacagcggcaagtacctgtgctacttccaggacggcgacttctacgagaaggccctggtggagctgaaggtggccgccctgggcagcaacctgcacgtggaggtgaagggctacgaggacggcggcatccacctggagtgcagaagcaccggctggtacccccagccccagatccagtggagcaacgccaagggcgagaacatccccgccgtggaggcccccgtggtggccgacggcgtgggcctgtacgaggtggccgccagcgtgatcatgagaggcggcagcggcgagggcgtgagctgcatcatcagaaacagcctgctgggcctggagaagaccgccagcatcagcatcgccgaccccttcttcagaagcgcccagccctggatcgccgccctggccggcaccctgcccatcctgctgctgctgctggccggcgccagctacttcctgtggagacagcagaaggagatcaccgccctgagcagcgagatcgagagcgagcaggagatgaaggagatgggctacgccgccaccgagagagagatcagcctgagagagagcctgcaggaggagctgaagagaaagaagatccagtacctgaccagaggcgaggagagcagcagcgacaccaacaagagcgcctag

SEQ ID NO: 74732 - DNA, 1005 bp, Artificial Sequence; identical to SEQ ID NO: 74729
  Description of Artificial Sequence: Synthetic coding sequence

SEQ ID NO: 74733 - DNA, 879 bp, Artificial Sequence
  Description of Artificial Sequence: Synthetic coding sequence
atggtgggcgaggacgccgacctgccctgccacctgttccccaccatgagcgccgagaccatggagctgaagtgggtgagcagcagcctgagacaggtggtgaacgtgtacgccgacggcaaggaggtggaggacagacagagcgccccctacagaggcagaaccagcatcctgagagacggcatcaccgccggcaaggccgccctgagaatccacaacgtgaccgccagcgacagcggcaagtacctgtgctacttccaggacggcgacttctacgagaaggccctggtggagctgaaggtggccgccctgggcagcaacctgcacgtggaggtgaagggctacgaggacggcggcatccacctggagtgcagaagcaccggctggtacccccagccccagatccagtggagcaacgccaagggcgagaacatccccgccgtggaggcccccgtggtggccgacggcgtgggcctgtacgaggtggccgccagcgtgatcatgagaggcggcagcggcgagggcgtgagctgcatcatcagaaacagcctgctgggcctggagaagaccgccagcatcagcatcgccgaccccttcttcagaagcgcccagccctggatcgccgccctggccggcaccctgcccatcctgctgctgctgctggccggcgccagctacttcctgtggagacagcagaaggagatcaccgccctgagcagcgagatcgagagcgagcaggagatgaaggagatgggctacgccgccaccgagagagagatcagcctgagagagagcctgcaggaggagctgaagagaaagaagatccagtacctgaccagaggcgaggagagcagcagcgacaccaacaagagcgcctag

SEQ ID NO: 74734 - DNA, 1005 bp, Artificial Sequence; identical to SEQ ID NO: 74729
  Description of Artificial Sequence: Synthetic coding sequence

SEQ ID NO: 74735 - DNA, 960 bp, Artificial Sequence
  Description of Artificial Sequence: Synthetic coding sequence
atgaagatggccagcagcctggccttcctgctgctgaacttccacgtgagcctgctgctggtgcagctgctgaccccctgcagcgcccagttcagcgtgctgggccccagcggccccatcctggccatggtgggcgaggacgccgacctgccctgccacctgttccccaccatgagcgccgagaccatggagctgaagtgggtgagcagcagcctgagacaggtggtgaacgtgtacgccgacggcaaggaggtggaggacagacagagcgccccctacagaggcagaaccagcatcctgagagacggcatcaccgccggcaaggccgccctgagaatccacaacgtgaccgccagcgacagcggcaagtacctgtgctacttccaggacggcgacttctacgagaaggccctggtggagctgaaggtggccgccctgggcagcaacctgcacgtggaggtgaagggctacgaggacggcggcatccacctggagtgcagaagcaccggctggtacccccagccccagatccagtggagcaacgccaagggcgagaacatccccgccgtggaggcccccgtggtggccgacggcgtgggcctgtacgaggtggccgccagcgtgatcatgagaggcggcagcggcgagggcgtgagctgcatcatcagaaacagcctgctgggcctggagaagaccgccagcatcagcatcgccgaccccttcttcagaagcgcccagccctggatcgccgccctggccggcaccctgcccatcctgctgctgctgctggccggcgccagctacttcctgtggagacagcagaaggagatcaccgccctgagcagcgagatcgagagcgagcaggagatgaaggagatgggctacgccgccaccgagagagagatcagcctgagagagagcctgcaggaggagctgaagagaaagaagagcagcacctag

SEQ ID NO: 74736 - DNA, 1755 bp, Artificial Sequence
  Description of Artificial Sequence: Synthetic coding sequence
atgaagatggccagcagcctggccttcctgctgctgaacttccacgtgagcctgttcctggtgcagctgctgaccccctgcagcgcccagttcagcgtgctgggccccagcggccccatcctggccatggtgggcgaggacgccgacctgccctgccacctgttccccaccatgagcgccgagaccatggagctgagatgggtgagcagcagcctgagacaggtggtgaacgtgtacgccgacggcaaggaggtggaggacagacagagcgccccctacagaggcagaaccagcatcctgagagacggcatcaccgccggcaaggccgccctgagaatccacaacgtgaccgccagcgacagcggcaagtacctgtgctacttccaggacggcgacttctacgagaaggccctggtggagctgaaggtggccgccctgggcagcgacctgcacatcgaggtgaagggctacgaggacggcggcatccacctggagtgcagaagcaccggctggtacccccagccccagatcaagtggagcgacaccaagggcgagaacatccccgccgtggaggcccccgtggtggccgacggcgtgggcctgtacgccgtggccgccagcgtgatcatgagaggcagcagcggcggcggcgtgagctgcatcatcagaaacagcctgctgggcctggagaagaccgccagcatcagcatcgccgaccccttcttcagaagcgcccagccctggatcgccgccctggccggcaccctgcccatcagcctgctgctgctggccggcgccagctacttcctgtggagacagcagaaggagaagatcgccctgagcagagagaccgagagagagagagagatgaaggagatgggctacgccgccaccgagcaggagatcagcctgagagagaagctgcaggaggagctgaagtggagaaagatccagtacatggccagaggcgagaagagcctggcctaccacgagtggaagatggccctgttcaagcccgccgacgtgatcctggaccccgacaccgccaacgccatcctgctggtgagcgaggaccagagaagcgtgcagagagccgaggagcccagagacctgcccgacaaccccgagagattcgagtggagatactgcgtgctgggctgcgagaacttcaccagcggcagacactactgggaggtggaggtgggcgacagaaaggagtggcacatcggcgtgtgcagcaagaacgtggagagaaagaagggctgggtgaagatgacccccgagaacggctactggaccatgggcctgaccgacggcaacaagtacagagccctgaccgagcccagaaccaacctgaagctgcccgagccccccagaaaggtgggcatcttcctggactacgagaccggcgagatcagcttctacaacgccaccgacggcagccacatctacaccttcccccacgccagcttcagcgagcccctgtaccccgtgttcagaatcctgaccctggagcccaccgccctgaccatctgccccatccccaaggaggtggagagcagccccgaccccgacctggtgcccgaccacagcctggagacccccctgacccccggcctggccaacgagagcggcgagccccaggccgaggtgaccagcctgctgctgcccgcccaccccggcgccgaggtgagccccagcgccaccaccaaccagaaccacaagctgcaggccagaaccgaggccctgtactag

SEQ ID NO: 74737 - DNA, 1629 bp, Artificial Sequence
  Description of Artificial Sequence: Synthetic coding sequence
atggtgggcgaggacgccgacctgccctgccacctgttccccaccatgagcgccgagaccatggagctgagatgggtgagcagcagcctgagacaggtggtgaacgtgtacgccgacggcaaggaggtggaggacagacagagcgccccctacagaggcagaaccagcatcctgagagacggcatcaccgccggcaaggccgccctgagaatccacaacgtgaccgccagcgacagcggcaagtacctgtgctacttccaggacggcgacttctacgagaaggccctggtggagctgaaggtggccgccctgggcagcgacctgcacatcgaggtgaagggctacgaggacggcggcatccacctggagtgcagaagcaccggctggtacccccagccccagatcaagtggagcgacaccaagggcgagaacatccccgccgtggaggcccccgtggtggccgacggcgtgggcctgtacgccgtggccgccagcgtgatcatgagaggcagcagcggcggcggcgtgagctgcatcatcagaaacagcctgctgggcctggagaagaccgccagcatcagcatcgccgaccccttcttcagaagcgcccagccctggatcgccgccctggccggcaccctgcccatcagcctgctgctgctggccggcgccagctacttcctgtggagacagcagaaggagaagatcgccctgagcagagagaccgagagagagagagagatgaaggagatgggctacgccgccaccgagcaggagatcagcctgagagagaagctgcaggaggagctgaagtggagaaagatccagtacatggccagaggcgagaagagcctggcctaccacgagtggaagatggccctgttcaagcccgccgacgtgatcctggaccccgacaccgccaacgccatcctgctggtgagcgaggaccagagaagcgtgcagagagccgaggagcccagagacctgcccgacaaccccgagagattcgagtggagatactgcgtgctgggctgcgagaacttcaccagcggcagacactactgggaggtggaggtgggcgacagaaaggagtggcacatcggcgtgtgcagcaagaacgtggagagaaagaagggctgggtgaagatgacccccgagaacggctactggaccatgggcctgaccgacggcaacaagtacagagccctgaccgagcccagaaccaacctgaagctgcccgagccccccagaaaggtgggcatcttcctggactacgagaccggcgagatcagcttctacaacgccaccgacggcagccacatctacaccttcccccacgccagcttcagcgagcccctgtaccccgtgttcagaatcctgaccctggagcccaccgccctgaccatctgccccatccccaaggaggtggagagcagccccgaccccgacctggtgcccgaccacagcctggagacccccctgacccccggcctggccaacgagagcggcgagccccaggccgaggtgaccagcctgctgctgcccgcccaccccggcgccgaggtgagccccagcgccaccaccaaccagaaccacaagctgcaggccagaaccgaggccctgtactag

SEQ ID NO: 74738 - DNA, 417 bp, Artificial Sequence
  Description of Artificial Sequence: Synthetic coding sequence
atgaagatggccagcagcctggccttcctgctgctgaacttccacgtgagcctgttcctggtgcagctgctgaccccctgcagcgcccagttcagcgtgctgggccccagcggccccatcctggccatggtgggcgaggacgccgacctgccctgccacctgttccccaccatgagcgccgagaccatggagctgagatgggtgagcagcagcctgagacaggtggtgaacgtgtacgccgacggcaaggaggtggaggacagacagagcgccccctacagaggcagaaccagcatcctgagagacggcatcaccgccggcaaggccgccctgagaatccacaacgtgaccgccagcgacagcggcaagtacctgtgctacttccaggacggcgacttctacgagaaggccctgtag

SEQ ID NO: 74739 - DNA, 717 bp, Artificial Sequence
  Description of Artificial Sequence: Synthetic coding sequence
atgaagatggccagcagcctggccttcctgctgctgaacttccacgtgagcctgttcctggtgcagctgctgaccccctgcagcgcccagttcagcgtgctgggccccagcggccccatcctggccatggtgggcgaggacgccgacctgccctgccacctgttccccaccatgagcgccgagaccatggagctgagatgggtgagcagcagcctgagacaggtggtgaacgtgtacgccgacggcaaggaggtggaggacagacagagcgccccctacagaggcagaaccagcatcctgagagacggcatcaccgccggcaaggccgccctgagaatccacaacgtgaccgccagcgacagcggcaagtacctgtgctacttccaggacggcgacttctacgagaaggccctggtggagctgaaggtggccgccctgggcagcgacctgcacatcgaggtgaagggctacgaggacggcggcatccacctggagtgcagaagcaccggctggtacccccagccccagatcaagtggagcgacaccaagggcgagaacatccccgccgtggaggcccccgtggtggccgacggcgtgggcctgtacgccgtggccgccagcgtgatcatgagaggcagcagcggcggcggcgtgagctgcatcatcagaaacagcctgctgggcctggagaagaccgccagcatcagcatcgcctag

SEQ ID NO: 74740 - DNA, 1368 bp, Artificial Sequence
  Description of Artificial Sequence: Synthetic coding sequence
atggtggacttccccggctacaacctgagcggcgccgtggccagcttcctgttcatcctgctgaccatgaagcagagcgaggacttcagagtgatcggccccgcccaccccatcctggccggcgtgggcgaggacgccctgctgacctgccagctgctgcccaagagaaccaccatgcacgtggaggtgagatggtacagaagcgagcccagcacccccgtgttcgtgcacagagacggcgtggaggtgaccgagatgcagatggaggagtacagaggctgggtggagtggatcgagaacggcatcgccaagggcaacgtggccctgaagatccacaacatccagcccagcgacaacggccagtactggtgccacttccaggacggcaactactgcggcgagaccagcctgctgctgaaggtggccggcctgggcagcgcccccagcatccacatggagggccccggcgagagcggcgtgcagctggtgtgcaccgccagaggctggttccccgagccccaggtgtactgggaggacatcagaggcgagaagctgctggccgtgagcgagcacagaatccaggacaaggacggcctgttctacgccgaggccaccctggtggtgagaaacgccagcgccgagagcgtgagctgcctggtgcacaaccccgtgctgaccgaggagaagggcagcgtgatcagcctgcccgagaagctgcagaccgagctggccagcctgaaggtgaacggccccagccagcccatcctggtgagagtgggcgaggacatccagctgacctgctacctgagccccaaggccaacgcccagagcatggaggtgagatgggacagaagccacagataccccgccgtgcacgtgtacatggacggcgaccacgtggccggcgagcagatggccgagtacagaggcagaaccgtgctggtgagcgacgccatcgacgagggcagactgaccctgcagatcctgagcgccagacccagcgacgacggccagtacagatgcctgttcgagaaggacgacgtgtaccaggaggccagcctggacctgaaggtggtgagcctgggcagcagccccctgatcaccgtggagggccaggaggacggcgagatgcagcccatgtgcagcagcgacggctggttcccccagccccacgtgccctggagagacatggagggcaagaccatccccagcagcagccaggccctgacccagggcagccacggcctgttccacgtgcagaccctgctgagagtgaccaacatcagcgccgtggacgtgacctgcagcatcagcatccccttcctgggcgaggagaagatcgccaccttcagcctgagcggctggtag

SEQ ID NO: 74741 - DNA, 1167 bp, Artificial Sequence
  Description of Artificial Sequence: Synthetic coding sequence
atggtggacttccccggctacaacctgagcggcgccgtggccagcttcctgttcatcctgctgaccatgaagcagagcgaggacttcagagtgatcggccccgcccaccccatcctggccggcgtgggcgaggacgccctgctgacctgccagctgctgcccaagagaaccaccatgcacgtggaggtgagatggtacagaagcgagcccagcacccccgtgttcgtgcacagagacggcgtggaggtgaccgagatgcagatggaggagtacagaggctgggtggagtggatcgagaacggcatcgccaagggcaacgtggccctgaagatccacaacatccagcccagcgacaacggccagtactggtgccacttccaggacggcaactactgcggcgagaccagcctgctgctgaaggtggccgagaagctgctggccgtgctgagcagcctgaaggtgaacggccccagccagcccatcctggtgagagtgggcgaggacatccagctgacctgctacctgagccccaaggccaacgcccagagcatggaggtgagatgggacagaagccacagataccccgccgtgcacgtgtacatggacggcgaccacgtggccggcgagcagatggccgagtacagaggcagaaccgtgctggtgagcgacgccatcgacgagggcagactgaccctgcagatcctgagcgccagacccagcgacgacggccagtacagatgcctgttcgagaaggacgacgtgtaccaggaggccagcctggacctgaaggtggtgagcctgggcagcagccccctgatcaccgtggagggccaggaggacggcgagatgcagcccatgtgcagcagcgacggctggttcccccagccccacgtgccctggagagacatggagggcaagaccatccccagcagcagccaggccctgacccagggcagccacggcctgttccacgtgcagaccctgctgagagtgaccaacatcagcgccgtggacgtgacctgcagcatcagcatccccttcctgggcgaggagaagatcgccaccttcagcctgagcgagagcagaatgaccttcctgtggaagaccctgctggtgtggggcctgctgctggccgtggccgtgggcctgcccagaaagagaagctag

SEQ ID NO: 74742 - DNA, 738 bp, Artificial Sequence
  Description of Artificial Sequence: Synthetic coding sequence
atggtggacttccccggctacaacctgagcggcgccgtggccagcttcctgttcatcctgctgaccatgaagcagagcgagaagctgcagaccgagctggccagcctgaaggtgaacggccccagccagcccatcctggtgagagtgggcgaggacatccagctgacctgctacctgagccccaaggccaacgcccagagcatggaggtgagatgggacagaagccacagataccccgccgtgcacgtgtacatggacggcgaccacgtggccggcgagcagatggccgagtacagaggcagaaccgtgctggtgagcgacgccatcgacgagggcagactgaccctgcagatcctgagcgccagacccagcgacgacggccagtacagatgcctgttcgagaaggacgacgtgtaccaggaggccagcctggacctgaaggtggtgagcctgggcagcagccccctgatcaccgtggagggccaggaggacggcgagatgcagcccatgtgcagcagcgacggctggttcccccagccccacgtgccctggagagacatggagggcaagaccatccccagcagcagccaggccctgacccagggcagccacggcctgttccacgtgcagaccctgctgagagtgaccaacatcagcgccgtggacgtgacctgcagcatcagcatccccttcctgggcgaggagaagatcgccaccttcagcctgagcggctggtag

SEQ ID NO: 74743 - DNA, 327 bp, Artificial Sequence
  Description of Artificial Sequence: Synthetic coding sequence
atggtggacttccccggctacaacctgagcggcgccgtggccagcttcctgttcatcctgctgaccatgaagcagagcgacttcagagtgatcggccccgcccaccccatcctggccggcgtgggcgaggacgccctgctgacctgccagctgctgcccaagagaaccaccatgcacgtggaggtgagatggtacagaagcgagcccagcacccccgtgttcgtgcacagagacggcgtggaggtgaccgagatgcagatggaggagtacagaggctgggtggagtggatcgagaacggcatcgccaagggcaacgtggccctgtag

SEQ ID NO: 74744 - DNA, 780 bp, Artificial Sequence
  Description of Artificial Sequence: Synthetic coding sequence
atggtggacttccccggctacaacctgagcggcgccgtggccagcttcctgttcatcctgctgaccatgaagcagagcgaggacttcagagtgatcggccccgcccaccccatcctggccggcgtgggcgaggacgccctgctgacctgccagctgctgcccaagagaaccaccatgcacgtggaggtgagatggtacagaagcgagcccagcacccccgtgttcgtgcacagagacggcgtggaggtgaccgagatgcagatggaggagtacagaggctgggtggagtggatcgagaacggcatcgccaagggcaacgtggccctgaagatccacaacatccagcccagcgacaacggccagtactggtgccacttccaggacggcaactactgcggcgagaccagcctgctgctgaaggtggccggcctgggcagcgcccccagcatccacatggagggccccggcgagagcggcgtgcagctggtgtgcaccgccagaggctggttccccgagccccaggtgtactgggaggacatcagaggcgagaagctgctggccgtgagcgagcacagaatccaggacgaggacggcctgttctacgccgaggccaccctggtggtgagaaacgccagcgccgagagcgtgagctgcctggtgcacaaccccgtgctgaccgaggagaagggcagcgtgatcagcctgcccgagaagctgcagaccgagctgggcaagtacgaggtgctggcccacacctgcggcggcagcctgtgcccctag

SEQ ID NO: 74745 - DNA, 780 bp, Artificial Sequence
  Description of Artificial Sequence: Synthetic coding sequence
atggtggacttccccggctacaacctgagcggcgccgtggccagcttcctgttcatcctgctgaccatgaagcagagcgaggacttcagagtgatcggccccgcccaccccatcctggccggcgtgggcgaggacgccctgctgacctgccagctgctgcccaagagaaccaccatgcacgtggaggtgagatggtacagaagcgagcccagcacccccgtgttcgtgcacagagacggcgtggaggtgaccgagatgcagatggaggagtacagaggctgggtggagtggatcgagaacggcatcgccaagggcaacgtggccctgaagatccacaacatccagcccagcgacaacggccagtactggtgccacttccaggacggcaactactgcggcgagaccagcctgctgctgaaggtggccggcctgggcagcgcccccagcatccacatggagggccccggcgagagcggcgtgcagctggtgtgcaccgccagaggctggttccccgagccccaggtgtactgggaggacatcagaggcgagaagctgctggccgtgagcgagcacagaatccaggacaaggacggcctgttctacgccgaggccaccctggtggtgagaaacgccagcgccgagagcgtgagctgcctggtgcacaaccccgtgctgaccgaggagaagggcagcgtgatcagcctgcccgagaagctgcagaccgagctgggcaagtacgaggtgctggcccacacctgcggcggcagcctgtgcccctag

SEQ ID NO: 74746 - DNA, 636 bp, Artificial Sequence
  Description of Artificial Sequence: Synthetic coding sequence
aaggccaacgcccagagcatggaggtgagatgggacagaagccacagataccccgccgtgcacgtgtacatggacggcgaccacgtggccggcgagcagatggccgagtacagaggcagaaccgtgctggtgagcgacgccatcgacgagggcagactgaccctgcagatcctgagcgccagacccagcgacgacggccagtacagatgcctgttcgagaaggacgacgtgtaccaggaggccagcctggacctgaaggtggtgagcctgggcagcagccccctgatcaccgtggagggccaggaggacggcgagatgcagcccatgtgcagcagcgacggctggttcccccagccccacgtgccctggagagacatggagggcaagaccatccccagcagcagccaggccctgacccagggcagccacggcctgttccacgtgcagaccctgctgagagtgaccaacatcagcgccgtggacgtgacctgcagcatcagcatccccttcctgggcgaggagaagatcgccaccttcagcctgagcgagagcagaatgaccttcctgtggaagaccctgctggtgtggggcctgctgctggccgtggccgtgggcctgcccagaaagagaagctag

SEQ ID NO: 74747 - DNA, 780 bp, Artificial Sequence; identical to SEQ ID NO: 74745
  Description of Artificial Sequence: Synthetic coding sequence

SEQ ID NO: 74748 - DNA, 327 bp, Artificial Sequence; identical to SEQ ID NO: 74743
  Description of Artificial Sequence: Synthetic coding sequence

SEQ ID NO: 74749 - DNA, 327 bp, Artificial Sequence; identical to SEQ ID NO: 74743
  Description of Artificial Sequence: Synthetic coding sequence

SEQ ID NO: 74750 - DNA, 636 bp, Artificial Sequence
  Description of Artificial Sequence: Synthetic coding sequence
aaggccaacgcccagagcatggaggtgagatgggacagaagccacagataccccgccgtgcacgtgtacatggacggcgaccacgtggccggcgagcagatggccgagtacagaggcagaaccgtgctggtgagcgacgccatcgacgagggcagactgaccctgcagatcctgagcgccagacccagcgacgacggccagtacagatgcctgttcgagaaggacgacgtgtaccaggaggccagcctggacctgaaggtggtgggcctgggcagcagccccctgatcaccgtggagggccaggaggacggcgagatgcagcccatgtgcagcagcgacggctggttcccccagccccacgtgccctggagagacatggagggcaagaccatccccagcagcagccaggccctgacccagggcagccacggcctgttccacgtgcagaccctgctgagagtgaccaacatcagcgccgtggacgtgacctgcagcatcagcatccccttcctgggcgaggagaagatcgccaccttcagcctgagcgagagcagaatgaccttcctgtggaagaccctgctggtgtggggcctgctgctggccgtggccgtgggcctgcccagaaagagaagctag

SEQ ID NO: 74751 - DNA, 816 bp, Artificial Sequence
  Description of Artificial Sequence: Synthetic coding sequence
atggtggacttccccggctacaacctgagcggcgccgtggccagcttcctgttcatcctgctgaccatgaagcagagcgaggacttcagagtgatcggccccgcccaccccatcctggccggcgtgggcgaggacgccctgctgacctgccagctgctgcccaagagaaccaccatgcacgtggaggtgagatggtacagaagcgagcccagcacccccgtgttcgtgcacagagacggcgtggaggtgaccgagatgcagatggaggagtacagaggctgggtggagtggatcgagaacggcatcgccaagggcaacgtggccctgaagatccacaacatccagcccagcgacaacggccagtactggtgccacttccaggacggcaactactgcggcgagaccagcctgctgctgaaggtggccgccgtgctgagagacgacatcatcgccagcctgaaggtgaacggccccagccagcccatcctggtgagagtgggcgaggacatccagctgacctgctacctgagccccaaggccaacgcccagagcatggaggtgagatgggacagaagccacagataccccgccgtgcacgtgtacatggacggcgaccacgtggccggcgagcagatggccgagtacagaggcagaaccgtgctggtgagcgacgccatcgacgagggcagactgaccctgcagatcctgagcgccagacccagcgacgacggccagtacagatgcctgttcgagaaggacgacgtgtaccaggaggccagcctggacctgaaggtggtgtgggtgctgccccactag

SEQ ID NO: 74752 - DNA, 327 bp, Artificial Sequence; identical to SEQ ID NO: 74743
  Description of Artificial Sequence: Synthetic coding sequence

SEQ ID NO: 74753 - DNA, 780 bp, Artificial Sequence; identical to SEQ ID NO: 74744
  Description of Artificial Sequence: Synthetic coding sequence

SEQ ID NO: 74754 - DNA, 327 bp, Artificial Sequence; identical to SEQ ID NO: 74743
  Description of Artificial Sequence: Synthetic coding sequence

SEQ ID NO: 74755 - DNA, 636 bp, Artificial Sequence; identical to SEQ ID NO: 74750
  Description of Artificial Sequence: Synthetic coding sequence

SEQ ID NO: 74756 - DNA, 780 bp, Artificial Sequence; identical to SEQ ID NO: 74744
  Description of Artificial Sequence: Synthetic coding sequence

SEQ ID NO: 74757 - DNA, 780 bp, Artificial Sequence; identical to SEQ ID NO: 74745
  Description of Artificial Sequence: Synthetic coding sequence

SEQ ID NO: 74758 - DNA, 327 bp, Artificial Sequence; identical to SEQ ID NO: 74743
  Description of Artificial Sequence: Synthetic coding sequence

SEQ ID NO: 74759 - DNA, 780 bp, Artificial Sequence; identical to SEQ ID NO: 74745
  Description of Artificial Sequence: Synthetic coding sequence

SEQ ID NO: 74760 - DNA, 636 bp, Artificial Sequence; identical to SEQ ID NO: 74750
  Description of Artificial Sequence: Synthetic coding sequence

SEQ ID NO: 74761 - DNA, 636 bp, Artificial Sequence; identical to SEQ ID NO: 74746
  Description of Artificial Sequence: Synthetic coding sequence

SEQ ID NO: 74762 - DNA, 636 bp, Artificial Sequence; identical to SEQ ID NO: 74746
  Description of Artificial Sequence: Synthetic coding sequence

SEQ ID NO: 74763 - DNA, 327 bp, Artificial Sequence; identical to SEQ ID NO: 74743
  Description of Artificial Sequence: Synthetic coding sequence

SEQ ID NO: 74764 - DNA, 636 bp, Artificial Sequence; identical to SEQ ID NO: 74746
  Description of Artificial Sequence: Synthetic coding sequence

SEQ ID NO: 74765 - DNA, 1449 bp, Artificial Sequence
  Description of Artificial Sequence: Synthetic coding sequence
atggtggacttccccggctacaacctgagcggcgccgtggccagcttcctgttcatcctgctgaccatgaagcagagcgaggacttcagagtgatcggccccgcccaccccatcctggccggcgtgggcgaggacgccctgctgacctgccagctgctgcccaagagaaccaccatgcacgtggaggtgagatggtacagaagcgagcccagcacccccgtgttcgtgcacagagacggcgtggaggtgaccgagatgcagatggaggagtacagaggctgggtggagtggatcgagaacggcatcgccaagggcaacgtggccctgaagatccacaacatccagcccagcgacaacggccagtactggtgccacttccaggacggcaactactgcggcgagaccagcctgctgctgaaggtggccggcctgggcagcgcccccagcatccacatggagggccccggcgagagcggcgtgcagctggtgtgcaccgccagaggctggttccccgagccccaggtgtactgggaggacatcagaggcgagaagctgctggccgtgagcgagcacagaatccaggacaaggacggcctgttctacgccgaggccaccctggtggtgagaaacgccagcgccgagagcgtgagctgcctggtgcacaaccccgtgctgaccgaggagaagggcagcgtgatcagcctgcccgagaagctgcagaccgagctggccagcctgaaggtgaacggccccagccagcccatcctggtgagagtgggcgaggacatccagctgacctgctacctgagccccaaggccaacgcccagagcatggaggtgagatgggacagaagccacagataccccgccgtgcacgtgtacatggacggcgaccacgtggccggcgagcagatggccgagtacagaggcagaaccgtgctggtgagcgacgccatcgacgagggcagactgaccctgcagatcctgagcgccagacccagcgacgacggccagtacagatgcctgttcgagaaggacgacgtgtaccaggaggccagcctggacctgaaggtggtgagcctgggcagcagccccctgatcaccgtggagggccaggaggacggcgagatgcagcccatgtgcagcagcgacggctggttcccccagccccacgtgccctggagagacatggagggcaagaccatccccagcagcagccaggccctgacccagggcagccacggcctgttccacgtgcagaccctgctgagagtgaccaacatcagcgccgtggacgtgacctgcagcatcagcatccccttcctgggcgaggagaagatcgccaccttcagcctgagcgagagcagaatgaccttcctgtggaagaccctgctggtgtggggcctgctgctggccgtggccgtgggcctgcccagaaagagaagctag

SEQ ID NO: 74766 - DNA, 738 bp, Artificial Sequence
  Description of Artificial Sequence: Synthetic coding sequence
atggtggacttccccggctacaacctgagcggcgccgtggccagcttcctgttcatcctgctgaccatgaagcagagcgacagactggacacccccaaggccagcctgaaggtgaacggccccagccagcccatcctggtgagagtgggcgaggacatccagctgacctgctacctgagccccaaggccaacgcccagagcatggaggtgagatgggacagaagccacagataccccgccgtgcacgtgtacatggacggcgaccacgtggccggcgagcagatggccgagtacagaggcagaaccgtgctggtgagcgacgccatcgacgagggcagactgaccctgcagatcctgagcgccagacccagcgacgacggccagtacagatgcctgttcgagaaggacgacgtgtaccaggaggccagcctggacctgaaggtggtgagcctgggcagcagccccctgatcaccgtggagggccaggaggacggcgagatgcagcccatgtgcagcagcgacggctggttcccccagccccacgtgccctggagagacatggagggcaagaccatccccagcagcagccaggccctgacccagggcagccacggcctgttccacgtgcagaccctgctgagagtgaccaacatcagcgccgtggacgtgacctgcagcatcagcatccccttcctgggcgaggagaagatcgccaccttcagcctgagcggctggtag

SEQ ID NO: 74767 - DNA, 537 bp, Artificial Sequence
  Description of Artificial Sequence: Synthetic coding sequence
atggaggtgagatgggacagaagccacagataccccgccgtgcacgtgtacatggacggcgaccacgtggccggcgagcagatggccgagtacagaggcagaaccgtgctggtgagcgacgccatcgacgagggcagactgaccctgcagatcctgagcgccagacccagcgacgacggccagtacagatgcctgttcgagaaggacgacgtgtaccaggaggccagcctggacctgaaggtggtgagcctgggcagcagccccctgatcaccgtggagggccaggaggacggcgagatgcagcccatgtgcagcagcgacggctggttcccccagccccacgtgccctggagagacatggagggcaagaccatccccagcagcagccaggccctgacccagggcagccacggcctgttccacgtgcagaccctgctgagagtgaccaacatcagcgccgtggacgtgacctgcagcatcagcatccccttcctgggcgaggagaagatcgccaccttcagcctgagcggctggtag

SEQ ID NO: 74768 - DNA, 1167 bp, Artificial Sequence; identical to SEQ ID NO: 74741
  Description of Artificial Sequence: Synthetic coding sequence

SEQ ID NO: 74769 - DNA, 1167 bp, Artificial Sequence
  Description of Artificial Sequence: Synthetic coding sequence
atggtggacttccccggctacaacctgagcggcgccgtggccagcttcctgttcatcctgctgaccatgaagcagagcgaggacttcagagtgatcggccccgcccaccccatcctggccggcgtgggcgaggacgccctgctgacctgccagctgctgcccaagagaaccaccatgcacgtggaggtgagatggtacagaagcgagcccagcacccccgtgttcgtgcacagagacggcgtggaggtgaccgagatgcagatggaggagtacagaggctgggtggagtggatcgagaacggcatcgccaagggcaacgtggccctgaagatccacaacatccagcccagcgacaacggccagtactggtgccacttccaggacggcaactactgcggcgagaccagcctgctgctgaaggtggccgagaagctgctggccgtgctgagcagcctgaaggtgaacggccccagccagcccatcctggtgagagtgggcgaggacatccagctgacctgctacctgagccccaaggccaacgcccagagcatggaggtgagatgggacagaagccacagataccccgccgtgcacgtgtacatggacggcgaccacgtggccggcgagcagatggccgagtacagaggcagaaccgtgctggtgagcgacgccatcgacgagggcagactgaccctgcagatcctgagcgccagacccagcgacgacggccagtacagatgcctgttcgagaaggacgacgtgtaccaggaggccagcctggacctgaaggtggtgggcctgggcagcagccccctgatcaccgtggagggccaggaggacggcgagatgcagcccatgtgcagcagcgacggctggttcccccagccccacgtgccctggagagacatggagggcaagaccatccccagcagcagccaggccctgacccagggcagccacggcctgttccacgtgcagaccctgctgagagtgaccaacatcagcgccgtggacgtgacctgcagcatcagcatccccttcctgggcgaggagaagatcgccaccttcagcctgagcgagagcagaatgaccttcctgtggaagaccctgctggtgtggggcctgctgctggccgtggccgtgggcctgcccagaaagagaagctag

SEQ ID NO: 74770 - DNA, 1167 bp, Artificial Sequence; identical to SEQ ID NO: 74741
  Description of Artificial Sequence: Synthetic coding sequence

SEQ ID NO: 74771 - DNA, 738 bp, Artificial Sequence
  Description of Artificial Sequence: Synthetic coding sequence
atggtggacttccccggctacaacctgagcggcgccgtggccagcttcctgttcatcctgctgaccatgaagcagagcgacagactggacacccccaaggccagcctgaaggtgaacggccccagccagcccatcctggtgagagtgggcgaggacatccagctgacctgctacctgagccccaaggccaacgcccagagcatggaggtgagatgggacagaagccacagataccccgccgtgcacgtgtacatggacggcgaccacgtggccggcgagcagatggccgagtacagaggcagaaccgtgctggtgagcgacgccatcgacgagggcagactgaccctgcagatcctgagcgccagacccagcgacgacggccagtacagatgcctgttcgagaaggacgacgtgtaccaggaggccagcctggacctgaaggtggtgggcctgggcagcagccccctgatcaccgtggagggccaggaggacggcgagatgcagcccatgtgcagcagcgacggctggttcccccagccccacgtgccctggagagacatggagggcaagaccatccccagcagcagccaggccctgacccagggcagccacggcctgttccacgtgcagaccctgctgagagtgaccaacatcagcgccgtggacgtgacctgcagcatcagcatccccttcctgggcgaggagaagatcgccaccttcagcctgagcggctggtag

SEQ ID NO: 74772 - DNA, 738 bp, Artificial Sequence; identical to SEQ ID NO: 74766
  Description of Artificial Sequence: Synthetic coding sequence

SEQ ID NO: 74773 - DNA, 1167 bp, Artificial Sequence; identical to SEQ ID NO: 74741
  Description of Artificial Sequence: Synthetic coding sequence

SEQ ID NO: 74774 - DNA, 816 bp, Artificial Sequence; identical to SEQ ID NO: 74751
  Description of Artificial Sequence: Synthetic coding sequence

SEQ ID NO: 74775 - DNA, 738 bp, Artificial Sequence
  Description of Artificial Sequence: Synthetic coding sequence
atggtggacttccccggctacaacctgagcggcgccgtggccagcttcctgttcatcctgctgaccatgaagcagagcgagaagctgcagaccgagctggccagcctgaaggtgaacggccccagccagcccatcctggtgagagtgggcgaggacatccagctgacctgctacctgagccccaaggccaacgcccagagcatggaggtgagatgggacagaagccacagataccccgccgtgcacgtgtacatggacggcgaccacgtggccggcgagcagatggccgagtacagaggcagaaccgtgctggtgagcgacgccatcgacgagggcagactgaccctgcagatcctgagcgccagacccagcgacgacggccagtacagatgcctgttcgagaaggacgacgtgtaccaggaggccagcctggacctgaaggtggtgggcctgggcagcagccccctgatcaccgtggagggccaggaggacggcgagatgcagcccatgtgcagcagcgacggctggttcccccagccccacgtgccctggagagacatggagggcaagaccatccccagcagcagccaggccctgacccagggcagccacggcctgttccacgtgcagaccctgctgagagtgaccaacatcagcgccgtggacgtgacctgcagcatcagcatccccttcctgggcgaggagaagatcgccaccttcagcctgagcggctggtag

SEQ ID NO: 74776 - DNA, 537 bp, Artificial Sequence
  Description of Artificial Sequence: Synthetic coding sequence
atggaggtgagatgggacagaagccacagataccccgccgtgcacgtgtacatggacggcgaccacgtggccggcgagcagatggccgagtacagaggcagaaccgtgctggtgagcgacgccatcgacgagggcagactgaccctgcagatcctgagcgccagacccagcgacgacggccagtacagatgcctgttcgagaaggacgacgtgtaccaggaggccagcctggacctgaaggtggtgggcctgggcagcagccccctgatcaccgtggagggccaggaggacggcgagatgcagcccatgtgcagcagcgacggctggttcccccagccccacgtgccctggagagacatggagggcaagaccatccccagcagcagccaggccctgacccagggcagccacggcctgttccacgtgcagaccctgctgagagtgaccaacatcagcgccgtggacgtgacctgcagcatcagcatccccttcctgggcgaggagaagatcgccaccttcagcctgagcggctggtag

SEQ ID NO: 74777 - DNA, 738 bp, Artificial Sequence; identical to SEQ ID NO: 74766
  Description of Artificial Sequence: Synthetic coding sequence

SEQ ID NO: 74778 - DNA, 1368 bp, Artificial Sequence
  Description of Artificial Sequence: Synthetic coding sequence
atggtggacttccccggctacaacctgagcggcgccgtggccagcttcctgttcatcctgctgaccatgaagcagagcgaggacttcagagtgatcggccccgcccaccccatcctggccggcgtgggcgaggacgccctgctgacctgccagctgctgcccaagagaaccaccatgcacgtggaggtgagatggtacagaagcgagcccagcacccccgtgttcgtgcacagagacggcgtggaggtgaccgagatgcagatggaggagtacagaggctgggtggagtggatcgagaacggcatcgccaagggcaacgtggccctgaagatccacaacatccagcccagcgacaacggccagtactggtgccacttccaggacggcaactactgcggcgagaccagcctgctgctgaaggtggccggcctgggcagcgcccccagcatccacatggagggccccggcgagagcggcgtgcagctggtgtgcaccgccagaggctggttccccgagccccaggtgtactgggaggacatcagaggcgagaagctgctggccgtgagcgagcacagaatccaggacgaggacggcctgttctacgccgaggccaccctggtggtgagaaacgccagcgccgagagcgtgagctgcctggtgcacaaccccgtgctgaccgaggagaagggcagcgtgatcagcctgcccgagaagctgcagaccgagctggccagcctgaaggtgaacggccccagccagcccatcctggtgagagtgggcgaggacatccagctgacctgctacctgagccccaaggccaacgcccagagcatggaggtgagatgggacagaagccacagataccccgccgtgcacgtgtacatggacggcgaccacgtggccggcgagcagatggccgagtacagaggcagaaccgtgctggtgagcgacgccatcgacgagggcagactgaccctgcagatcctgagcgccagacccagcgacgacggccagtacagatgcctgttcgagaaggacgacgtgtaccaggaggccagcctggacctgaaggtggtgggcctgggcagcagccccctgatcaccgtggagggccaggaggacggcgagatgcagcccatgtgcagcagcgacggctggttcccccagccccacgtgccctggagagacatggagggcaagaccatccccagcagcagccaggccctgacccagggcagccacggcctgttccacgtgcagaccctgctgagagtgaccaacatcagcgccgtggacgtgacctgcagcatcagcatccccttcctgggcgaggagaagatcgccaccttcagcctgagcggctggtag

SEQ ID NO: 74779 - DNA, 816 bp, Artificial Sequence; identical to SEQ ID NO: 74751
  Description of Artificial Sequence: Synthetic coding sequence

SEQ ID NO: 74780 - DNA, 816 bp, Artificial Sequence; identical to SEQ ID NO: 74751
  Description of Artificial Sequence: Synthetic coding sequence

SEQ ID NO: 74781 - DNA, 738 bp, Artificial Sequence; identical to SEQ ID NO: 74766
  Description of Artificial Sequence: Synthetic coding sequence

SEQ ID NO: 74782 - DNA, 816 bp, Artificial Sequence; identical to SEQ ID NO: 74751
  Description of Artificial Sequence: Synthetic coding sequence

SEQ ID NO: 74783 - DNA, 738 bp, Artificial Sequence; identical to SEQ ID NO: 74771
  Description of Artificial Sequence: Synthetic coding sequence

SEQ ID NO: 74784 - DNA, 738 bp, Artificial Sequence; identical to SEQ ID NO: 74766
  Description of Artificial Sequence: Synthetic coding sequence

SEQ ID NO: 74785 - DNA, 1368 bp, Artificial Sequence; identical to SEQ ID NO: 74740
  Description of Artificial Sequence: Synthetic coding sequence

SEQ ID NO: 74786 - DNA, 1368 bp, Artificial Sequence; identical to SEQ ID NO: 74740
  Description of Artificial Sequence: Synthetic coding sequence

SEQ ID NO: 74787 - DNA, 537 bp, Artificial Sequence; identical to SEQ ID NO: 74767
  Description of Artificial Sequence: Synthetic coding sequence

SEQ ID NO: 74788 - DNA, 1368 bp, Artificial Sequence; identical to SEQ ID NO: 74740
  Description of Artificial Sequence: Synthetic coding sequence

SEQ ID NO: 74789 - DNA, 816 bp, Artificial Sequence; identical to SEQ ID NO: 74751
  Description of Artificial Sequence: Synthetic coding sequence

SEQ ID NO: 74790 - DNA, 1368 bp, Artificial Sequence; identical to SEQ ID NO: 74778
  Description of Artificial Sequence: Synthetic coding sequence

SEQ ID NO: 74791 - DNA, 1368 bp, Artificial Sequence; identical to SEQ ID NO: 74778
  Description of Artificial Sequence: Synthetic coding sequence

SEQ ID NO: 74792 - DNA, 816 bp, Artificial Sequence; identical to SEQ ID NO: 74751
  Description of Artificial Sequence: Synthetic coding sequence

SEQ ID NO: 74793 - DNA, 537 bp, Artificial Sequence; identical to SEQ ID NO: 74776
  Description of Artificial Sequence: Synthetic coding sequence

SEQ ID NO: 74794 - DNA, 738 bp, Artificial Sequence; identical to SEQ ID NO: 74775
  Description of Artificial Sequence: Synthetic coding sequence

SEQ ID NO: 74795 - DNA, 738 bp, Artificial Sequence; identical to SEQ ID NO: 74742
  Description of Artificial Sequence: Synthetic coding sequence

SEQ ID NO: 74796 - DNA, 1167 bp, Artificial Sequence; identical to SEQ ID NO: 74741
  Description of Artificial Sequence: Synthetic coding sequence

SEQ ID NO: 74797 - DNA, 1368 bp, Artificial Sequence; identical to SEQ ID NO: 74740
  Description of Artificial Sequence: Synthetic coding sequence

SEQ ID NO: 74798 - DNA, 1167 bp, Artificial Sequence; identical to SEQ ID NO: 74769
  Description of Artificial Sequence: Synthetic coding sequence

SEQ ID NO: 74799 - DNA, 738 bp, Artificial Sequence; identical to SEQ ID NO: 74771
  Description of Artificial Sequence: Synthetic coding sequence

SEQ ID NO: 74800 - DNA, 816 bp, Artificial Sequence; identical to SEQ ID NO: 74751
  Description of Artificial Sequence: Synthetic coding sequence

SEQ ID NO: 74801 - DNA, 1167 bp, Artificial Sequence; identical to SEQ ID NO: 74769
  Description of Artificial Sequence: Synthetic coding sequence

SEQ ID NO: 74802 - DNA, 1401 bp, Artificial Sequence
  Description of Artificial Sequence: Synthetic coding sequence
atggccttcgtgctgatcctggtgctgagcttctacgagctggtgagcggccagtggcaggtgaccggccccggcaagttcgtgcaggccctggtgggcgaggacgccgtgttcagctgcagcctgttccccgagaccagcgccgaggccatggaggtgagattcttcagaaaccagttccacgccgtggtgcacctgtacagagacggcgaggactgggagagcaagcagatgccccagtacagaggcagaaccgagttcgtgaaggacagcatcgccggcggcagagtgagcctgagactgaagaacatcacccccagcgacatcggcctgtacggctgctggttcagcagccagatctacgacgaggaggccacctgggagctgagagtggccgccctgggcagcctgcccctgatcagcatcgtgggctacgtggacggcggcatccagctgctgtgcctgagcagcggctggttcccccagcccaccgccaagtggaagggcccccagggccaggacctgagcagcgacagcagagccaacgccgacggctacagcctgtacgacgtggagatcagcatcatcgtgcaggagaacgccggcagcatcctgtgcagcatccacctggccgagcagagccacgaggtggagagcaaggtgctgatcggcgagaccttcttccagcccagcccctggagactggccagcatcctgctgggcctgctgtgcggcgccctgtgcggcgtggtgatgggcatgatcatcgtgttcttcaagagcaagggcaagatccaggccgagctggactggagaagaaagcacggccaggccgagctgagagacgccagaaagcacgccgtggaggtgaccctggaccccgagaccgcccaccccaagctgtgcgtgagcgacctgaagaccgtgacccacagaaaggccccccaggaggtgccccacagcgagaagagattcaccagaaagagcgtggtggccagccagggcttccaggccggcaagcactactgggaggtggacgtgggccagaacgtgggctggtacgtgggcgtgtgcagagacgacgtggacagaggcaagaacaacgtgaccctgagccccaacaacggctactgggtgctgagactgaccaccgagcacctgtacttcaccttcaacccccacttcatcagcctgccccccagcaccccccccaccagagtgggcgtgttcctggactacgagggcggcaccatcagcttcttcaacaccaacgaccagagcctgatctacaccctgctgacctgccagttcgagggcctgctgagaccctacatccagcacgccatgtacgacgaggagaagggcacccccatcttcatctgccccgtgagctggggctag

SEQ ID NO: 74803 - DNA, 1299 bp, Artificial Sequence
  Description of Artificial Sequence: Synthetic coding sequence
atggccttcgtgctgatcctggtgctgagcttctacgagctggtgagcggccagtggcaggtgaccggccccggcaagttcgtgcaggccctggtgggcgaggacgccgtgttcagctgcagcctgttccccgagaccagcgccgaggccatggaggtgagattcttcagaaaccagttccacgccgtggtgcacctgtacagagacggcgaggactgggagagcaagcagatgccccagtacagaggcagaaccgagttcgtgaaggacagcatcgccggcggcagagtgagcctgagactgaagaacatcacccccagcgacatcggcctgtacggctgctggttcagcagccagatctacgacgaggaggccacctgggagctgagagtggccgccctgggcagcctgcccctgatcagcatcgtgggctacgtggacggcggcatccagctgctgtgcctgagcagcgtgcagcccagcccctggagactggccagcatcctgctgggcctgctgtgcggcgccctgtgcggcgtggtgatgggcatgatcatcgtgttcttcaagagcaagggcaagatccaggccgagctgggcatgtgccacgtgctgagcctgccccacatggtgctgcccggccccagcctgatccacagcctgagcctgtggaccaccctggccgccggctggaccggcagcaccgactggagaagaaagcacggccaggccgagctgagagacgccagaaagcacgccgtggaggtgaccctggaccccgagaccgcccaccccaagctgtgcgtgagcgacctgaagaccgtgacccacagaaaggccccccaggaggtgccccacagcgagaagagattcaccagaaagagcgtggtggccagccagggcttccaggccggcaagcactactgggaggtggacgtgggccagaacgtgggctggtacgtgggcgtgtgcagagacgacgtggacagaggcaagaacaacgtgaccctgagccccaacaacggctactgggtgctgagactgaccaccgagcacctgtacttcaccttcaacccccacttcatcagcctgccccccagcaccccccccaccagagtgggcgtgttcctggactacgagggcggcaccatcagcttcttcaacaccaacgaccagagcctgatctacaccctgctgacctgccagttcgagggcctgctgagaccctacatccagcacgccatgtacgacgaggagaagggcacccccatcttcatctgccccgtgagctggggctag

SEQ ID NO: 74804 - DNA, 1809 bp, Artificial Sequence
  Description of Artificial Sequence: Synthetic coding sequence
atgcacagcaaggtgaccatcatctgcatcagattcctgttctggttcctgctgctgtgcatgctgatcggcaagagccacaccgaggacgacatcatcatcgccaccaagaacggcaaggtgagaggcatgaacctgaccgtgttcggcggcaccgtgaccgccttcctgggcatcccctacgcccagccccccctgggcagactgagattcaagaagccccagagcctgaccaagtggagcgacatctggaacgccaccaagtacgccaacagctgctgccagaacatcgaccagagcttccccggcttccacggcagcgagatgtggaaccccaacaccgacctgagcgaggactgcctgtacctgaacgtgtggatccccgcccccaagcccaagaacgccaccgtgctgatctggatctacggcggcggcttccagaccggcaccagcagcctgcacgtgtacgacggcaagttcctggccagagtggagagagtgatcgtggtgagcatgaactacagagtgggcgccctgggcttcctggccctgcccggcaaccccgaggcccccggcaacatgggcctgttcgaccagcagctggccctgcagtgggtgcagaagaacatcgccgccttcggcggcaaccccaagagcgtgaccctgttcggcgagagcgccggcgccgccagcgtgagcctgcacctgctgagccccggcagccacagcctgttcaccagagccatcctgcagagcggcagcttcaacgccccctgggccgtgaccagcctgtacgaggccagaaacagaaccctgaacctggccaagctgaccggctgcagcagagagaacgagaccgagatcatcaagtgcctgagaaacaaggacccccaggagatcctgctgaacgaggccttcgtggtgccctacggcacccccctgagcgtgaacttcggccccaccgtggacggcgacttcctgaccgacatgcccgacatcctgctggagctgggccagttcaagaagacccagatcctggtgggcgtgaacaaggacgagggcaccgccttcctggtgtacggcgcccccggcttcagcaaggacaacaacagcatcatcaccagaaaggagttccaggagggcctgaagatcttcttccccggcgtgagcgagttcggcaaggagagcatcctgttccactacaccgactgggtggacgaccagagacccgagaactacagagaggccctgggcgacgtggtgggcgactacaacttcatctgccccgccctggagttcaccaagaagttcagcgagtggggcaacaacgccttcttctactacttcgagcacagaagcagcaagctgccctggcccgagtggatgggcgtgatgcacggctacgagatcgagttcgtgttcggcctgcccctggagagaagagacaactacaccaaggccgaggagatcctgagcagaagcatcgtgaagagatgggccaacttcgccaagtacggcaaccccaacgagacccagaacaacagcaccagctggcccgtgttcaagagcaccgagcagaagtacctgaccctgaacaccgagagcaccagaatcatgaccaagctgagagcccagcagtgcagattctggaccagcttcttccccaaggtgctggagatgaccggcaacatcgacgaggccgagtgggagtggaaggccggcttccacagatggaacaactacatgatggactggaagaaccagttcaacgactacaccagcaagaaggagagctgcgtgggcctgtag

SEQ ID NO: 74805 - DNA, 399 bp, Artificial Sequence
  Description of Artificial Sequence: Synthetic coding sequence
gccgtgcagttcaccggctggagcagcagctgcatcctgcacttccccgaggtgctgcacgacttccacagcctgcagaccctgcccagcctgctgcagagaatcggcaaccccaacgagacccagaacaacagcaccagctggcccgtgttcaagagcaccgagcagaagtacctgaccctgaacaccgagagcaccagaatcatgaccaagctgagagcccagcagtgcagattctggaccagcttcttccccaaggtgctggagatgaccggcaacatcgacgaggccgagtgggagtggaaggccggcttccacagatggaacaactacatgatggactggaagaaccagttcaacgactacaccagcaagaaggagagctgcgtgggcctgtag

SEQ ID NO: 74806 - DNA, 195 bp, Artificial Sequence
  Description of Artificial Sequence: Synthetic coding sequence
atgaccaagctgagagcccagcagtgcagattctggaccagcttcttccccaaggtgctggagatgaccggcaacatcgacgaggccgagtgggagtggaaggccggcttccacagatggaacaactacatgatggactggaagaaccagttcaacgactacaccagcaagaaggagagctgcgtgggcctgtag

SEQ ID NO: 74807 - DNA, 1431 bp, Artificial Sequence
  Description of Artificial Sequence: Synthetic coding sequence
atggccagcagaatcggcctgagaatgcagctgatgagagagcaggcccagcaggaggagcagagagagagaatgcagcagcaggccgtgatgcactacatgcagcagcagcagcagcagcagcagcagcagctgggcggcccccccacccccgccatcaacacccccgtgcacttccagagccccccccccgtgcccggcgaggtgctgaaggtgcagagctacctggagaaccccaccagctaccacctgcagcagagccagcaccagaaggtgagagagtacctgagcgagacctacggcaacaagttcgccgcccacatcagccccgcccagggcagccccaagcccccccccgccgccagccccggcgtgagagccggccacgtgctgagcagcagcgccggcaacagcgcccccaacagccccatggccatgctgcacatcggcagcaaccccgagagagagctggacgacgtgatcgacaacatcatgagactggacgacgtgctgggctacatcaaccccgagatgcagatgcccaacaccctgcccctgagcagcagccacctgaacgtgtacagcagcgacccccaggtgaccgccagcctggtgggcgtgaccagcagcagctgccccgccgacctgacccagaagagagagctgaccgacgccgagagcagagccctggccaaggagagacagaagaaggacaaccacaacctgatcgagagaagaagaagattcaacatcaacgacagaatcaaggagctgggcatgctgatccccaaggccaacgacctggacgtgagatggaacaagggcaccatcctgaaggccagcgtggactacatcagaagaatgcagaaggacctgcagaagagcagagagctggagaaccacagcagaagactggagatgaccaacaagcagctgtggctgagaatccaggagctggagatgcaggccagagtgcacggcctgcccaccaccagccccagcggcatgaacatggccgagctggcccagcaggtggtgaagcaggagctgcccagcgaggagggccccggcgaggccctgatgctgggcgccgaggtgcccgaccccgagcccctgcccgccctgcccccccaggcccccctgcccctgcccacccagccccccagccccttccaccacctggacttcagccacagcctgagcttcggcggcagagaggacgagggcccccccggctaccccgagcccctggcccccggccacggcagccccttccccagcctgagcaagaaggacctggacctgatgctgctggacgacagcctgctgcccctggccagcgaccccctgctgagcaccatgagccccgaggccagcaaggccagcagcagaagaagcagcttcagcatggaggagggcgacgtgctgtag

SEQ ID NO: 74808 - DNA, 426 bp, Artificial Sequence
  Description of Artificial Sequence: Synthetic coding sequence
atggccggcgaggagatcaacgaggactaccccgtggagatccacgagtacctgagcgccttcgagaacagcatcggcgccgtggacgagatgctgaagaccatgatgagcgtgagcagaaacgagctgctgcagaagctggaccccctggagcaggccaaggtggacctggtgagcgcctacaccctgaacagcatgttctgggtgtacctggccacccagggcgtgaaccccaaggagcaccccgtgaagcaggagctggagagaatcagagtgtacatgaacagagtgaaggagatcaccgacaagaagaaggccggcaagctggacagaggcgccgccagcagattcgtgaagaacgccctgtgggagcccaagagcaagaacgccagcaaggtggccaacaagggcaagagcaagagctag

SEQ ID NO: 74809 - DNA, 543 bp, Artificial Sequence
  Description of Artificial Sequence: Synthetic coding sequence
atgcccagccccagcgtgagcaccagcgccgccagcgtgctggagggcgtgtgcggcagagccagaagcacctacagaacccccgaggagggcgaggagcagagctggagcgccatcatggccggcgaggagatcaacgaggactaccccgtggagatccacgagtacctgagcgccttcgagaacagcatcggcgccgtggacgagatgctgaagaccatgatgagcgtgagcagaaacgagctgctgcagaagctggaccccctggagcaggccaaggtggacctggtgagcgcctacaccctgaacagcatgttctgggtgtacctggccacccagggcgtgaaccccaaggagcaccccgtgaagcaggagctggagagaatcagagtgtacatgaacagagtgaaggagatcaccgacaagaagaaggccggcaagctggacagaggcgccgccagcagattcgtgaagaacgccctgtgggagcccaagagcaagaacgccagcaaggtggccaacaagggcaagagcaagagctag

SEQ ID NO: 74810 - DNA, 426 bp, Artificial Sequence; identical to SEQ ID NO: 74808
  Description of Artificial Sequence: Synthetic coding sequence

SEQ ID NO: 74811 - DNA, 426 bp, Artificial Sequence; identical to SEQ ID NO: 74808
  Description of Artificial Sequence: Synthetic coding sequence

SEQ ID NO: 74812 - DNA, 957 bp, Artificial Sequence
  Description of Artificial Sequence: Synthetic coding sequence
atgctgagcgagagcagcagcttcctgaagggcgtgatgctgggcagcatcttctgcgccctgatcaccatgctgggccacatcagaatcggccacggcaacagaatgcaccaccacgagcaccaccacctgcaggcccccaacaaggaggacatcctgaagatcagcgaggacgagagaatggagctgagcaagagcttcagagtgtactgcatcatcctggtgaagcccaaggacgtgagcctgtgggccgccgtgaaggagacctggaccaagcactgcgacaaggccgagttcttcagcagcgagaacgtgaaggtgttcgagagcatcaacatggacaccaacgacatgtggctgatgatgagaaaggcctacaagtacgccttcgacaagtacagagaccagtacaactggttcttcctggccagacccaccaccttcgccatcatcgagaacctgaagtacttcctgctgaagaaggaccccagccagcccttctacctgggccacaccatcaagagcggcgacctggagtacgtgggcatggagggcggcatcgtgctgagcgtggagagcatgaagagactgaacagcctgctgaacatccccgagaagtgccccgagcagggcggcatgatctggaagatcagcgaggacaagcagctggccgtgtgcctgaagtacgccggcgtgttcgccgagaacgccgaggacgccgacggcaaggacgtgttcaacaccaagagcgtgggcctgagcatcaaggaggccatgacctaccaccccaaccaggtggtggagggctgctgcagcgacatggccgtgaccttcaacggcctgacccccaaccagatgcacgtgatgatgtacggcgtgtacagactgagagccttcggccacatcttcaacgacgccctggtgttcctgccccccaacggcagcgacaacgactag

SEQ ID NO: 74813 - DNA, 957 bp, Artificial Sequence; identical to SEQ ID NO: 74812
  Description of Artificial Sequence: Synthetic coding sequence

SEQ ID NO: 74814 - DNA, 732 bp, Artificial Sequence
  Description of Artificial Sequence: Synthetic coding sequence
atgagacccctgctggtgctgctgctgctgggcctggccgccggcagcccccccctggacgacaacaagatccccagcctgtgccccggccaccccggcctgcccggcacccccggccaccacggcagccagggcctgcccggcagagacggcagagacggcagagacggcgcccccggcgcccccggcgagaagggcgagggcggcagacccggcctgcccggccccagaggcgaccccggccccagaggcgaggccggccccgccggccccaccggccccgccggcgagtgcagcgtgccccccagaagcgccttcagcgccaagagaagcgagagcagagtgcccccccccagcgacgcccccctgcccttcgacagagtgctggtgaacgagcagggccactacgacgccgtgaccggcaagttcacctgccaggtgcccggcgtgtactacttcgccgtgcacgccaccgtgtacagagccagcctgcagttcgacctggtgaagaacggcgagagcatcgccagcttcttccagttcttcggcggctggcccaagcccgccagcctgagcggcggcgccatggtgagactggagcccgaggaccaggtgtgggtgcaggtgggcgtgggcgactacatcggcatctacgccagcatcaagaccgacagcaccttcagcggcttcctggtgtacagcgactggcacagcagccccgtgttcgcctag

SEQ ID NO: 74815 - DNA, 732 bp, Artificial Sequence; identical to SEQ ID NO: 74814
  Description of Artificial Sequence: Synthetic coding sequence

SEQ ID NO: 74816 - DNA, 759 bp, Artificial Sequence
  Description of Artificial Sequence: Synthetic coding sequence
atggccgcccccgccctgctgctgctggccctgctgctgcccgtgggcgcctggcccggcctgcccagaagaccctgcgtgcactgctgcagacccgcctggccccccggcccctacgccagagtgagcgacagagacctgtggagaggcgacctgtggagaggcctgcccagagtgagacccaccatcgacatcgagatcctgaagggcgagaagggcgaggccggcgtgagaggcagagccggcagaagcggcaaggagggcccccccggcgccagaggcctgcagggcagaagaggccagaagggccaggtgggcccccccggcgccgcctgcagaagagcctacgccgccttcagcgtgggcagaagagagggcctgcacagcagcgaccacttccaggccgtgcccttcgacaccgagctggtgaacctggacggcgccttcgacctggccgccggcagattcctgtgcaccgtgcccggcgtgtacttcctgagcctgaacgtgcacacctggaactacaaggagacctacctgcacatcatgctgaacagaagacccgccgccgtgctgtacgcccagcccagcgagagaagcgtgatgcaggcccagagcctgatgctgctgctggccgccggcgacgccgtgtgggtgagaatgttccagagagacagagacaacgccatctacggcgagcacggcgacctgtacatcaccttcagcggccacctggtgaagcccgccgccgagctgtag

SEQ ID NO: 74817 - DNA, 1002 bp, Artificial Sequence
  Description of Artificial Sequence: Synthetic coding sequence
atgagaatctggtggctgctgctggccatcgagatctgcaccggcaacatcaacagccaggacacctgcagacagggccaccccggcatccccggcaaccccggccacaacggcctgcccggcagagacggcagagacggcgccaagggcgacaagggcgacgccggcgagcccggcagacccggcagccccggcaaggacggcaccagcggcgagaagggcgagagaggcgccgacggcaaggtggaggccaagggcatcaagggcgaccagggcagcagaggcagccccggcaagcacggccccaagggcctggccggccccatgggcgagaagggcctgagaggcgagaccggcccccagggccagaagggcaacaagggcgacgtgggccccaccggccccgagggccccagaggcaacatcggccccctgggccccaccggcctgcccggccccatgggccccatcggcaagcccggccccaagggcgaggccggccccaccggcccccagggcgagcccggcgtgagaggcatcagaggctggaagggcgacagaggcgagaagggcaagatcggcgagaccctggtgctgcccaagagcgccttcaccgtgggcctgaccgtgctgagcaagttccccagcagcgacatgcccatcaagttcgacaagatcctgtacaacgagttcaaccactacgacaccgccgccggcaagttcacctgccacatcgccggcgtgtactacttcacctaccacatcaccgtgttcagcagaaacgtgcaggtgagcctggtgaagaacggcgtgaagatcctgcacaccaaggacgcctacatgagcagcgaggaccaggccagcggcggcatcgtgctgcagctgaagctgggcgacgaggtgtggctgcaggtgaccggcggcgagagattcaacggcctgttcgccgacgaggacgacgacaccaccttcaccggcttcctgctgttcagcagcccctag

SEQ ID NO: 74818 - DNA, 1002 bp, Artificial Sequence; identical to SEQ ID NO: 74817
  Description of Artificial Sequence: Synthetic coding sequence

SEQ ID NO: 74819 - DNA, 300 bp, Artificial Sequence
  Description of Artificial Sequence: Synthetic coding sequence
atgagaatctggtggctgctgctggccatcgagatctgcaccggcaacatcaacagccaggacacctgcagacagggccaccccggcatccccggcaaccccggccacaacggcctgcccggcagagacggcagagacggcgccaagggcgacaagggcgacgccggcgagcccggctgccccggcagccccggcaaggacggcaccagcggcgagaagggcgagagaggcgccgacggcaaggtggaggccaagggcatcaagggcatgttcagatgcctgtggagcaagaccgagtag

SEQ ID NO: 74820 - DNA, 1002 bp, Artificial Sequence
  Description of Artificial Sequence: Synthetic coding sequence
atgagaatctggtggctgctgctggccatcgagatctgcaccggcaacatcaacagccaggacacctgcagacagggccaccccggcatccccggcaaccccggccacaacggcctgcccggcagagacggcagagacggcgccaagggcgacaagggcgacgccggcgagcccggctgccccggcagccccggcaaggacggcaccagcggcgagaagggcgagagaggcgccgacggcaaggtggaggccaagggcatcaagggcgaccagggcagcagaggcagccccggcaagcacggccccaagggcctggccggccccatgggcgagaagggcctgagaggcgagaccggcccccagggccagaagggcaacaagggcgacgtgggccccaccggccccgagggccccagaggcaacatcggccccctgggccccaccggcctgcccggccccatgggccccatcggcaagcccggccccaagggcgaggccggccccaccggcccccagggcgagcccggcgtgagaggcatcagaggctggaagggcgacagaggcgagaagggcaagatcggcgagaccctggtgctgcccaagagcgccttcaccgtgggcctgaccgtgctgagcaagttccccagcagcgacgtgcccatcaagttcgacaagatcctgtacaacgagttcaaccactacgacaccgccgtgggcaagttcacctgccacatcgccggcgtgtactacttcacctaccacatcaccgtgttcagcagaaacgtgcaggtgagcctggtgaagaacggcgtgaagatcctgcacaccagagacgcctacgtgagcagcgaggaccaggccagcggcagcatcgtgctgcagctgaagctgggcgacgagatgtggctgcaggtgaccggcggcgagagattcaacggcctgttcgccgacgaggacgacgacaccaccttcaccggcttcctgctgttcagcagccagtag

SEQ ID NO: 74821 - DNA, 1002 bp, Artificial Sequence; identical to SEQ ID NO: 74820
  Description of Artificial Sequence: Synthetic coding sequence

SEQ ID NO: 74822 - DNA, 150 bp, Artificial Sequence
  Description of Artificial Sequence: Synthetic coding sequence
gtgggccccaccggccccgagggccccagaggcaacatcggccccctgggccccaccggcctgcccggccccatgggccccatcggcaagcccggccccaagggcgaggccggccccaccggcccccaggtgttccccttctgcatctag

SEQ ID NO: 74823 - DNA, 1110 bp, Artificial Sequence
  Description of Artificial Sequence: Synthetic coding sequence
atgtggtgcctggagagactgagactgggccccgagtgcctgagaagaagcggcgactggctgctgcccggcagagccagaggcgccaagagcagaaccaccgccgcctgcgccaacgtgctgacccccgacagaatccccgagttctgcatcccccccagactgatgcccagactggccctggccgccctgagaaacagctgggtggaggaggccggcatggacgagggcgccggcagaaccgactgggaccccagaagccaggccgccctgagcctgccccacctgcccagagtgagaaccgcctacggcttctgcgccctgctggagagcccccacaccagaagaaaggagagcctgctgctgggcggcccccccgcccccagacccagagcccacacctacggcggcggcggcggccccgacgccctgctgggcaccctgagagtgcccagagcccccggccccgccacccccgccgcccccggctgccccagacccccccaggacgccctggccagaagacccagaggctgcagactgctgagagtgcccgacggcctgctgagcagagccctgagagccggcagaagcagaagactgaccagagtgagaagcgtgagcagcggcaacgaggacaaggagagaagagccggcagccagagccccgccagagcccccagcaccagcccccccagcagcagagtgcccttccccgagagactggaggccgagggcaccgtggccctgggcagagccggcgacgccctgagactggccgccgagtactgccccggcaccggcagactgagactgagactgctgagagccgagagccccgccggcggcgcccccggccccagagccgtgagctgcagactgagcctggtgctgagaccccccggcaccgccctgagacagtgcagcaccgtggtgggcagaagcagaaaggccagcttcgaccaggacttctgcttcgacggcctgagcgaggacgaggtgagaagactggccgtgagagtgaaggccagagacgagggcagaggcagagagagaggcagactgctgggccagggcgagctgagcctgggcgccctgctgctgctgtag

SEQ ID NO: 74824 - DNA, 1095 bp, Artificial Sequence
  Description of Artificial Sequence: Synthetic coding sequence
atgagactgctggagaagctgtgcagcagcgccgccggcagcagcgcccccaagcccgccttcgccaaggtgctgacccccaacagaatccccgagttctgcatcccccccagactgcccgccccctgcaccctggagagccccatcagagccgccgccgtgcccagaagatgcgccgccgagagcgacctgtggcccagagccgccgacgaggacgccggcagaaccgactgggaccccagaagccaggccgccctgagcctgccccacctgcccagagtgagaaccacctacggcttctgcgccctgctggagagcccccacaccagaagaaaggagagcctgctgctgggcggcccccccgcccccagacccagagcccacagctgcggcggcggcggcggccccgacgcccccctgggcaccctgtgcggccccagaggccccggccccgccacccccgccgcccccggcggccccagactgccccaggacgccctggccgccggccccagaagatgcagactgctgagagtgcccgacggcctgctgagcagagccctgagagccggcagaagcagaagactggccagagtgagaagcgtgagcagcggcaacgaggacgaggagagaagagccggcagcgagagccccgccagagcccccagcagcagccccctgagcagcagagcccccctgcccgagagactggaggccaagggcaccgtggccctgggcagagccggcgacgccctgagactggccgccgagtactgccccggcaccagaagactgagactgagactgctgagagccgagagcctgttcggcggcgcccccggccccagagccgtgagatgcagactgagcctggtgctgagaccccccggcaccgccagatggcagtgcagcgccgtggtgggcagaagcagaaaggccagcttcgaccaggacttctgcttcgacggcctgagcgaggacgaggtgagaagactggccgtgagagtgaaggccagagacgagggcagaggcagagacagaggcagactgctgggccagggcgagctgagcctgggcgccctgctgctgctgtag

SEQ ID NO: 74825 - DNA, 1266 bp, Artificial Sequence
  Description of Artificial Sequence: Synthetic coding sequence
atgagaaagaccaacatgtggttcctggagagactgagaggcagcggcgagaacggcgccgccagaggcgtgggcagcgaggccggcgacaaggccagcaagggccccctgtacagcaacgtgctgacccccgacaagatccccgacttcttcatcccccccaagctgcccagcggccccgccgagggcgagggccaggccgccctgggccccagcaccagcgagcagaacctggccagcgccgcccccagacagacccccagaagccccagactgcccgccaagctggccgccgagagcaagagcctgctgaaggccgccaccagacacgtgatccagatcgagagcgccgaggactggctgagcgaggaggccaccgacgccgacccccaggcccagggcgccatgagcctgcccagcgtgcccaaggcccagaccagctacggcttcgccatgctggccgagagcccccacaccagaagaaaggagagcctgttccacagcgagcacggcgccctggcccaggtgggcagccccggcgccggcagaagaagagccgccgccaaggccaacggcggcgacggcggccccagagaggccggcggcgccctgatgagccccggcagatacttcagcggcggcgagagcgacaccggcagcagcgccgagagcagccccttcggcagccccctgctgagcagaagcgtgagcctgctgaagggcttcgcccaggacagccaggccaaggtgagccagctgagacacagcgtgggcagacacggcagcctgagcgccgacgacagcacccccgacgccagccccggcagcagaagaagactgaccagaagagccccccccgagcccggccccgagagcggccaggccagaggcgagcacaccgtgcacgtgggccccagaggcagcgtgagactgctggccgagtacgaggccggccaggccagactgagagtgcacctgctggccgccgagggcctgtacgacagactgtgcgacgccagaagcatcaactgctgcgtgggcctgtgcctggtgcccggcaagctgcagaagcagagaagcaccatcgtgaagaacagcagaagacccgtgttcaacgaggacttcttcttcgacggcctgggccccgccagcgtgagaaagctggccctgagaatcaaggtggtgaacaagggcagcagcctgaagagagacaccctgctgggcgagaaggagctgcccctgaccagcctgctgcccttcctgtag

SEQ ID NO: 74826 - DNA, 3945 bp, Artificial Sequence
  Description of Artificial Sequence: Synthetic coding sequence
atgctggaccccagcagcagcgaggaggagagcgacgagatcgtggaggaggagagcggcaaggaggtgctgggcagcgcccccagcggcgccagactgagccccagcagaaccagcgagggcagcgccggcagcgccggcctgggcggcggcggcgccggcgccggcgccggcgtgggcgccggcggcggcggcggcagcggcgccagcagcggcggcggcgccggcggcctgcagcccagcagcagagccggcggcggcagacccagcagccccagccccagcgtggtgagcgagaaggagaaggaggagctggagagactgcagaaggaggaggaggagagaaagaagagactgcagctgtacgtgttcgtgatgagatgcatcgcctaccccttcaacgccaagcagcccaccgacatggccagaagacagcagaagatcagcaagcagcagctgcagaccgtgaaggacagattccaggccttcctgaacggcgagacccagatcatggccgacgaggccttcatgaacgccgtgcagagctactacgaggtgttcctgaagagcgacagagtggccagaatggtgcagagcggcggctgcagcgccaacgacagcagagaggtgttcaagaagcacatcgagaagagagtgagaagcctgcccgagatcgacggcctgagcaaggagaccgtgctgagcagctggatggccaagttcgacgccatctacagaggcgaggaggaccccagaaagcagcaggccagaatgaccgccagcgccgccagcgagctgatcctgagcaaggagcagctgtacgagatgttccagaacatcctgggcatcaagaagttcgagcaccagctgctgtacaacgcctgccagctggacaaccccgacgagcaggccgcccagatcagaagagagctggacggcagactgcagatggccgaccagatcgccagagagagaaagttccccaagttcgtgagcaaggagatggagaacatgtacatcgaggagctgaagagcagcgtgaacctgctgatggccaacctggagagcatgcccgtgagcaagggcggcgagttcaagctgcagaagctgaagagaagccacaacgccagcatcatcgacatgggcgaggagagcgagaaccagctgagcaagagcgacgtggtgctgagcttcagcctggaggtggtgatcatggaggtgcagggcctgaagagcctggcccccaacagaatcgtgtactgcaccatggaggtggagggcggcgagaagctgcagaccgaccaggccgaggccagcaagcccacctggggcacccagggcgacttcagcaccacccacgccctgcccgccgtgaaggtgaagctgttcaccgagagcaccggcgtgctggccctggaggacaaggagctgggcagagtgatcctgcaccccacccccaacagccccaagcagagcgagtggcacaagatgaccgtgagcaagaactgccccgaccaggacctgaagatcaagctggccgtgagaatggacaagccccagaacatgaagcacagcggctacctgtgggccatcggcaagaacgtgtggaagagatggaagaagagattcttcgtgctggtgcaggtgagccagtacaccttcgccatgtgcagctacagagagaagaaggccgagccccaggagctgctgcagctggacggctacaccgtggactacaccgacccccagcccggcctggagggcggcagagccttcttcaacgccgtgaaggagggcgacaccgtgatcttcgccagcgacgacgagcaggacagaatcctgtgggtgcaggccatgtacagagccaccggccagagccacaagcccgtgccccccacccaggtgcagaagctgaacgccaagggcggcaacgtgccccagctggacgcccccatcagccagttctacgccgacagagcccagaagcacggcatggacgagttcatcagcagcaacccctgcaacttcgaccacgccagcctgttcgagatggtgcagagactgaccctggaccacagactgaacgacagctacagctgcctgggctggttcagccccggccaggtgttcgtgctggacgagtactgcgccagaaacggcgtgagaggctgccacagacacctgtgctacctgagagacctgctggagagagccgagaacggcgccatgatcgaccccaccctgctgcactacagcttcgccttctgcgccagccacgtgcacggcaacagacccgacggcatcggcaccgtgaccgtggaggagaaggagagattcgaggagatcaaggagagactgagagtgctgctggagaaccagatcacccacttcagatactgcttccccttcggcagacccgagggcgccctgaaggccaccctgagcctgctggagagagtgctgatgaaggacatcgtgacccccgtgccccaggaggaggtgaagaccgtgatcagaaagtgcctggagcaggccgccctggtgaactacagcagactgagcgagtacgccaagatcgagggcaagaagagagagatgtacgagcaccccgtgttctgcctggccagccaggtgatggacctgaccatccagaacgtgggcagactgatcacccccgccaagaagctggaggacaccatcagactggccgagctggtgatcgaggtgctgcagcagaacgaggagcaccacgccgaggccttcgcctggtggagcgacctgatggtggagcacgccgagaccttcctgagcctgttcgccgtggacatggacgccgccctggaggtgcagccccccgacacctgggacagcttccccctgttccagctgctgaacgacttcctgagaaccgactacaacctgtgcaacggcaagttccacaagcacctgcaggacctgttcgcccccctggtggtgagatacgtggacctgatggagagcagcatcgcccagagcatccacagaggcttcgagagagagagctgggagcccgtgaacaacggcagcggcaccagcgaggacctgttctggaagctggacgccctgcagaccttcatcagagacctgcactggcccgaggaggagttcggcaagcacctggagcagagactgaagctgatggccagcgacatgatcgagagctgcgtgaagagaaccagaatcgccttcgaggtgaagctgcagaagaccagcagaagcaccgacttcagagtgccccagagcatctgcaccatgttcaacgtgatggtggacgccaaggcccagagcaccaagctgtgcagcatggagatgggccaggagcaccagtaccacagcaagatcgacgagctgatcgaggagaccgtgaaggagatgatcaccctgctggtggccaagttcgtgaccatcctggagggcgtgctggccaagctgagcagatacgacgagggcaccctgttcagcagcttcctgagcttcaccgtgaaggccgccagcaagtacgtggacgtgcccaagcccggcatggacgtggccgacgcctacgtgaccttcgtgagacacagccaggacgtgctgagagacaaggtgaacgaggagatgtacatcgagagactgttcgaccagtggtacaacagcagcatgaacgtgatctgcacctggctgaccgacagaatggacctgcagctgcacatctaccagctgaagaccctgatcagaatggtgaagaagacctacagagacttcagactgcagggcgtgctggacagcaccctgaacagcaagacctacgagaccatcagaaacagactgaccgtggaggaggccaccgccagcgtgagcgagggcggcggcctgcagggcatcagcatgaaggacagcgacgaggaggacgaggaggacgactag

SEQ ID NO: 74827 - DNA, 3825 bp, Artificial Sequence
  Description of Artificial Sequence: Synthetic coding sequence
atgctggaccccagcagcagcgaggaggagagcgacgagatcgtggaggaggagagcggcaaggaggtgctgggcagcgcccccagcggcgccagactgagccccagcagaaccagcgagggcagcgccggcagcgccggcctgggcggcggcggcgccggcgccggcgccggcgtgggcgccggcggcggcggcggcagcggcgccagcagcggcggcggcgccggcggcctgcagcccagcagcagagccggcggcggcagacccagcagccccagccccagcgtggtgagcgagaaggagaaggaggagctggagagactgcagaaggaggaggaggagagaaagaagagactgcagctgtacgtgttcgtgatgagatgcatcgcctaccccttcaacgccaagcagcccaccgacatggccagaagacagcagaagatcagcaagcagcagctgcagaccgtgaaggacagattccaggccttcctgaacggcgagacccagatcatggccgacgaggccttcatgaacgccgtgcagagctactacgaggtgttcctgaagagcgacagagtggccagaatggtgcagagcggcggctgcagcgccaacgacagcagagaggtgttcaagaagcacatcgagaagagagtgagaagcctgcccgagatcgacggcctgagcaaggagaccgtgctgagcagctggatggccaagttcgacgccatctacagaggcgaggaggaccccagaaagcagcaggccagaatgaccgccagcgccgccagcgagctgatcctgagcaaggagcagctgtacgagatgttccagaacatcctgggcatcaagaagttcgagcaccagctgctgtacaacgcctgccagctggacaaccccgacgagcaggccgcccagatcagaagagagctggacggcagactgcagatggccgaccagatcgccagagagagaaagttccccaagttcgtgagcaaggagatggagaacatgtacatcgaggagctgaagagcagcgtgaacctgctgatggccaacctggagagcatgcccgtgagcaagggcggcgagttcaagctgcagaagctgaagagaagccacaacgccagcatcatcgacatgggcgaggagagcgagaaccagctgagcaagagcgacgtggtgctgagcttcagcctggaggtggtgatcatggaggtgcagggcctgaagagcctggcccccaacagaatcgtgtactgcaccatggaggtggagggcggcgagaagctgcagaccgaccaggccgaggccagcaagcccacctggggcacccagggcgacttcagcaccacccacgccctgcccgccgtgaaggtgaagctgttcaccgagagcaccggcgtgctggccctggaggacaaggagctgggcagagtgatcctgcaccccacccccaacagccccaagcagagcgagtggcacaagatgaccgtgagcaagaactgccccgaccaggacctgaagatcaagctggccgtgagaatggacaagccccagaacatgaagcacagcggctacctgtgggccatcggcaagaacgtgtggaagagatggaagaagagattcttcgtgctggtgcaggtgagccagtacaccttcgccatgtgcagctacagagagaagaaggccgagccccaggagctgctgcagctggacggctacaccgtggactacaccgacccccagcccggcctggagggcggcagagccttcttcaacgccgtgaaggagggcgacaccgtgatcttcgccagcgacgacgagcaggacagaatcctgtgggtgcaggccatgtacagagccaccggccagagccacaagcccgtgccccccacccaggtgcagaagctgaacgccaagggcggcaacgtgccccagctggacgcccccatcagccagttctacgccgacagagcccagaagcacggcatggacgagttcatcagcagcaacccctgcaacttcgaccacgccagcctgttcgagatgggctggttcagccccggccaggtgttcgtgctggacgagtactgcgccagaaacggcgtgagaggctgccacagacacctgtgctacctgagagacctgctggagagagccgagaacggcgccatgatcgaccccaccctgctgcactacagcttcgccttctgcgccagccacgtgcacggcaacagacccgacggcatcggcaccgtgaccgtggaggagaaggagagattcgaggagatcaaggagagactgagagtgctgctggagaaccagatcacccacttcagatactgcttccccttcggcagacccgagggcgccctgaaggccaccctgagcctgctggagagagtgctgatgaaggacatcgtgacccccgtgccccaggaggaggtgaagaccgtgatcagaaagtgcctggagcaggccgccctggtgaactacagcagactgagcgagtacgccaagatcgaggagaacgtgggcagactgatcacccccgccaagaagctggaggacaccatcagactggccgagctggtgatcgaggtgctgcagcagaacgaggagcaccacgccgaggccttcgcctggtggagcgacctgatggtggagcacgccgagaccttcctgagcctgttcgccgtggacatggacgccgccctggaggtgcagccccccgacacctgggacagcttccccctgttccagctgctgaacgacttcctgagaaccgactacaacctgtgcaacggcaagttccacaagcacctgcaggacctgttcgcccccctggtggtgagatacgtggacctgatggagagcagcatcgcccagagcatccacagaggcttcgagagagagagctgggagcccgtgaacaacggcagcggcaccagcgaggacctgttctggaagctggacgccctgcagaccttcatcagagacctgcactggcccgaggaggagttcggcaagcacctggagcagagactgaagctgatggccagcgacatgatcgagagctgcgtgaagagaaccagaatcgccttcgaggtgaagctgcagaagaccagcagaagcaccgacttcagagtgccccagagcatctgcaccatgttcaacgtgatggtggacgccaaggcccagagcaccaagctgtgcagcatggagatgggccaggagcaccagtaccacagcaagatcgacgagctgatcgaggagaccgtgaaggagatgatcaccctgctggtggccaagttcgtgaccatcctggagggcgtgctggccaagctgagcagatacgacgagggcaccctgttcagcagcttcctgagcttcaccgtgaaggccgccagcaagtacgtggacgtgcccaagcccggcatggacgtggccgacgcctacgtgaccttcgtgagacacagccaggacgtgctgagagacaaggtgaacgaggagatgtacatcgagagactgttcgaccagtggtacaacagcagcatgaacgtgatctgcacctggctgaccgacagaatggacctgcagctgcacatctaccagctgaagaccctgatcagaatggtgaagaagacctacagagacttcagactgcagggcgtgctggacagcaccctgaacagcaagacctacgagaccatcagaaacagactgaccgtggaggaggccaccgccagcgtgagcgagggcggcggcctgcagggcatcagcatgaaggacagcgacgaggaggacgaggaggacgactag

SEQ ID NO: 74828 - DNA, 4080 bp, Artificial Sequence
  Description of Artificial Sequence: Synthetic coding sequence
atgctggaccccagcagcagcgaggaggagagcgacgagatcgtggaggaggagagcggcaaggaggtgctgggcagcgcccccagcggcgccagactgagccccagcagaaccagcgagggcagcgccggcagcgccggcctgggcggcggcggcgccggcgccggcgccggcgtgggcgccggcggcggcggcggcagcggcgccagcagcggcggcggcgccggcggcctgcagcccagcagcagagccggcggcggcagacccagcagccccagccccagcgtggtgagcgagaaggagaaggaggagctggagagactgcagaaggaggaggaggagagaaagaagagactgcagctgtacgtgttcgtgatgagatgcatcgcctaccccttcaacgccaagcagcccaccgacatggccagaagacagcagaagatcagcaagcagcagctgcagaccgtgaaggacagattccaggccttcctgaacggcgagacccagatcatggccgacgaggccttcatgaacgccgtgcagagctactacgaggtgttcctgaagagcgacagagtggccagaatggtgcagagcggcggctgcagcgccaacgacagcagagaggtgttcaagaagcacatcgagaagagagtgagaagcctgcccgagatcgacggcctgagcaaggagaccgtgctgagcagctggatggccaagttcgacgccatctacagaggcgaggaggaccccagaaagcagcaggccagaatgaccgccagcgccgccagcgagctgatcctgagcaaggagcagctgtacgagatgttccagaacatcctgggcatcaagaagttcgagcaccagctgctgtacaacgcctgccagctggacaaccccgacgagcaggccgcccagatcagaagagagctggacggcagactgcagatggccgaccagatcgccagagagagaaagttccccaagttcgtgagcaaggagatggagaacatgtacatcgaggagctgaagagcagcgtgaacctgctgatggccaacctggagagcatgcccgtgagcaagggcggcgagttcaagctgcagaagctgaagagaagccacaacgccagcatcatcgacatgggcgaggagagcgagaaccagctgagcaagagcgacgtggtgctgagcttcagcctggaggtggtgatcatggaggtgcagggcctgaagagcctggcccccaacagaatcgtgtactgcaccatggaggtggagggcggcgagaagctgcagaccgaccaggccgaggccagcaagcccacctggggcacccagggcgacttcagcaccacccacgccctgcccgccgtgaaggtgaagctgttcaccgagagcaccggcgtgctggccctggaggacaaggagctgggcagagtgatcctgcaccccacccccaacagccccaagcagagcgagtggcacaagatgaccgtgagcaagaactgccccgaccaggacctgaagatcaagctggccgtgagaatggacaagccccagaacatgaagcacagcggctacctgtgggccatcggcaagaacgtgtggaagagatggaagaagagattcttcgtgctggtgcaggtgagccagtacaccttcgccatgtgcagctacagagagaagaaggccgagccccaggagctgctgcagctggacggctacaccgtggactacaccgacccccagcccggcctggagggcggcagagccttcttcaacgccgtgaaggagggcgacaccgtgatcttcgccagcgacgacgagcaggacagaatcctgtgggtgcaggccatgtacagagccaccggccagagccacaagcccgtgccccccacccaggtgcagaagctgaacgccaagggcggcaacgtgccccagctggacgcccccatcagccagttctacgccgacagagcccagaagcacggcatggacgagttcatcagcagcaacccctgcaacttcgaccacgccagcctgttcgagatggtgcagagactgaccctggaccacagactgaacgacagctacagctgcctgggctggttcagccccggccaggtgttcgtgctggacgagtactgcgccagaaacggcgtgagaggctgccacagacacctgtgctacctgagagacctgctggagagagccgagaacggcgccatgatcgaccccaccctgctgcactacagcttcgccttctgcgccagccacgtgcacggcaacagacccgacggcatcggcaccgtgaccgtggaggagaaggagagattcgaggagatcaaggagagactgagagtgctgctggagaaccagatcacccacttcagatactgcttccccttcggcagacccgagggcgccctgaaggccaccctgagcctgctggagagagtgctgatgaaggacatcgtgacccccgtgccccaggaggaggtgaagaccgtgatcagaaagtgcctggagcaggccgccctggtgaactacagcagactgagcgagtacgccaagatcgaggccaacagctgcaccaccgagaacgtgggcagactgatcacccccgccaagaagctggaggacaccatcagactggccgagctggtgatcgaggtgctgcagcagaacgaggagcaccacgccgagccccacgtggacaagggcgaggccttcgcctggtggagcgacctgatggtggagcacgccgagaccttcctgagcctgttcgccgtggacatggacgccgccctggaggtgcagccccccgacacctgggacagcttccccctgttccagctgctgaacgacttcctgagaaccgactacaacctgtgcaacggcaagttccacaagcacctgcaggacctgttcgcccccctggtggtgagatacgtggacctgatggagagcagcatcgcccagagcatccacagaggcttcgagagagagagctgggagcccgtgaagagcctgaccagcaacctgcccaacgtgaacctgcccaacgtgaacctgcccaaggtgcccaacctgcccgtgaacatccccctgggcatcccccagatgcccaccttcagcgcccccagctggatggccgccatctacgacgccgacaacggcagcggcaccagcgaggacctgttctggaagctggacgccctgcagaccttcatcagagacctgcactggcccgaggaggagttcggcaagcacctggagcagagactgaagctgatggccagcgacatgatcgagagctgcgtgaagagaaccagaatcgccttcgaggtgaagctgcagaagaccagcagaagcaccgacttcagagtgccccagagcatctgcaccatgttcaacgtgatggtggacgccaaggcccagagcaccaagctgtgcagcatggagatgggccaggagaagtacaagaagatgagacaccagtaccacagcaagatcgacgagctgatcgaggagaccgtgaaggagatgatcaccctgctggtggccaagttcgtgaccatcctggagggcgtgctggccaagctgagcagatacgacgagggcaccctgttcagcagcttcctgagcttcaccgtgaaggccgccagcaagtacgtggacgtgcccaagcccggcatggacgtggccgacgcctacgtgaccttcgtgagacacagccaggacgtgctgagagacaaggtgaacgaggagatgtacatcgagagactgttcgaccagtggtacaacagcagcatgaacgtgatctgcacctggctgaccgacagaatggacctgcagctgcacatctaccagctgaagaccctgatcagaatggtgaagaagacctacagagacttcagactgcagggcgtgctggacagcaccctgaacagcaagacctacgagaccatcagaaacagactgaccgtggaggaggccaccgccagcgtgagcgagggcggcggcctgcagggcatcagcatgaaggacagcgacgaggaggacgaggaggacgactag

SEQ ID NO: 74829 - DNA, 4062 bp, Artificial Sequence
  Description of Artificial Sequence: Synthetic coding sequence
atgctggaccccagcagcagcgaggaggagagcgacgagatcgtggaggaggagagcggcaaggaggtgctgggcagcgcccccagcggcgccagactgagccccagcagaaccagcgagggcagcgccggcagcgccggcctgggcggcggcggcgccggcgccggcgccggcgtgggcgccggcggcggcggcggcagcggcgccagcagcggcggcggcgccggcggcctgcagcccagcagcagagccggcggcggcagacccagcagccccagccccagcgtggtgagcgagaaggagaaggaggagctggagagactgcagaaggaggaggaggagagaaagaagagactgcagctgtacgtgttcgtgatgagatgcatcgcctaccccttcaacgccaagcagcccaccgacatggccagaagacagcagaagatcagcaagcagcagctgcagaccgtgaaggacagattccaggccttcctgaacggcgagacccagatcatggccgacgaggccttcatgaacgccgtgcagagctactacgaggtgttcctgaagagcgacagagtggccagaatggtgcagagcggcggctgcagcgccaacgacagcagagaggtgttcaagaagcacatcgagaagagagtgagaagcctgcccgagatcgacggcctgagcaaggagaccgtgctgagcagctggatggccaagttcgacgccatctacagaggcgaggaggaccccagaaagcagcaggccagaatgaccgccagcgccgccagcgagctgatcctgagcaaggagcagctgtacgagatgttccagaacatcctgggcatcaagaagttcgagcaccagctgctgtacaacgcctgccagctggacaaccccgacgagcaggccgcccagatcagaagagagctggacggcagactgcagatggccgaccagatcgccagagagagaaagttccccaagttcgtgagcaaggagatggagaacatgtacatcgaggagctgaagagcagcgtgaacctgctgatggccaacctggagagcatgcccgtgagcaagggcggcgagttcaagctgcagaagctgaagagaagccacaacgccagcatcatcgacatgggcgaggagagcgagaaccagctgagcaagagcgacgtggtgctgagcttcagcctggaggtggtgatcatggaggtgcagggcctgaagagcctggcccccaacagaatcgtgtactgcaccatggaggtggagggcggcgagaagctgcagaccgaccaggccgaggccagcaagcccacctggggcacccagggcgacttcagcaccacccacgccctgcccgccgtgaaggtgaagctgttcaccgagagcaccggcgtgctggccctggaggacaaggagctgggcagagtgatcctgcaccccacccccaacagccccaagcagagcgagtggcacaagatgaccgtgagcaagaactgccccgaccaggacctgaagatcaagctggccgtgagaatggacaagccccagaacatgaagcacagcggctacctgtgggccatcggcaagaacgtgtggaagagatggaagaagagattcttcgtgctggtgcaggtgagccagtacaccttcgccatgtgcagctacagagagaagaaggccgagccccaggagctgctgcagctggacggctacaccgtggactacaccgacccccagcccggcctggagggcggcagagccttcttcaacgccgtgaaggagggcgacaccgtgatcttcgccagcgacgacgagcaggacagaatcctgtgggtgcaggccatgtacagagccaccggccagagccacaagcccgtgccccccacccaggtgcagaagctgaacgccaagggcggcaacgtgccccagctggacgcccccatcagccagttctacgccgacagagcccagaagcacggcatggacgagttcatcagcagcaacccctgcaacttcgaccacgccagcctgttcgagatggtgcagagactgaccctggaccacagactgaacgacagctacagctgcctgggctggttcagccccggccaggtgttcgtgctggacgagtactgcgccagaaacggcgtgagaggctgccacagacacctgtgctacctgagagacctgctggagagagccgagaacggcgccatgatcgaccccaccctgctgcactacagcttcgccttctgcgccagccacgtgcacggcaacagacccgacggcatcggcaccgtgaccgtggaggagaaggagagattcgaggagatcaaggagagactgagagtgctgctggagaaccagatcacccacttcagatactgcttccccttcggcagacccgagggcgccctgaaggccaccctgagcctgctggagagagtgctgatgaaggacatcgtgacccccgtgccccaggaggaggtgaagaccgtgatcagaaagtgcctggagcaggccgccctggtgaactacagcagactgagcgagtacgccaagatcgaggagaaccagaaggacgccgagaacgtgggcagactgatcacccccgccaagaagctggaggacaccatcagactggccgagctggtgatcgaggtgctgcagcagaacgaggagcaccacgccgagccccacgtggacaagggcgaggccttcgcctggtggagcgacctgatggtggagcacgccgagaccttcctgagcctgttcgccgtggacatggacgccgccctggaggtgcagccccccgacacctgggacagcttccccctgttccagctgctgaacgacttcctgagaaccgactacaacctgtgcaacggcaagttccacaagcacctgcaggacctgttcgcccccctggtggtgagatacgtggacctgatggagagcagcatcgcccagagcatccacagaggcttcgagagagagagctgggagcccgtgaagagcctgaccagcaacctgcccaacgtgaacctgcccaacgtgaacctgcccaaggtgcccaacctgcccgtgaacatccccctgggcatcccccagatgcccaccttcagcgcccccagctggatggccgccatctacgacgccgacaacggcagcggcaccagcgaggacctgttctggaagctggacgccctgcagaccttcatcagagacctgcactggcccgaggaggagttcggcaagcacctggagcagagactgaagctgatggccagcgacatgatcgagagctgcgtgaagagaaccagaatcgccttcgaggtgaagctgcagaagaccagcagaagcaccgacttcagagtgccccagagcatctgcaccatgttcaacgtgatggtggacgccaaggcccagagcaccaagctgtgcagcatggagatgggccaggagcaccagtaccacagcaagatcgacgagctgatcgaggagaccgtgaaggagatgatcaccctgctggtggccaagttcgtgaccatcctggagggcgtgctggccaagctgagcagatacgacgagggcaccctgttcagcagcttcctgagcttcaccgtgaaggccgccagcaagtacgtggacgtgcccaagcccggcatggacgtggccgacgcctacgtgaccttcgtgagacacagccaggacgtgctgagagacaaggtgaacgaggagatgtacatcgagagactgttcgaccagtggtacaacagcagcatgaacgtgatctgcacctggctgaccgacagaatggacctgcagctgcacatctaccagctgaagaccctgatcagaatggtgaagaagacctacagagacttcagactgcagggcgtgctggacagcaccctgaacagcaagacctacgagaccatcagaaacagactgaccgtggaggaggccaccgccagcgtgagcgagggcggcggcctgcagggcatcagcatgaaggacagcgacgaggaggacgaggaggacgactag

SEQ ID NO: 74830 - DNA, 1038 bp, Artificial Sequence
  Description of Artificial Sequence: Synthetic coding sequence
tgactgcccaacgtgaacctgcccaacgtgaacctgcccaaggtgcccaacctgcccgtgaacatccccctgggcatcccccagatgcccaccttcagcgcccccagctggatggccgccatctacgacgccgacaacggcagcggcaccagcgaggacctgttctggaagctggacgccctgcagaccttcatcagagacctgcactggcccgaggaggagttcggcaagcacctggagcagagactgaagctgatggccagcgacatgatcgagagctgcgtgaagagaaccagaatcgccttcgaggtgaagctgcagaagaccagcagaagcaccgacttcagagtgccccagagcatctgcaccatgttcaacgtgatggtggacgccaaggcccagagcaccaagctgtgcagcatggagatgggccaggagttcgccaagatgtggcaccagtaccacagcaagatcgacgagctgatcgaggagaccgtgaaggagatgatcaccctgctggtggccaagttcgtgaccatcctggagggcgtgctggccaagctgagcagatacgacgagggcaccctgttcagcagcttcctgagcttcaccgtgaaggccgccagcaagtacgtggacgtgcccaagcccggcatggacgtggccgacgcctacgtgaccttcgtgagacacagccaggacgtgctgagagacaaggtgaacgaggagatgtacatcgagagactgttcgaccagtggtacaacagcagcatgaacgtgatctgcacctggctgaccgacagaatggacctgcagctgcacatctaccagctgaagaccctgatcagaatggtgaagaagacctacagagacttcagactgcagggcgtgctggacagcaccctgaacagcaagacctacgagaccatcagaaacagactgaccgtggaggaggccaccgccagcgtgagcgagggcggcggcctgcagggcatcagcatgaaggacagcgacgaggaggacgaggaggacgactag

SEQ ID NO: 74831 - DNA, 3768 bp, Artificial Sequence
  Description of Artificial Sequence: Synthetic coding sequence
atgctggaccccagcagcagcgaggaggagagcgacgagggcctggaggaggagagcagagacgtgctggtggccgccggcagcagccagagagccccccccgcccccaccagagagggcagaagagacgcccccggcagagccggcggcggcggcgccgccagaagcgtgagccccagccccagcgtgctgagcgagggcagagacgagccccagagacagctggacgacgagcaggagagaagaatcagactgcagctgtacgtgttcgtggtgagatgcatcgcctaccccttcaacgccaagcagcccaccgacatggccagaagacagcagaagctgaacaagcagcagctgcagctgctgaaggagagattccaggccttcctgaacggcgagacccagatcgtggccgacgaggccttctgcaacgccgtgagaagctactacgaggtgttcctgaagagcgacagagtggccagaatggtgcagagcggcggctgcagcgccaacgacttcagagaggtgttcaagaagaacatcgagaagagagtgagaagcctgcccgagatcgacggcctgagcaaggagaccgtgctgagcagctggatcgccaagtacgacgccatctacagaggcgaggaggacctgtgcaagcagcccaacagaatggccctgagcgccgtgagcgagctgatcctgagcaaggagcagctgtacgagatgttccagcagatcctgggcatcaagaagctggagcaccagctgctgtacaacgcctgccagctggacaacgccgacgagcaggccgcccagatcagaagagagctggacggcagactgcagctggccgacaagatggccaaggagagaaagttccccaagttcatcgccaaggacatggagaacatgtacatcgaggagctgagaagcagcgtgaacctgctgatggccaacctggagagcctgcccgtgagcaagggcggccccgagttcaagctgcagaagctgaagagaagccagaacagcgccttcctggacatcggcgacgagaacgagatccagctgagcaagagcgacgtggtgctgagcttcaccctggagatcgtgatcatggaggtgcagggcctgaagagcgtggcccccaacagaatcgtgtactgcaccatggaggtggagggcgagaagctgcagaccgaccaggccgaggccagcagaccccagtggggcacccagggcgacttcaccaccacccaccccagacccgtggtgaaggtgaagctgttcaccgagagcaccggcgtgctggccctggaggacaaggagctgggcagagtgatcctgtaccccaccagcaacagcagcaagagcgccgagctgcacagaatggtggtgcccaagaacagccaggacagcgacctgaagatcaagctggccgtgagaatggacaagcccgcccacatgaagcacagcggctacctgtacgccctgggccagaaggtgtggaagagatggaagaagagatacttcgtgctggtgcaggtgagccagtacaccttcgccatgtgcagctacagagagaagaagagcgagccccaggagctgatgcagctggagggctacaccgtggactacaccgacccccaccccggcctgcagggcggctgcatgttcttcaacgccgtgaaggagggcgacaccgtgatcttcgccagcgacgacgagcaggacagaatcctgtgggtgcaggccatgtacagagccaccggccagagctacaagcccgtgcccgccatccagacccagaagctgaaccccaagggcggcaccctgcacgccgacgcccagctgtacgccgacagattccagaagcacggcatggacgagttcatcagcgccaacccctgcaagctggaccacgccttcctgttcagaatcctgcagagacagaccctggaccacagactgaacgacagctacagctgcctgggctggttcagccccggccaggtgttcgtgctggacgagtactgcgccagatacggcgtgagaggctgccacagacacctgtgctacctggccgagctgatggagcacagcgagaacggcgccgtgatcgaccccaccctgctgcactacagcttcgccttctgcgccagccacgtgcacggcaacagacccgacggcatcggcaccgtgagcgtggaggagaaggagagattcgaggagatcaaggagagactgagcagcctgctggagaaccagatcagccacttcagatactgcttccccttcggcagacccgagggcgccctgaaggccaccctgagcctgctggagagagtgctgatgaaggacatcgccacccccatccccgccgaggaggtgaagaaggtggtgagaaagtgcctggagaaggccgccctgatcaactacaccagactgaccgagtacgccaagatcgaggagaccatgaaccaggccagccccgccagaaagctggaggagatcctgcacctggccgagctgtgcatcgaggtgctgcagcagaacgaggagcaccacgccgaggccttcgcctggtggcccgacctgctggccgagcacgccgagaagttctgggccctgttcaccgtggacatggacaccgccctggaggcccagccccaggacagctgggacagcttccccctgttccagctgctgaacaacttcctgagaaacgacaccctgctgtgcaacggcaagttccacaagcacctgcaggagatcttcgtgcccctggtggtgagatacgtggacctgatggagagcagcatcgcccagagcatccacagaggcttcgagcaggagacctggcagcccgtgaacaacggcagcgccaccagcgaggacctgttctggaagctggacgccctgcagatgttcgtgttcgacctgcactggcccgagcaggagttcgcccaccacctggagcagagactgaagctgatggccagcgacatgctggaggcctgcgtgaagagaaccagaaccgccttcgagctgaagctgcagaaggccagcaagaccaccgacctgagaatccccgccagcgtgtgcaccatgttcaacgtgctggtggacgccaagaagcagagcaccaagctgtgcgccctggacggcggccaggaggtgtgcagaatcttccagcagtaccacagcaagatcgacgacctgatcgacaacagcgtgaaggagatcatcagcctgctggtgagcaagttcgtgagcgtgctggagggcgtgctgagcaagctgagcagatacgacgagggcaccttcttcagcagcatcctgagcttcaccgtgaaggccgccgccaagtacgtggacgtgcccaagcccggcatggacctggccgacacctacatcatgttcgtgagacagaaccaggacatcctgagagagaaggtgaacgaggagatgtacatcgagaagctgttcgaccagtggtacagcagcagcatgaaggtgatctgcgtgtggctgaccgacagactggacctgcagctgcacatctaccagctgaagaccctgatcaagatcgtgaagaagacctacagagacttcagactgcagggcgtgctggagggcaccctgaacagcaagacctacgacaccgtgcacagaagactgaccgtggaggaggccaccgccagcgtgagcgagggcggcggcctgcagggcatcaccatgaaggacagcgacgaggaggaggagggctag

SEQ ID NO: 74832 - DNA, 3885 bp, Artificial Sequence
  Description of Artificial Sequence: Synthetic coding sequence
atgctggaccccagcagcagcgaggaggagagcgacgagggcctggaggaggagagcagagacgtgctggtggccgccggcagcagccagagagccccccccgcccccaccagagagggcagaagagacgcccccggcagagccggcggcggcggcgccgccagaagcgtgagccccagccccagcgtgctgagcgagggcagagacgagccccagagacagctggacgacgagcaggagagaagaatcagactgcagctgtacgtgttcgtggtgagatgcatcgcctaccccttcaacgccaagcagcccaccgacatggccagaagacagcagaagctgaacaagcagcagctgcagctgctgaaggagagattccaggccttcctgaacggcgagacccagatcgtggccgacgaggccttctgcaacgccgtgagaagctactacgaggtgttcctgaagagcgacagagtggccagaatggtgcagagcggcggctgcagcgccaacgacttcagagaggtgttcaagaagaacatcgagaagagagtgagaagcctgcccgagatcgacggcctgagcaaggagaccgtgctgagcagctggatcgccaagtacgacgccatctacagaggcgaggaggacctgtgcaagcagcccaacagaatggccctgagcgccgtgagcgagctgatcctgagcaaggagcagctgtacgagatgttccagcagatcctgggcatcaagaagctggagcaccagctgctgtacaacgcctgccagctggacaacgccgacgagcaggccgcccagatcagaagagagctggacggcagactgcagctggccgacaagatggccaaggagagaaagttccccaagttcatcgccaaggacatggagaacatgtacatcgaggagctgagaagcagcgtgaacctgctgatggccaacctggagagcctgcccgtgagcaagggcggccccgagttcaagctgcagaagctgaagagaagccagaacagcgccttcctggacatcggcgacgagaacgagatccagctgagcaagagcgacgtggtgctgagcttcaccctggagatcgtgatcatggaggtgcagggcctgaagagcgtggcccccaacagaatcgtgtactgcaccatggaggtggagggcgagaagctgcagaccgaccaggccgaggccagcagaccccagtggggcacccagggcgacttcaccaccacccaccccagacccgtggtgaaggtgaagctgttcaccgagagcaccggcgtgctggccctggaggacaaggagctgggcagagtgatcctgtaccccaccagcaacagcagcaagagcgccgagctgcacagaatggtggtgcccaagaacagccaggacagcgacctgaagatcaagctggccgtgagaatggacaagcccgcccacatgaagcacagcggctacctgtacgccctgggccagaaggtgtggaagagatggaagaagagatacttcgtgctggtgcaggtgagccagtacaccttcgccatgtgcagctacagagagaagaagagcgagccccaggagctgatgcagctggagggctacaccgtggactacaccgacccccaccccggcctgcagggcggctgcatgttcttcaacgccgtgaaggagggcgacaccgtgatcttcgccagcgacgacgagcaggacagaatcctgtgggtgcaggccatgtacagagccaccggccagagctacaagcccgtgcccgccatccagacccagaagctgaaccccaagggcggcaccctgcacgccgacgcccagctgagcgagttcaccgacgccgacagattccagaagcacggcatggacgagttcatcagcgccaacccctgcaagctggaccacgccttcctgttcagaatcctgcagagacagaccctggaccacagactgaacgacagctacagctgcctgggctggttcagccccggccaggtgttcgtgctggacgagtactgcgccagatacggcgtgagaggctgccacagacacctgtgctacctggccgagctgatggagcacagcgagaacggcgccgtgatcgaccccaccctgctgcactacagcttcgccttctgcgccagccacgtgcacggcaacagacccgacggcatcggcaccgtgagcgtggaggagaaggagagattcgaggagatcaaggagagactgagcagcctgctggagaaccagatcagccacttcagatactgcttccccttcggcagacccgagggcgccctgaaggccaccctgagcctgctggagagagtgctgatgaaggacatcgccacccccatccccgccgaggaggtgaagaaggtggtgagaaagtgcctggagaaggccgccctgatcaactacaccagactgaccgagtacgccaagatcgaggagaccatgaaccaggccagccccgccagaaagctggaggagatcctgcacctggccgagctgtgcatcgaggtgctgcagcagaacgaggagcaccacgccgaggccttcgcctggtggcccgacctgctggccgagcacgccgagaagttctgggccctgttcaccgtggacatggacaccgccctggaggcccagccccaggacagctgggacagcttccccctgttccagctgctgaacaacttcctgagaaacgacaccctgctgtgcaacggcaagttccacaagcacctgcaggagatcttcgtgcccctggtggtgagatacgtggacctgatggagagcagcatcgcccagagcatccacagaggcttcgagcaggagacctggcagcccgtgaagaacatcgccaacagcctgcccaacgtggccctgcccaaggtgcccagcctgcccctgaacctgccccagatccccaacatcagcaccgccagctggatgcccagcctgtacgagagcaccaacggcagcgccaccagcgaggacctgttctggaagctggacgccctgcagatgttcgtgttcgacctgcactggcccgagcaggagttcgcccaccacctggagcagagactgaagctgatggccagcgacatgctggaggcctgcgtgaagagaaccagaaccgccttcgagctgaagctgcagaaggccagcaagaccaccgacctgagaatccccgccagcgtgtgcaccatgttcaacgtgctggtggacgccaagaagcagagcaccaagctgtgcgccctggacggcggccaggagcagcagtaccacagcaagatcgacgacctgatcgacaacagcgtgaaggagatcatcagcctgctggtgagcaagttcgtgagcgtgctggagggcgtgctgagcaagctgagcagatacgacgagggcaccttcttcagcagcatcctgagcttcaccgtgaaggccgccgccaagtacgtggacgtgcccaagcccggcatggacctggccgacacctacatcatgttcgtgagacagaaccaggacatcctgagagagaaggtgaacgaggagatgtacatcgagaagctgttcgaccagtggtacagcagcagcatgaaggtgatctgcgtgtggctgaccgacagactggacctgcagctgcacatctaccagctgaagaccctgatcaagatcgtgaagaagacctacagagacttcagactgcagggcgtgctggagggcaccctgaacagcaagacctacgacaccgtgcacagaagactgaccgtggaggaggccaccgccagcgtgagcgagggcggcggcctgcagggcatcaccatgaaggacagcgacgaggaggaggagggctag

SEQ ID NO: 74833 - DNA, 1410 bp, Artificial Sequence
  Description of Artificial Sequence: Synthetic coding sequence
atgaaccaggccagccccgccagaaagctggaggagatcctgcacctggccgagctgtgcatcgaggtgctgcagcagaacgaggagcaccacgccgagctgagacacgccttcgcctggtggcccgacctgctggccgagcacgccgagaagttctgggccctgttcaccgtggacatggacaccgccctggaggcccagccccaggacagctgggacagcttccccctgttccagctgctgaacaacttcctgagaaacgacaccctgctgtgcaacggcaagttccacaagcacctgcaggagatcttcgtgcccctggtggtgagatacgtggacctgatggagagcagcatcgcccagagcatccacagaggcttcgagcaggagacctggcagcccgtgaagaacatcgccaacagcctgcccaacgtggccctgcccaaggtgcccagcctgcccctgaacctgccccagatccccaacatcagcaccgccagctggatgcccagcctgtacgagagcaccaacggcagcgccaccagcgaggacctgttctggaagctggacgccctgcagatgttcgtgttcgacctgcactggcccgagcaggagttcgcccaccacctggagcagagactgaagctgatggccagcgacatgctggaggcctgcgtgaagagaaccagaaccgccttcgagctgaagctgcagaaggccagcaagaccaccgacctgagaatccccgccagcgtgtgcaccatgttcaacgtgctggtggacgccaagaagcagagcaccaagctgtgcgccctggacggcggccaggagcagcagtaccacagcaagatcgacgacctgatcgacaacagcgtgaaggagatcatcagcctgctggtgagcaagttcgtgagcgtgctggagggcgtgctgagcaagctgagcagatacgacgagggcaccttcttcagcagcatcctgagcttcaccgtgaaggccgccgccaagtacgtggacgtgcccaagcccggcatggacctggccgacacctacatcatgttcgtgagacagaaccaggacatcctgagagagaaggtgaacgaggagatgtacatcgagaagctgttcgaccagtggtacagcagcagcatgaaggtgatctgcgtgtggctgaccgacagactggacctgcagctgcacatctaccagctgaagaccctgatcaagatcgtgaagaagacctacagagacttcagactgcagggcgtgctggagggcaccctgaacagcaagacctacgacaccgtgcacagaagactgaccgtggaggaggccaccgccagcgtgagcgagggcggcggcctgcagggcatcaccatgaaggacagcgacgaggaggaggagggctag

SEQ ID NO: 74834 - DNA, 2700 bp, Artificial Sequence
  Description of Artificial Sequence: Synthetic coding sequence
tgagagatccagctgagcaagagcgacgtggtgctgagcttcaccctggagatcgtgatcatggaggtgcagggcctgaagagcgtggcccccaacagaatcgtgtactgcaccatggaggtggagggcgagaagctgcagaccgaccaggccgaggccagcagaccccagtggggcacccagggcgacttcaccaccacccaccccagacccgtggtgaaggtgaagctgttcaccgagagcaccggcgtgctggccctggaggacaaggagctgggcagagtgatcctgtaccccaccagcaacagcagcaagagcgccgagctgcacagaatggtggtgcccaagaacagccaggacagcgacctgaagatcaagctggccgtgagaatggacaagcccgcccacatgaagcacagcggctacctgtacgccctgggccagaaggtgtggaagagatggaagaagagatacttcgtgctggtgcaggtgagccagtacaccttcgccatgtgcagctacagagagaagaagagcgagccccaggagctgatgcagctggagggctacaccgtggactacaccgacccccaccccggcctgcagggcggctgcatgttcttcaacgccgtgaaggagggcgacaccgtgatcttcgccagcgacgacgagcaggacagaatcctgtgggtgcaggccatgtacagagccaccggccagagctacaagcccgtgcccgccatccagacccagaagctgaaccccaagggcggcaccctgcacgccgacgcccagctgtacgccgacagattccagaagcacggcatggacgagttcatcagcgccaacccctgcaagctggaccacgccttcctgttcagaatcctgcagagacagaccctggaccacagactgaacgacagctacagctgcctgggctggttcagccccggccaggtgttcgtgctggacgagtactgcgccagatacggcgtgagaggctgccacagacacctgtgctacctggccgagctgatggagcacagcgagaacggcgccgtgatcgaccccaccctgctgcactacagcttcgccttctgcgccagccacgtgcacggcaacagacccgacggcatcggcaccgtgagcgtggaggagaaggagagattcgaggagatcaaggagagactgagcagcctgctggagaaccagatcagccacttcagatactgcttccccttcggcagacccgagggcgccctgaaggccaccctgagcctgctggagagagtgctgatgaaggacatcgccacccccatccccgccgaggaggtgaagaaggtggtgagaaagtgcctggagaaggccgccctgatcaactacaccagactgaccgagtacgccaagatcgaggagaccatgaaccaggccagccccgccagaaagctggaggagatcctgcacctggccgagctgtgcatcgaggtgctgcagcagaacgaggagcaccacgccgaggccttcgcctggtggcccgacctgctggccgagcacgccgagaagttctgggccctgttcaccgtggacatggacaccgccctggaggcccagccccaggacagctgggacagcttccccctgttccagctgctgaacaacttcctgagaaacgacaccctgctgtgcaacggcaagttccacaagcacctgcaggagatcttcgtgcccctggtggtgagatacgtggacctgatggagagcagcatcgcccagagcatccacagaggcttcgagcaggagacctggcagcccgtgaacaacggcagcgccaccagcgaggacctgttctggaagctggacgccctgcagatgttcgtgttcgacctgcactggcccgagcaggagttcgcccaccacctggagcagagactgaagctgatggccagcgacatgctggaggcctgcgtgaagagaaccagaaccgccttcgagctgaagctgcagaaggccagcaagaccaccgacctgagaatccccgccagcgtgtgcaccatgttcaacgtgctggtggacgccaagaagcagagcaccaagctgtgcgccctggacggcggccaggagcagcagtaccacagcaagatcgacgacctgatcgacaacagcgtgaaggagatcatcagcctgctggtgagcaagttcgtgagcgtgctggagggcgtgctgagcaagctgagcagatacgacgagggcaccttcttcagcagcatcctgagcttcaccgtgaaggccgccgccaagtacgtggacgtgcccaagcccggcatggacctggccgacacctacatcatgttcgtgagacagaaccaggacatcctgagagagaaggtgaacgaggagatgtacatcgagaagctgttcgaccagtggtacagcagcagcatgaaggtgatctgcgtgtggctgaccgacagactggacctgcagctgcacatctaccagctgaagaccctgatcaagatcgtgaagaagacctacagagacttcagactgcagggcgtgctggagggcaccctgaacagcaagacctacgacaccgtgcacagaagactgaccgtggaggaggccaccgccagcgtgagcgagggcggcggcctgcagggcatcaccatgaaggacagcgacgaggaggaggagggctag

SEQ ID NO: 74835 - DNA, 3768 bp, Artificial Sequence
  Description of Artificial Sequence: Synthetic coding sequence
atgctggaccccagcagcagcgaggaggagagcgacgagggcctggaggaggagagcagagacgtgctggtggccgccggcagcagccagagagccccccccgcccccaccagagagggcagaagagacgcccccggcagagccggcggcggcggcgccgccagaagcgtgagccccagccccagcgtgctgagcgagggcagagacgagccccagagacagctggacgacgagcaggagagaagaatcagactgcagctgtacgtgttcgtggtgagatgcatcgcctaccccttcaacgccaagcagcccaccgacatggccagaagacagcagaagctgaacaagcagcagctgcagctgctgaaggagagattccaggccttcctgaacggcgagacccagatcgtggccgacgaggccttctgcaacgccgtgagaagctactacgaggtgttcctgaagagcgacagagtggccagaatggtgcagagcggcggctgcagcgccaacgacttcagagaggtgttcaagaagaacatcgagaagagagtgagaagcctgcccgagatcgacggcctgagcaaggagaccgtgctgagcagctggatcgccaagtacgacgccatctacagaggcgaggaggacctgtgcaagcagcccaacagaatggccctgagcgccgtgagcgagctgatcctgagcaaggagcagctgtacgagatgttccagcagatcctgggcatcaagaagctggagcaccagctgctgtacaacgcctgccagctggacaacgccgacgagcaggccgcccagatcagaagagagctggacggcagactgcagctggccgacaagatggccaaggagagaaagttccccaagttcatcgccaaggacatggagaacatgtacatcgaggagctgagaagcagcgtgaacctgctgatggccaacctggagagcctgcccgtgagcaagggcggccccgagttcaagctgcagaagctgaagagaagccagaacagcgccttcctggacatcggcgacgagaacgagatccagctgagcaagagcgacgtggtgctgagcttcaccctggagatcgtgatcatggaggtgcagggcctgaagagcgtggcccccaacagaatcgtgtactgcaccatggaggtggagggcgagaagctgcagaccgaccaggccgaggccagcagaccccagtggggcacccagggcgacttcaccaccacccaccccagacccgtggtgaaggtgaagctgttcaccgagagcaccggcgtgctggccctggaggacaaggagctgggcagagtgatcctgtaccccaccagcaacagcagcaagagcgccgagctgcacagaatggtggtgcccaagaacagccaggacagcgacctgaagatcaagctggccgtgagaatggacaagcccgcccacatgaagcacagcggctacctgtacgccctgggccagaaggtgtggaagagatggaagaagagatacttcgtgctggtgcaggtgagccagtacaccttcgccatgtgcagctacagagagaagaagagcgagccccaggagctgatgcagctggagggctacaccgtggactacaccgacccccaccccggcctgcagggcggctgcatgttcttcaacgccgtgaaggagggcgacaccgtgatcttcgccagcgacgacgagcaggacagaatcctgtgggtgcaggccatgtacagagccaccggccagagctacaagcccgtgcccgccatccagacccagaagctgaaccccaagggcggcaccctgcacgccgacgcccagctgtacgccgacagattccagaagcacggcatggacgagttcatcagcgccaacccctgcaagctggaccacgccttcctgttcagaatcctgcagagacagaccctggaccacagactgaacgacagctacagctgcctgggctggttcagccccggccaggtgttcgtgctggacgagtactgcgccagatacggcgtgagaggctgccacagacacctgtgctacctggccgagctgatggagcacagcgagaacggcgccgtgatcgaccccaccctgctgcactacagcttcgccttctgcgccagccacgtgcacggcaacagacccgacggcatcggcaccgtgagcgtggaggagaaggagagattcgaggagatcaaggagagactgagcagcctgctggagaaccagatcagccacttcagatactgcttccccttcggcagacccgagggcgccctgaaggccaccctgagcctgctggagagagtgctgatgaaggacatcgccacccccatccccgccgaggaggtgaagaaggtggtgagaaagtgcctggagaaggccgccctgatcaactacaccagactgaccgagtacgccaagatcgaggagaccatgaaccaggccagccccgccagaaagctggaggagatcctgcacctggccgagctgtgcatcgaggtgctgcagcagaacgaggagcaccacgccgaggccttcgcctggtggcccgacctgctggccgagcacgccgagaagttctgggccctgttcaccgtggacatggacaccgccctggaggcccagccccaggacagctgggacagcttccccctgttccagctgctgaacaacttcctgagaaacgacaccctgctgtgcaacggcaagttccacaagcacctgcaggagatcttcgtgcccctggtggtgagatacgtggacctgatggagagcagcatcgcccagagcatccacagaggcttcgagcaggagacctggcagcccgtgaacaacggcagcgccaccagcgaggacctgttctggaagctggacgccctgcagatgttcgtgttcgacctgcactggcccgagcaggagttcgcccaccacctggagcagagactgaagctgatggccagcgacatgctggaggcctgcgtgaagagaaccagaaccgccttcgagctgaagctgcagaaggccagcaagaccaccgacctgagaatccccgccagcgtgtgcaccatgttcaacgtgctggtggacgccaagaagcagagcaccaagctgtgcgccctggacggcggccaggagttcggcagccagtggcagcagtaccacagcaagatcgacgacctgatcgacaacagcgtgaaggagatcatcagcctgctggtgagcaagttcgtgagcgtgctggagggcgtgctgagcaagctgagcagatacgacgagggcaccttcttcagcagcatcctgagcttcaccgtgaaggccgccgccaagtacgtggacgtgcccaagcccggcatggacctggccgacacctacatcatgttcgtgagacagaaccaggacatcctgagagagaaggtgaacgaggagatgtacatcgagaagctgttcgaccagtggtacagcagcagcatgaaggtgatctgcgtgtggctgaccgacagactggacctgcagctgcacatctaccagctgaagaccctgatcaagatcgtgaagaagacctacagagacttcagactgcagggcgtgctggagggcaccctgaacagcaagacctacgacaccgtgcacagaagactgaccgtggaggaggccaccgccagcgtgagcgagggcggcggcctgcagggcatcaccatgaaggacagcgacgaggaggaggagggctag

SEQ ID NO: 74836 - DNA, 3906 bp, Artificial Sequence
  Description of Artificial Sequence: Synthetic coding sequence
atgctggaccccagcagcagcgaggaggagagcgacgagggcctggaggaggagagcagagacgtgctggtggccgccggcagcagccagagagccccccccgcccccaccagagagggcagaagagacgcccccggcagagccggcggcggcggcgccgccagaagcgtgagccccagccccagcgtgctgagcgagggcagagacgagccccagagacagctggacgacgagcaggagagaagaatcagactgcagctgtacgtgttcgtggtgagatgcatcgcctaccccttcaacgccaagcagcccaccgacatggccagaagacagcagaagctgaacaagcagcagctgcagctgctgaaggagagattccaggccttcctgaacggcgagacccagatcgtggccgacgaggccttctgcaacgccgtgagaagctactacgaggtgttcctgaagagcgacagagtggccagaatggtgcagagcggcggctgcagcgccaacgacttcagagaggtgttcaagaagaacatcgagaagagagtgagaagcctgcccgagatcgacggcctgagcaaggagaccgtgctgagcagctggatcgccaagtacgacgccatctacagaggcgaggaggacctgtgcaagcagcccaacagaatggccctgagcgccgtgagcgagctgatcctgagcaaggagcagctgtacgagatgttccagcagatcctgggcatcaagaagctggagcaccagctgctgtacaacgcctgccagctggacaacgccgacgagcaggccgcccagatcagaagagagctggacggcagactgcagctggccgacaagatggccaaggagagaaagttccccaagttcatcgccaaggacatggagaacatgtacatcgaggagctgagaagcagcgtgaacctgctgatggccaacctggagagcctgcccgtgagcaagggcggccccgagttcaagctgcagaagctgaagagaagccagaacagcgccttcctggacatcggcgacgagaacgagatccagctgagcaagagcgacgtggtgctgagcttcaccctggagatcgtgatcatggaggtgcagggcctgaagagcgtggcccccaacagaatcgtgtactgcaccatggaggtggagggcgagaagctgcagaccgaccaggccgaggccagcagaccccagtggggcacccagggcgacttcaccaccacccaccccagacccgtggtgaaggtgaagctgttcaccgagagcaccggcgtgctggccctggaggacaaggagctgggcagagtgatcctgtaccccaccagcaacagcagcaagagcgccgagctgcacagaatggtggtgcccaagaacagccaggacagcgacctgaagatcaagctggccgtgagaatggacaagcccgcccacatgaagcacagcggctacctgtacgccctgggccagaaggtgtggaagagatggaagaagagatacttcgtgctggtgcaggtgagccagtacaccttcgccatgtgcagctacagagagaagaagagcgagccccaggagctgatgcagctggagggctacaccgtggactacaccgacccccaccccggcctgcagggcggctgcatgttcttcaacgccgtgaaggagggcgacaccgtgatcttcgccagcgacgacgagcaggacagaatcctgtgggtgcaggccatgtacagagccaccggccagagctacaagcccgtgcccgccatccagacccagaagctgaaccccaagggcggcaccctgcacgccgacgcccagctgagcgagttcaccgacgccgacagattccagaagcacggcatggacgagttcatcagcgccaacccctgcaagctggaccacgccttcctgttcagaatcctgcagagacagaccctggaccacagactgaacgacagctacagctgcctgggctggttcagccccggccaggtgttcgtgctggacgagtactgcgccagatacggcgtgagaggctgccacagacacctgtgctacctggccgagctgatggagcacagcgagaacggcgccgtgatcgaccccaccctgctgcactacagcttcgccttctgcgccagccacgtgcacggcaacagacccgacggcatcggcaccgtgagcgtggaggagaaggagagattcgaggagatcaaggagagactgagcagcctgctggagaaccagatcagccacttcagatactgcttccccttcggcagacccgagggcgccctgaaggccaccctgagcctgctggagagagtgctgatgaaggacatcgccacccccatccccgccgaggaggtgaagaaggtggtgagaaagtgcctggagaaggccgccctgatcaactacaccagactgaccgagtacgccaagatcgagggccccgccgagaaggagaccgagaccatgaaccaggccagccccgccagaaagctggaggagatcctgcacctggccgagctgtgcatcgaggtgctgcagcagaacgaggagcaccacgccgaggccttcgcctggtggcccgacctgctggccgagcacgccgagaagttctgggccctgttcaccgtggacatggacaccgccctggaggcccagccccaggacagctgggacagcttccccctgttccagctgctgaacaacttcctgagaaacgacaccctgctgtgcaacggcaagttccacaagcacctgcaggagatcttcgtgcccctggtggtgagatacgtggacctgatggagagcagcatcgcccagagcatccacagaggcttcgagcaggagacctggcagcccgtgaagaacatcgccaacagcctgcccaacgtggccctgcccaaggtgcccagcctgcccctgaacctgccccagatccccaacatcagcaccgccagctggatgcccagcctgtacgagagcaccaacggcagcgccaccagcgaggacctgttctggaagctggacgccctgcagatgttcgtgttcgacctgcactggcccgagcaggagttcgcccaccacctggagcagagactgaagctgatggccagcgacatgctggaggcctgcgtgaagagaaccagaaccgccttcgagctgaagctgcagaaggccagcaagaccaccgacctgagaatccccgccagcgtgtgcaccatgttcaacgtgctggtggacgccaagaagcagagcaccaagctgtgcgccctggacggcggccaggagcagcagtaccacagcaagatcgacgacctgatcgacaacagcgtgaaggagatcatcagcctgctggtgagcaagttcgtgagcgtgctggagggcgtgctgagcaagctgagcagatacgacgagggcaccttcttcagcagcatcctgagcttcaccgtgaaggccgccgccaagtacgtggacgtgcccaagcccggcatggacctggccgacacctacatcatgttcgtgagacagaaccaggacatcctgagagagaaggtgaacgaggagatgtacatcgagaagctgttcgaccagtggtacagcagcagcatgaaggtgatctgcgtgtggctgaccgacagactggacctgcagctgcacatctaccagctgaagaccctgatcaagatcgtgaagaagacctacagagacttcagactgcagggcgtgctggagggcaccctgaacagcaagacctacgacaccgtgcacagaagactgaccgtggaggaggccaccgccagcgtgagcgagggcggcggcctgcagggcatcaccatgaaggacagcgacgaggaggaggagggctag

SEQ ID NO: 74837 - DNA, 3891 bp, Artificial Sequence
  Description of Artificial Sequence: Synthetic coding sequence
atgctggaccccagcagcagcgaggaggagagcgacgagggcctggaggaggagagcagagacgtgctggtggccgccggcagcagccagagagccccccccgcccccaccagagagggcagaagagacgcccccggcagagccggcggcggcggcgccgccagaagcgtgagccccagccccagcgtgctgagcgagggcagagacgagccccagagacagctggacgacgagcaggagagaagaatcagactgcagctgtacgtgttcgtggtgagatgcatcgcctaccccttcaacgccaagcagcccaccgacatggccagaagacagcagaagctgaacaagcagcagctgcagctgctgaaggagagattccaggccttcctgaacggcgagacccagatcgtggccgacgaggccttctgcaacgccgtgagaagctactacgaggtgttcctgaagagcgacagagtggccagaatggtgcagagcggcggctgcagcgccaacgacttcagagaggtgttcaagaagaacatcgagaagagagtgagaagcctgcccgagatcgacggcctgagcaaggagaccgtgctgagcagctggatcgccaagtacgacgccatctacagaggcgaggaggacctgtgcaagcagcccaacagaatggccctgagcgccgtgagcgagctgatcctgagcaaggagcagctgtacgagatgttccagcagatcctgggcatcaagaagctggagcaccagctgctgtacaacgcctgccagctggacaacgccgacgagcaggccgcccagatcagaagagagctggacggcagactgcagctggccgacaagatggccaaggagagaaagttccccaagttcatcgccaaggacatggagaacatgtacatcgaggagctgagaagcagcgtgaacctgctgatggccaacctggagagcctgcccgtgagcaagggcggccccgagttcaagctgcagaagctgaagagaagccagaacagcgccttcctggacatcggcgacgagaacgagatccagctgagcaagagcgacgtggtgctgagcttcaccctggagatcgtgatcatggaggtgcagggcctgaagagcgtggcccccaacagaatcgtgtactgcaccatggaggtggagggcgagaagctgcagaccgaccaggccgaggccagcagaccccagtggggcacccagggcgacttcaccaccacccaccccagacccgtggtgaaggtgaagctgttcaccgagagcaccggcgtgctggccctggaggacaaggagctgggcagagtgatcctgtaccccaccagcaacagcagcaagagcgccgagctgcacagaatggtggtgcccaagaacagccaggacagcgacctgaagatcaagctggccgtgagaatggacaagcccgcccacatgaagcacagcggctacctgtacgccctgggccagaaggtgtggaagagatggaagaagagatacttcgtgctggtgcaggtgagccagtacaccttcgccatgtgcagctacagagagaagaagagcgagccccaggagctgatgcagctggagggctacaccgtggactacaccgacccccaccccggcctgcagggcggctgcatgttcttcaacgccgtgaaggagggcgacaccgtgatcttcgccagcgacgacgagcaggacagaatcctgtgggtgcaggccatgtacagagccaccggccagagctacaagcccgtgcccgccatccagacccagaagctgaaccccaagggcggcaccctgcacgccgacgcccagctgagcggcaaggacgccgacagattccagaagcacggcatggacgagttcatcagcgccaacccctgcaagctggaccacgccttcctgttcagaatcctgcagagacagaccctggaccacagactgaacgacagctacagctgcctgggctggttcagccccggccaggtgttcgtgctggacgagtactgcgccagatacggcgtgagaggctgccacagacacctgtgctacctggccgagctgatggagcacagcgagaacggcgccgtgatcgaccccaccctgctgcactacagcttcgccttctgcgccagccacgtgcacggcaacagacccgacggcatcggcaccgtgagcgtggaggagaaggagagattcgaggagatcaaggagagactgagcagcctgctggagaaccagatcagccacttcagatactgcttccccttcggcagacccgagggcgccctgaaggccaccctgagcctgctggagagagtgctgatgaaggacatcgccacccccatccccgccgaggaggtgaagaaggtggtgagaaagtgcctggagaaggccgccctgatcaactacaccagactgaccgagtacgccaagatcgaggagaccatgaaccaggccagccccgccagaaagctggaggagatcctgcacctggccgagctgtgcatcgaggtgctgcagcagaacgaggagcaccacgccgagggcagagaggccttcgcctggtggcccgacctgctggccgagcacgccgagaagttctgggccctgttcaccgtggacatggacaccgccctggaggcccagccccaggacagctgggacagcttccccctgttccagctgctgaacaacttcctgagaaacgacaccctgctgtgcaacggcaagttccacaagcacctgcaggagatcttcgtgcccctggtggtgagatacgtggacctgatggagagcagcatcgcccagagcatccacagaggcttcgagcaggagacctggcagcccgtgaagaacatcgccaacagcctgcccaacgtggccctgcccaaggtgcccagcctgcccctgaacctgccccagatccccaacatcagcaccgccagctggatgcccagcctgtacgagagcaccaacggcagcgccaccagcgaggacctgttctggaagctggacgccctgcagatgttcgtgttcgacctgcactggcccgagcaggagttcgcccaccacctggagcagagactgaagctgatggccagcgacatgctggaggcctgcgtgaagagaaccagaaccgccttcgagctgaagctgcagaaggccagcaagaccaccgacctgagaatccccgccagcgtgtgcaccatgttcaacgtgctggtggacgccaagaagcagagcaccaagctgtgcgccctggacggcggccaggagcagcagtaccacagcaagatcgacgacctgatcgacaacagcgtgaaggagatcatcagcctgctggtgagcaagttcgtgagcgtgctggagggcgtgctgagcaagctgagcagatacgacgagggcaccttcttcagcagcatcctgagcttcaccgtgaaggccgccgccaagtacgtggacgtgcccaagcccggcatggacctggccgacacctacatcatgttcgtgagacagaaccaggacatcctgagagagaaggtgaacgaggagatgtacatcgagaagctgttcgaccagtggtacagcagcagcatgaaggtgatctgcgtgtggctgaccgacagactggacctgcagctgcacatctaccagctgaagaccctgatcaagatcgtgaagaagacctacagagacttcagactgcagggcgtgctggagggcaccctgaacagcaagacctacgacaccgtgcacagaagactgaccgtggaggaggccaccgccagcgtgagcgagggcggcggcctgcagggcatcaccatgaaggacagcgacgaggaggaggagggctag

SEQ ID NO: 74838 - DNA, 1473 bp, Artificial Sequence
  Description of Artificial Sequence: Synthetic coding sequence
tgatacaccagactgaccgagtacgccaagatcgagggccccgccgagaaggagaccgagaccatgaaccaggccagccccgccagaaagctggaggagatcctgcacctggccgagctgtgcatcgaggtgctgcagcagaacgaggagcaccacgccgagggcagagaggccttcgcctggtggcccgacctgctggccgagcacgccgagaagttctgggccctgttcaccgtggacatggacaccgccctggaggcccagccccaggacagctgggacagcttccccctgttccagctgctgaacaacttcctgagaaacgacaccctgctgtgcaacggcaagttccacaagcacctgcaggagatcttcgtgcccctggtggtgagatacgtggacctgatggagagcagcatcgcccagagcatccacagaggcttcgagcaggagacctggcagcccgtgaagaacatcgccaacagcctgcccaacgtggccctgcccaaggtgcccagcctgcccctgaacctgccccagatccccaacatcagcaccgccagctggatgcccagcctgtacgagagcaccaacggcagcgccaccagcgaggacctgttctggaagctggacgccctgcagatgttcgtgttcgacctgcactggcccgagcaggagttcgcccaccacctggagcagagactgaagctgatggccagcgacatgctggaggcctgcgtgaagagaaccagaaccgccttcgagctgaagctgcagaaggccagcaagaccaccgacctgagaatccccgccagcgtgtgcaccatgttcaacgtgctggtggacgccaagaagcagagcaccaagctgtgcgccctggacggcggccaggagcagcagtaccacagcaagatcgacgacctgatcgacaacagcgtgaaggagatcatcagcctgctggtgagcaagttcgtgagcgtgctggagggcgtgctgagcaagctgagcagatacgacgagggcaccttcttcagcagcatcctgagcttcaccgtgaaggccgccgccaagtacgtggacgtgcccaagcccggcatggacctggccgacacctacatcatgttcgtgagacagaaccaggacatcctgagagagaaggtgaacgaggagatgtacatcgagaagctgttcgaccagtggtacagcagcagcatgaaggtgatctgcgtgtggctgaccgacagactggacctgcagctgcacatctaccagctgaagaccctgatcaagatcgtgaagaagacctacagagacttcagactgcagggcgtgctggagggcaccctgaacagcaagacctacgacaccgtgcacagaagactgaccgtggaggaggccaccgccagcgtgagcgagggcggcggcctgcagggcatcaccatgaaggacagcgacgaggaggaggagggctag

SEQ ID NO: 74839 - DNA, 3669 bp, Artificial Sequence
  Description of Artificial Sequence: Synthetic coding sequence
atgctggaccccagcagcagcgaggaggagagcgacgagggcctggaggaggagagcagagacgtgctggtggccgccggcagcagccagagagccccccccgcccccaccagagagggccagctggacgacgagcaggagagaagaatcagactgcagctgtacgtgttcgtggtgagatgcatcgcctaccccttcaacgccaagcagcccaccgacatggccagaagacagcagaagctgaacaagcagcagctgcagctgctgaaggagagattccaggccttcctgaacggcgagacccagatcgtggccgacgaggccttctgcaacgccgtgagaagctactacgaggtgttcctgaagagcgacagagtggccagaatggtgcagagcggcggctgcagcgccaacgacttcagagaggtgttcaagaagaacatcgagaagagagtgagaagcctgcccgagatcgacggcctgagcaaggagaccgtgctgagcagctggatcgccaagtacgacgccatctacagaggcgaggaggacctgtgcaagcagcccaacagaatggccctgagcgccgtgagcgagctgatcctgagcaaggagcagctgtacgagatgttccagcagatcctgggcatcaagaagctggagcaccagctgctgtacaacgcctgccagctggacaacgccgacgagcaggccgcccagatcagaagagagctggacggcagactgcagctggccgacaagatggccaaggagagaaagttccccaagttcatcgccaaggacatggagaacatgtacatcgaggagctgagaagcagcgtgaacctgctgatggccaacctggagagcctgcccgtgagcaagggcggccccgagttcaagctgcagaagctgaagagaagccagaacagcgccttcctggacatcggcgacgagaacgagatccagctgagcaagagcgacgtggtgctgagcttcaccctggagatcgtgatcatggaggtgcagggcctgaagagcgtggcccccaacagaatcgtgtactgcaccatggaggtggagggcgagaagctgcagaccgaccaggccgaggccagcagaccccagtggggcacccagggcgacttcaccaccacccaccccagacccgtggtgaaggtgaagctgttcaccgagagcaccggcgtgctggccctggaggacaaggagctgggcagagtgatcctgtaccccaccagcaacagcagcaagagcgccgagctgcacagaatggtggtgcccaagaacagccaggacagcgacctgaagatcaagctggccgtgagaatggacaagcccgcccacatgaagcacagcggctacctgtacgccctgggccagaaggtgtggaagagatggaagaagagatacttcgtgctggtgcaggtgagccagtacaccttcgccatgtgcagctacagagagaagaagagcgagccccaggagctgatgcagctggagggctacaccgtggactacaccgacccccaccccggcctgcagggcggctgcatgttcttcaacgccgtgaaggagggcgacaccgtgatcttcgccagcgacgacgagcaggacagaatcctgtgggtgcaggccatgtacagagccaccggccagagctacaagcccgtgcccgccatccagacccagaagctgaaccccaagggcggcaccctgcacgccgacgcccagctgtacgccgacagattccagaagcacggcatggacgagttcatcagcgccaacccctgcaagctggaccacgccttcctgttcagaatcctgcagagacagaccctggaccacagactgaacgacagctacagctgcctgggctggttcagccccggccaggtgttcgtgctggacgagtactgcgccagatacggcgtgagaggctgccacagacacctgtgctacctggccgagctgatggagcacagcgagaacggcgccgtgatcgaccccaccctgctgcactacagcttcgccttctgcgccagccacgtgcacggcaacagacccgacggcatcggcaccgtgagcgtggaggagaaggagagattcgaggagatcaaggagagactgagcagcctgctggagaaccagatcagccacttcagatactgcttccccttcggcagacccgagggcgccctgaaggccaccctgagcctgctggagagagtgctgatgaaggacatcgccacccccatccccgccgaggaggtgaagaaggtggtgagaaagtgcctggagaaggccgccctgatcaactacaccagactgaccgagtacgccaagatcgaggagaccatgaaccaggccagccccgccagaaagctggaggagatcctgcacctggccgagctgtgcatcgaggtgctgcagcagaacgaggagcaccacgccgaggccttcgcctggtggcccgacctgctggccgagcacgccgagaagttctgggccctgttcaccgtggacatggacaccgccctggaggcccagccccaggacagctgggacagcttccccctgttccagctgctgaacaacttcctgagaaacgacaccctgctgtgcaacggcaagttccacaagcacctgcaggagatcttcgtgcccctggtggtgagatacgtggacctgatggagagcagcatcgcccagagcatccacagaggcttcgagcaggagacctggcagcccgtgaacaacggcagcgccaccagcgaggacctgttctggaagctggacgccctgcagatgttcgtgttcgacctgcactggcccgagcaggagttcgcccaccacctggagcagagactgaagctgatggccagcgacatgctggaggcctgcgtgaagagaaccagaaccgccttcgagctgaagctgcagaaggccagcaagaccaccgacctgagaatccccgccagcgtgtgcaccatgttcaacgtgctggtggacgccaagaagcagagcaccaagctgtgcgccctggacggcggccaggagttcggcagccagtggcagcagtaccacagcaagatcgacgacctgatcgacaacagcgtgaaggagatcatcagcctgctggtgagcaagttcgtgagcgtgctggagggcgtgctgagcaagctgagcagatacgacgagggcaccttcttcagcagcatcctgagcttcaccgtgaaggccgccgccaagtacgtggacgtgcccaagcccggcatggacctggccgacacctacatcatgttcgtgagacagaaccaggacatcctgagagagaaggtgaacgaggagatgtacatcgagaagctgttcgaccagtggtacagcagcagcatgaaggtgatctgcgtgtggctgaccgacagactggacctgcagctgcacatctaccagctgaagaccctgatcaagatcgtgaagaagacctacagagacttcagactgcagggcgtgctggagggcaccctgaacagcaagacctacgacaccgtgcacagaagactgaccgtggaggaggccaccgccagcgtgagcgagggcggcggcctgcagggcatcaccatgaaggacagcgacgaggaggaggagggctag

SEQ ID NO: 74840 - DNA, 2367 bp, Artificial Sequence
  Description of Artificial Sequence: Synthetic coding sequence
atgaccatccaccagttcctgctgctgttcctgttctgggtgtgcctgccccacttctgcagccccgagatcatgttcagaagaacccccgtgccccagcagagaatcctgagcagcagagtgcccagaagcgacggcaagatcctgcacagacagaagagaggctggatgtggaaccagttcttcctgctggaggagtacaccggcagcgactaccagtacgtgggcaagctgcacagcgaccaggacaagggcgacggcagcctgaagtacatcctgagcggcgacggcgccggcaccctgttcatcatcgacgagaagaccggcgacatccacgccaccagaagaatcgacagagaggagaaggccttctacaccctgagagcccaggccatcaacagaagaaccctgagacccgtggagcccgagagcgagttcgtgatcaagatccacgacatcaacgacaacgagcccaccttccccgaggagatctacaccgccagcgtgcccgagatgagcgtggtgggcaccagcgtggtgcaggtgaccgccaccgacgccgacgaccccagctacggcaacagcgccagagtgatctacagcatcctgcagggccagccctacttcagcgtggagcccgagaccggcatcatcagaaccgccctgcccaacatgaacagagagaacagagagcagtaccaggtggtgatccaggccaaggacatgggcggccagatgggcggcctgagcggcaccaccaccgtgaacatcaccctgaccgacgtgaacgacaacccccccagattcccccagaacaccatccacctgagagtgctggagagcagccccgtgggcaccgccatcggcagcgtgaaggccaccgacgccgacaccggcaagaacgccgaggtggagtacagaatcatcgacggcgacggcaccgacatgttcgacatcgtgaccgagaaggacacccaggagggcatcatcaccgtgaagaagcccctggactacgagagcagaagactgtacaccctgaaggtggaggccgagaacacccacgtggaccccagattctactacctgggccccttcaaggacaccaccatcgtgaagatcagcatcgaggacgtggacgagccccccgtgttcagcagaagcagctacctgttcgaggtgcacgaggacatcgaggtgggcaccatcatcggcaccgtgatggccagagaccccgacagcatcagcagccccatcagattcagcctggacagacacaccgacctggacagaatcttcaacatccacagcggcaacggcagcctgtacaccagcaagcccctggacagagagctgagccagtggcacaacctgaccgtgatcgccgccgagatcaacaaccccaaggagaccaccagagtggccgtgttcgtgagaatcctggacgtgaacgacaacgccccccagttcgccgtgttctacgacaccttcgtgtgcgagaacgccagacccggccagctgatccagaccatcagcgccgtggacaaggacgaccccctgggcggccagaagttcttcttcagcctggccgccgtgaaccccaacttcaccgtgcaggacaacgaggacaacaccgccagaatcctgaccagaaagaacggcttcaacagacacgagatcagcacctacctgctgcccgtggtgatcagcgacaacgactaccccatccagagcagcaccggcaccctgaccatcagagtgtgcgcctgcgacagccagggcaacatgcagagctgcagcgccgaggccctgctgctgcccgccggcctgagcaccggcgccctgatcgccatcctgctgtgcatcatcatcctgctggtgatcgtggtgctgttcgccgccctgaagagacagagaaagaaggagcccctgatcctgagcaaggaggacatcagagacaacatcgtgagctacaacgacgagggcggcggcgaggaggacacccaggccttcgacatcggcaccctgagaaaccccgccgccatcgaggagaagaagctgagaagagacatcatccccgagaccctgttcatccccagaagaacccccaccgcccccgacaacaccgacgtgagagacttcatcaacgagagactgaaggagcacgacctggaccccaccgcccccccctacgacagcctggccacctacgcctacgagggcaacgacagcatcgccgagagcctgagcagcctggagagcggcaccaccgagggcgaccagaactacgactacctgagagagtggggccccagattcaacaagctggccgagatgtacggcggcggcgagagcgacaaggacagctag

SEQ ID NO: 74841 - DNA, 2385 bp, Artificial Sequence
  Description of Artificial Sequence: Synthetic coding sequence
atgctgaccagaaactgcctgagcctgctgctgtgggtgctgttcgacggcggcctgctgacccccctgcagccccagccccagcagaccctggccaccgagcccagagagaacgtgatccacctgcccggccagagaagccacttccagagagtgaagagaggctgggtgtggaaccagttcttcgtgctggaggagtacgtgggcagcgagccccagtacgtgggcaagctgcacagcgacctggacaagggcgagggcaccgtgaagtacaccctgagcggcgacggcgccggcaccgtgttcaccatcgacgagaccaccggcgacatccacgccatcagaagcctggacagagaggagaagcccttctacaccctgagagcccaggccgtggacatcgagaccagaaagcccctggagcccgagagcgagttcatcatcaaggtgcaggacatcaacgacaacgagcccaagttcctggacggcccctacgtggccaccgtgcccgagatgagccccgtgggcgcctacgtgctgcaggtgaaggccaccgacgccgacgaccccacctacggcaacagcgccagagtggtgtacagcatcctgcagggccagccctacttcagcatcgaccccaagaccggcgtgatcagaaccgccctgcccaacatggacagagaggtgaaggagcagtaccaggtgctgatccaggccaaggacatgggcggccagctgggcggcctggccggcaccaccatcgtgaacatcaccctgaccgacgtgaacgacaacccccccagattccccaagagcatcttccacctgaaggtgcccgagagcagccccatcggcagcgccatcggcagaatcagagccgtggaccccgacttcggccagaacgccgagatcgagtacaacatcgtgcccggcgacggcggcaacctgttcgacatcgtgaccgacgaggacacccaggagggcgtgatcaagctgaagaagcccctggacttcgagaccaagaaggcctacaccttcaaggtggaggccagcaacctgcacctggaccacagattccacagcgccggccccttcaaggacaccgccaccgtgaagatcagcgtgctggacgtggacgagccccccgtgttcagcaagcccctgtacaccatggaggtgtacgaggacacccccgtgggcaccatcatcggcgccgtgaccgcccaggacctggacgtgggcagcagcgccgtgagatacttcatcgactggaagagcgacggcgacagctacttcaccatcgacggcaacgagggcaccatcgccaccaacgagctgctggacagagagagcaccgcccagtacaacttcagcatcatcgccagcaaggtgagcaaccccctgctgaccagcaaggtgaacatcctgatcaacgtgctggacgtgaacgagttcccccccgagatcagcgtgccctacgagaccgccgtgtgcgagaacgccaagcccggccagatcatccagatcgtgagcgccgccgacagagacctgagccccgccggccagcagttcagcttcagactgagccccgaggccgccatcaagcccaacttcaccgtgagagacttcagaaacaacaccgccggcatcgagaccagaagaaacggctacagcagaagacagcaggagctgtacttcctgcccgtggtgatcgaggacagcagctaccccgtgcagagcagcaccaacaccatgaccatcagagtgtgcagatgcgacagcgacggcaccatcctgagctgcaacgtggaggccatcttcctgcccgtgggcctgagcaccggcgccctgatcgccatcctgctgtgcatcgtgatcctgctggccatcgtggtgctgtacgtggccctgagaagacagaagaagaaggacaccctgatgaccagcaaggaggacatcagagacaacgtgatccactacgacgacgagggcggcggcgaggaggacacccaggccttcgacatcggcgccctgagaaaccccaaggtgatcgaggagaacaagatcagaagagacatcaagcccgacagcctgtgcctgcccagacagagaccccccatggaggacaacaccgacatcagagacttcatccaccagagactgcaggagaacgacgtggaccccaccgcccccccctacgacagcctggccacctacgcctacgagggcagcggcagcgtggccgagagcctgagcagcatcgacagcctgaccaccgaggccgaccaggactacgactacctgaccgactggggccccagattcaaggtgctggccgacatgttcggcgaggaggagagctacaaccccgacaaggtgacctag

SEQ ID NO: 74842 - DNA, 2385 bp, Artificial Sequence; identical to SEQ ID NO: 74841
  Description of Artificial Sequence: Synthetic coding sequence

SEQ ID NO: 74843 - DNA, 2265 bp, Artificial Sequence
  Description of Artificial Sequence: Synthetic coding sequence
atgctgaccagaaactgcctgagcctgctgctgtgggtgctgttcgacggcggcctgctgacccccctgcagccccagccccagcagaccctggccaccgagcccagagagaacgtgatccacctgcccggccagagaagccacttccagagagtgaagagaggctgggtgtggaaccagttcttcgtgctggaggagtacgtgggcagcgagccccagtacgtgggcaagctgcacagcgacctggacaagggcgagggcaccgtgaagtacaccctgagcggcgacggcgccggcaccgtgttcaccatcgacgagaccaccggcgacatccacgccatcagaagcctggacagagaggagaagcccttctacaccctgagagcccaggccgtggacatcgagaccagaaagcccctggagcccgagagcgagttcatcatcaaggtgcaggacatcaacgacaacgagcccaagttcctggacggcccctacgtggccaccgtgcccgagatgagccccgtgggcgtgatcagaaccgccctgcccaacatggacagagaggtgaaggagcagtaccaggtgctgatccaggccaaggacatgggcggccagctgggcggcctggccggcaccaccatcgtgaacatcaccctgaccgacgtgaacgacaacccccccagattccccaagagcatcttccacctgaaggtgcccgagagcagccccatcggcagcgccatcggcagaatcagagccgtggaccccgacttcggccagaacgccgagatcgagtacaacatcgtgcccggcgacggcggcaacctgttcgacatcgtgaccgacgaggacacccaggagggcgtgatcaagctgaagaagcccctggacttcgagaccaagaaggcctacaccttcaaggtggaggccagcaacctgcacctggaccacagattccacagcgccggccccttcaaggacaccgccaccgtgaagatcagcgtgctggacgtggacgagccccccgtgttcagcaagcccctgtacaccatggaggtgtacgaggacacccccgtgggcaccatcatcggcgccgtgaccgcccaggacctggacgtgggcagcagcgccgtgagatacttcatcgactggaagagcgacggcgacagctacttcaccatcgacggcaacgagggcaccatcgccaccaacgagctgctggacagagagagcaccgcccagtacaacttcagcatcatcgccagcaaggtgagcaaccccctgctgaccagcaaggtgaacatcctgatcaacgtgctggacgtgaacgagttcccccccgagatcagcgtgccctacgagaccgccgtgtgcgagaacgccaagcccggccagatcatccagatcgtgagcgccgccgacagagacctgagccccgccggccagcagttcagcttcagactgagccccgaggccgccatcaagcccaacttcaccgtgagagacttcagaaacaacaccgccggcatcgagaccagaagaaacggctacagcagaagacagcaggagctgtacttcctgcccgtggtgatcgaggacagcagctaccccgtgcagagcagcaccaacaccatgaccatcagagtgtgcagatgcgacagcgacggcaccatcctgagctgcaacgtggaggccatcttcctgcccgtgggcctgagcaccggcgccctgatcgccatcctgctgtgcatcgtgatcctgctggccatcgtggtgctgtacgtggccctgagaagacagaagaagaaggacaccctgatgaccagcaaggaggacatcagagacaacgtgatccactacgacgacgagggcggcggcgaggaggacacccaggccttcgacatcggcgccctgagaaaccccaaggtgatcgaggagaacaagatcagaagagacatcaagcccgacagcctgtgcctgcccagacagagaccccccatggaggacaacaccgacatcagagacttcatccaccagagactgcaggagaacgacgtggaccccaccgcccccccctacgacagcctggccacctacgcctacgagggcagcggcagcgtggccgagagcctgagcagcatcgacagcctgaccaccgaggccgaccaggactacgactacctgaccgactggggccccagattcaaggtgctggccgacatgttcggcgaggaggagagctacaaccccgacaaggtgacctag

SEQ ID NO: 74844 - DNA, 2445 bp, Artificial Sequence
  Description of Artificial Sequence: Synthetic coding sequence
atggacgccgccttcctgctggtgctgggcctgctggcccagagcctgtgcctgagcctgggcgtgcccggctggagaagacccaccaccctgtacccctggagaagagcccccgccctgagcagagtgagaagagcctgggtgatcccccccatcagcgtgagcgagaaccacaagagactgccctaccccctggtgcagatcaagagcgacaagcagcagctgggcagcgtgatctacagcatccagggccccggcgtggacgaggagcccagaggcgtgttcagcatcgacaagttcaccggcaaggtgttcctgaacgccatgctggacagagagaagaccgacagattcagactgagagccttcgccctggacctgggcggcagcaccctggaggaccccaccgacctggagatcgtggtggtggaccagaacgacaacagacccgccttcctgcaggaggccttcaccggcagagtgctggagggcgccgtgcccggcacctacgtgaccagagccgaggccaccgacgccgacgaccccgagaccgacaacgccgccctgagattcagcatcctgcagcagggcagccccgagctgttcagcatcgacgagctgaccggcgagatcagaaccgtgcaggtgggcctggacagagaggtggtggccgtgtacaacctgaccctgcaggtggccgacatgagcggcgacggcctgaccgccaccgccagcgccatcatcaccctggacgacatcaacgacaacgcccccgagttcaccagagacgagttcttcatggaggccatcgaggccgtgagcggcgtggacgtgggcagactggaggtggaggacagagacctgcccggcagccccaactgggtggccagattcaccatcctggagggcgaccccgacggccagttcaccatcagaaccgaccccaagaccaacgagggcgtgctgagcatcgtgaaggccctggactacgagagctgcgagcactacgagctgaaggtgagcgtgcagaacgaggcccccctgcaggccgccgccctgagagccgagagaggccaggccaaggtgagagtgcacgtgcaggacaccaacgagccccccgtgttccaggagaaccccctgagaaccagcctggccgagggcgccccccccggcaccctggtggccaccttcagcgccagagaccccgacaccgagcagctgcagagactgagctacagcaaggactacgaccccgaggactggctgcaggtggacgccgccaccggcagaatccagacccagcacgtgctgagccccgccagccccttcctgaagggcggctggtacagagccatcgtgctggcccaggacgacgccagccagcccagaaccgccaccggcaccctgagcatcgagatcctggaggtgaacgaccacgcccccgtgctggccccccccccccccggcagcctgtgcagcgagccccaccagggccccggcctgctgctgggcgccaccgacgaggacctgcccccccacggcgcccccttccacttccagctgagccccagactgcccgagctgggcagaaactggagcctgagccaggtgaacgtgagccacgccagactgagacccagacaccaggtgcccgagggcctgcacagactgagcctgctgctgagagacagcggccagcccccccagcagagagagcagcccctgaacgtgaccgtgtgcagatgcggcaaggacggcgtgtgcctgcccggcgccgccgccctgctggccggcggcaccggcctgagcctgggcgccctggtgatcgtgctggccagcgccctgctgctgctggtgctggtgctgctggtggccctgagagccagattctggaagcagagcagaggcaagggcctgctgcacggcccccaggacgacctgagagacaacgtgctgaactacgacgagcagggcggcggcgaggaggaccaggacgcctacgacatcagccagctgagacaccccaccgccctgagcctgcccctgggccccccccccctgagaagagacgccccccagggcagactgcacccccagccccccagagtgctgcccaccagccccctggacatcgccgacttcatcaacgacggcctggaggccgccgacagcgaccccagcgtgcccccctacgacaccgccctgatctacgactacgagggcgacggcagcgtggccggcaccctgagcagcatcctgagcagccagggcgacgaggaccaggactacgactacctgagagactggggccccagattcgccagactggccgacatgtacggccacccctgcggcctggagtacggcgccagatgggaccaccaggccagagagggcctgagccccggcgccctgctgcccagacacagaggcagaaccgcctag

SEQ ID NO: 74845 - DNA, 2373 bp, Artificial Sequence
  Description of Artificial Sequence: Synthetic coding sequence
atggtgcccgcctggctgtggctgctgtgcgtgagcgtgccccaggccctgcccaaggcccagcccgccgagctgagcgtggaggtgcccgagaactacggcggcaacttccccctgtacctgaccaagctgcccctgcccagagagggcgccgagggccagatcgtgctgagcggcgacagcggcaaggccaccgagggccccttcgccatggaccccgacagcggcttcctgctggtgaccagagccctggacagagaggagcaggccgagtaccagctgcaggtgaccctggagatgcaggacggccacgtgctgtggggcccccagcccgtgctggtgcacgtgaaggacgagaacgaccaggtgccccacttcagccaggccatctacagagccagactgagcagaggcaccagacccggcatccccttcctgttcctggaggccagcgacagagacgagcccggcaccgccaacagcgacctgagattccacatcctgagccaggcccccgcccagcccagccccgacatgttccagctggagcccagactgggcgccctggccctgagccccaagggcagcaccagcctggaccacgccctggagagaacctaccagctgctggtgcaggtgaaggacatgggcgaccaggccagcggccaccaggccaccgccaccgtggaggtgagcatcatcgagagcacctgggtgagcctggagcccatccacctggccgagaacctgaaggtgctgtacccccaccacatggcccaggtgcactggagcggcggcgacgtgcactaccacctggagagccacccccccggccccttcgaggtgaacgccgagggcaacctgtacgtgaccagagagctggacagagaggcccaggccgagtacctgctgcaggtgagagcccagaacagccacggcgaggactacgccgcccccctggagctgcacgtgctggtgatggacgagaacgacaacgtgcccatctgcccccccagagaccccaccgtgagcatccccgagctgagcccccccggcaccgaggtgaccagactgagcgccgaggacgccgacgcccccggcagccccaacagccacgtggtgtaccagctgctgagccccgagcccgaggacggcgtggagggcagagccttccaggtggaccccaccagcggcagcgtgaccctgggcgtgctgcccctgagagccggccagaacatcctgctgctggtgctggccatggacctggccggcgccgagggcggcttcagcagcacctgcgaggtggaggtggccgtgaccgacatcaacgaccacgcccccgagttcatcaccagccagatcggccccatcagcctgcccgaggacgtggagcccggcaccctggtggccatgctgaccgccatcgacgccgacctggagcccgccttcagactgatggacttcgccatcgagagaggcgacaccgagggcaccttcggcctggactgggagcccgacagcggccacgtgagactgagactgtgcaagaacctgagctacgaggccgcccccagccacgaggtggtggtggtggtgcagagcgtggccaagctggtgggccccggccccggccccggcgccaccgccaccgtgaccgtgctggtggagagagtgatgcccccccccaagctggaccaggagagctacgaggccagcgtgcccatcagcgcccccgccggcagcttcctgctgaccatccagcccagcgaccccatcagcagaaccctgagattcagcctggtgaacgacagcgagggctggctgtgcatcgagaagttcagcggcgaggtgcacaccgcccagagcctgcagggcgcccagcccggcgacacctacaccgtgctggtggaggcccaggacaccgaccacggcctgatcgtgagcggccccagcaaggaccccgacctggccagcggccacggcccctacagcttcaccctgggccccaaccccaccgtgcagagagactggagactgcagaccctgaacggcagccacgcctacctgaccctggccctgcactgggtggagcccagagagcacatcatccccgtggtggtgagccacaacgcccagatgtggcagctgctggtgagagtgatcgtgtgcagatgcaacgtggagggccagtgcatgagaaaggtgggcagaatgaagggcatgcccaccaagctgagcgccgtgggcatcctggtgggcaccctggtggccatcggcatcttcctgatcctgatcttcacccactggaccatgagcagaaagaaggaccccgaccagcccgccgacagcgtgcccctgaaggccaccgtgtag

SEQ ID NO: 74846 - DNA, 2199 bp, Artificial Sequence
  Description of Artificial Sequence: Synthetic coding sequence
atggtgcccgcctggctgtggctgctgtgcgtgagcgtgccccaggccctgcccaaggcccagcccgccgagctgagcgtggaggtgcccgagaactacggcggcaacttccccctgtacctgaccaagctgcccctgcccagagagggcgccgagggccagatcgtgctgagcggcgacagcggcaaggccaccgagggccccttcgccatggaccccgacagcggcttcctgctggtgaccagagccctggacagagaggagcaggccgagtaccagctgcaggtgaccctggagatgcaggacggccacgtgctgtggggcccccagcccgtgctggtgcacgtgaaggacgagaacgaccaggccagcggccaccaggccaccgccaccgtggaggtgagcatcatcgagagcacctgggtgagcctggagcccatccacctggccgagaacctgaaggtgctgtacccccaccacatggcccaggtgcactggagcggcggcgacgtgcactaccacctggagagccacccccccggccccttcgaggtgaacgccgagggcaacctgtacgtgaccagagagctggacagagaggcccaggccgagtacctgctgcaggtgagagcccagaacagccacggcgaggactacgccgcccccctggagctgcacgtgctggtgatggacgagaacgacaacgtgcccatctgcccccccagagaccccaccgtgagcatccccgagctgagcccccccggcaccgaggtgaccagactgagcgccgaggacgccgacgcccccggcagccccaacagccacgtggtgtaccagctgctgagccccgagcccgaggacggcgtggagggcagagccttccaggtggaccccaccagcggcagcgtgaccctgggcgtgctgcccctgagagccggccagaacatcctgctgctggtgctggccatggacctggccggcgccgagggcggcttcagcagcacctgcgaggtggaggtggccgtgaccgacatcaacgaccacgcccccgagttcatcaccagccagatcggccccatcagcctgcccgaggacgtggagcccggcaccctggtggccatgctgaccgccatcgacgccgacctggagcccgccttcagactgatggacttcgccatcgagagaggcgacaccgagggcaccttcggcctggactgggagcccgacagcggccacgtgagactgagactgtgcaagaacctgagctacgaggccgcccccagccacgaggtggtggtggtggtgcagagcgtggccaagctggtgggccccggccccggccccggcgccaccgccaccgtgaccgtgctggtggagagagtgatgcccccccccaagctggaccaggagagctacgaggccagcgtgcccatcagcgcccccgccggcagcttcctgctgaccatccagcccagcgaccccatcagcagaaccctgagattcagcctggtgaacgacagcgagggctggctgtgcatcgagaagttcagcggcgaggtgcacaccgcccagagcctgcagggcgcccagcccggcgacacctacaccgtgctggtggaggcccaggacaccgacgagcccagactgagcgccagcgcccccctggtgatccacttcctgaaggccccccccgcccccgccctgaccctggcccccgtgcccagccagtacctgtgcacccccagacaggaccacggcctgatcgtgagcggccccagcaaggaccccgacctggccagcggccacggcccctacagcttcaccctgggccccaaccccaccgtgcagagagactggagactgcagaccctgaacggcagccacgcctacctgaccctggccctgcactgggtggagcccagagagcacatcatccccgtggtggtgagccacaacgcccagatgtggcagctgctggtgagagtgatcgtgtgcagatgcaacgtggagggccagtgcatgagaaaggtgggcagaatgaagggcatgcccaccaagctgagcgccgtgggcatcctggtgggcaccctggtggccatcggcatcttcctgatcctgatcttcacccactggaccatgagcagaaagaaggaccccgaccagcccgccgacagcgtgcccctgaaggccaccgtgtag

SEQ ID NO: 74847 - DNA, 2490 bp, Artificial Sequence
  Description of Artificial Sequence: Synthetic coding sequence
atggtgcccgcctggctgtggctgctgtgcgtgagcgtgccccaggccctgcccaaggcccagcccgccgagctgagcgtggaggtgcccgagaactacggcggcaacttccccctgtacctgaccaagctgcccctgcccagagagggcgccgagggccagatcgtgctgagcggcgacagcggcaaggccaccgagggccccttcgccatggaccccgacagcggcttcctgctggtgaccagagccctggacagagaggagcaggccgagtaccagctgcaggtgaccctggagatgcaggacggccacgtgctgtggggcccccagcccgtgctggtgcacgtgaaggacgagaacgaccaggtgccccacttcagccaggccatctacagagccagactgagcagaggcaccagacccggcatccccttcctgttcctggaggccagcgacagagacgagcccggcaccgccaacagcgacctgagattccacatcctgagccaggcccccgcccagcccagccccgacatgttccagctggagcccagactgggcgccctggccctgagccccaagggcagcaccagcctggaccacgccctggagagaacctaccagctgctggtgcaggtgaaggacatgggcgaccaggccagcggccaccaggccaccgccaccgtggaggtgagcatcatcgagagcacctgggtgagcctggagcccatccacctggccgagaacctgaaggtgctgtacccccaccacatggcccaggtgcactggagcggcggcgacgtgcactaccacctggagagccacccccccggccccttcgaggtgaacgccgagggcaacctgtacgtgaccagagagctggacagagaggcccaggccgagtacctgctgcaggtgagagcccagaacagccacggcgaggactacgccgcccccctggagctgcacgtgctggtgatggacgagaacgacaacgtgcccatctgcccccccagagaccccaccgtgagcatccccgagctgagcccccccggcaccgaggtgaccagactgagcgccgaggacgccgacgcccccggcagccccaacagccacgtggtgtaccagctgctgagccccgagcccgaggacggcgtggagggcagagccttccaggtggaccccaccagcggcagcgtgaccctgggcgtgctgcccctgagagccggccagaacatcctgctgctggtgctggccatggacctggccggcgccgagggcggcttcagcagcacctgcgaggtggaggtggccgtgaccgacatcaacgaccacgcccccgagttcatcaccagccagatcggccccatcagcctgcccgaggacgtggagcccggcaccctggtggccatgctgaccgccatcgacgccgacctggagcccgccttcagactgatggacttcgccatcgagagaggcgacaccgagggcaccttcggcctggactgggagcccgacagcggccacgtgagactgagactgtgcaagaacctgagctacgaggccgcccccagccacgaggtggtggtggtggtgcagagcgtggccaagctggtgggccccggccccggccccggcgccaccgccaccgtgaccgtgctggtggagagagtgatgcccccccccaagctggaccaggagagctacgaggccagcgtgcccatcagcgcccccgccggcagcttcctgctgaccatccagcccagcgaccccatcagcagaaccctgagattcagcctggtgaacgacagcgagggctggctgtgcatcgagaagttcagcggcgaggtgcacaccgcccagagcctgcagggcgcccagcccggcgacacctacaccgtgctggtggaggcccaggacaccgacgagcccagactgagcgccagcgcccccctggtgatccacttcctgaaggccccccccgcccccgccctgaccctggcccccgtgcccagccagtacctgtgcacccccagacaggaccacggcctgatcgtgagcggccccagcaaggaccccgacctggccagcggccacggcccctacagcttcaccctgggccccaaccccaccgtgcagagagactggagactgcagaccctgaacggcagccacgcctacctgaccctggccctgcactgggtggagcccagagagcacatcatccccgtggtggtgagccacaacgcccagatgtggcagctgctggtgagagtgatcgtgtgcagatgcaacgtggagggccagtgcatgagaaaggtgggcagaatgaagggcatgcccaccaagctgagcgccgtgggcatcctggtgggcaccctggtggccatcggcatcttcctgatcctgatcttcacccactggaccatgagcagaaagaaggaccccgaccagcccgccgacagcgtgcccctgaaggccaccgtgtag

SEQ ID NO: 74848 - DNA, 2424 bp, Artificial Sequence
  Description of Artificial Sequence: Synthetic coding sequence
atggtgcccgcctggctgtggctgctgtgcgtgagcgtgccccaggccctgcccaaggcccagcccgccgagctgagcgtggaggtgcccgagaactacggcggcaacttccccctgtacctgaccaagctgcccctgcccagagagggcgccgagggccagatcgtgctgagcggcgacagcggcaaggccaccgagggccccttcgccatggaccccgacagcggcttcctgctggtgaccagagccctggacagagaggagcaggccgagtaccagctgcaggtgaccctggagatgcaggacggccacgtgctgtggggcccccagcccgtgctggtgcacgtgaaggacgagaacgaccaggtgccccacttcagccaggccatctacagagccagactgagcagaggcaccagacccggcatccccttcctgttcctggaggccagcgacagagacgagcccggcaccgccaacagcgacctgagattccacatcctgagccaggcccccgcccagcccagccccgacatgttccagctggagcccagactgggcgccctggccctgagccccaagggcagcaccagcctggaccacgccctggagagaacctaccagctgctggtgcaggtgaaggacatgggcgaccaggccagcggccaccaggccaccgccaccgtggaggtgagcatcatcgagagcacctgggtgagcctggagcccatccacctggccgagaacctgaaggtgctgtacccccaccacatggcccaggtgcactggagcggcggcgacgtgcactaccacctggagagccacccccccggccccttcgaggtgaacgccgagggcaacctgtacgtgaccagagagctggacagagaggcccaggccgagtacctgctgcaggtgagagcccagaacagccacggcgaggactacgccgcccccctggagctgcacgtgctggtgatggacgagaacgacaacgtgcccatctgcccccccagagaccccaccgtgagcatccccgagctgagcccccccggcaccgaggtgaccagactgagcgccgaggacgccgacgcccccggcagccccaacagccacgtggtgtaccagctgctgagccccgagcccgaggacggcgtggagggcagagccttccaggtggaccccaccagcggcagcgtgaccctgggcgtgctgcccctgagagccggccagaacatcctgctgctggtgctggccatggacctggccggcgccgagggcggcttcagcagcacctgcgaggtggaggtggccgtgaccgacatcaacgaccacgcccccgagttcatcaccagccagatcggccccatcagcctgcccgaggacgtggagcccggcaccctggtggccatgctgaccgccatcgacgccgacctggagcccgccttcagactgatggacttcgccatcgagagaggcgacaccgagggcaccttcggcctggactgggagcccgacagcggccacgtgagactgagactgtgcaagaacctgagctacgaggccgcccccagccacgaggtggtggtggtggtgcagagcgtggccaagctggtgggccccggccccggccccggcgccaccgccaccgtgaccgtgctggtggagagagtgatgcccccccccaagctggaccaggagagctacgaggccagcgtgcccatcagcgcccccgccggcagcttcctgctgaccatccagcccagcgaccccatcagcagaaccctgagattcagcctggtgaacgacagcgagggctggctgtgcatcgagaagttcagcggcgaggtgcacaccgcccagagcctgcagggcgcccagcccggcgacacctacaccgtgctggtggaggcccaggacaccgccctgaccctggcccccgtgcccagccagtacctgtgcacccccagacaggaccacggcctgatcgtgagcggccccagcaaggaccccgacctggccagcggccacggcccctacagcttcaccctgggccccaaccccaccgtgcagagagactggagactgcagaccctgaacggcagccacgcctacctgaccctggccctgcactgggtggagcccagagagcacatcatccccgtggtggtgagccacaacgcccagatgtggcagctgctggtgagagtgatcgtgtgcagatgcaacgtggagggccagtgcatgagaaaggtgggcagaatgaagggcatgcccaccaagctgagcgccgtgggcatcctggtgggcaccctggtggccatcggcatcttcctgatcctgatcttcacccactggaccatgagcagaaagaaggaccccgaccagcccgccgacagcgtgcccctgaaggccaccgtgtag

SEQ ID NO: 74849 - DNA, 2382 bp, Artificial Sequence
  Description of Artificial Sequence: Synthetic coding sequence
atggtgcccgcctggctgtggctgctgtgcgtgagcgtgccccaggccctgcccaaggcccagcccgccgagctgagcgtggaggtgcccgagaactacggcggcaacttccccctgtacctgaccaagctgcccctgcccagagagggcgccgagggccagatcgtgctgagcggcgagcaggccgagatgcaggacggccacgtgctgtggggcccccagcccgtgctggtgcacgtgaaggacgagaacgaccaggtgccccacttcagccaggccatctacagagccagactgagcagaggcaccagacccggcatccccttcctgttcctggaggccagcgacagagacgagcccggcaccgccaacagcgacctgagattccacatcctgagccaggcccccgcccagcccagccccgacatgttccagctggagcccagactgggcgccctggccctgagccccaagggcagcaccagcctggaccacgccctggagagaacctaccagctgctggtgcaggtgaaggacatgggcgaccaggccagcggccaccaggccaccgccaccgtggaggtgagcatcatcgagagcacctgggtgagcctggagcccatccacctggccgagaacctgaaggtgctgtacccccaccacatggcccaggtgcactggagcggcggcgacgtgcactaccacctggagagccacccccccggccccttcgaggtgaacgccgagggcaacctgtacgtgaccagagagctggacagagaggcccaggccgagtacctgctgcaggtgagagcccagaacagccacggcgaggactacgccgcccccctggagctgcacgtgctggtgatggacgagaacgacaacgtgcccatctgcccccccagagaccccaccgtgagcatccccgagctgagcccccccggcaccgaggtgaccagactgagcgccgaggacgccgacgcccccggcagccccaacagccacgtggtgtaccagctgctgagccccgagcccgaggacggcgtggagggcagagccttccaggtggaccccaccagcggcagcgtgaccctgggcgtgctgcccctgagagccggccagaacatcctgctgctggtgctggccatggacctggccggcgccgagggcggcttcagcagcacctgcgaggtggaggtggccgtgaccgacatcaacgaccacgcccccgagttcatcaccagccagatcggccccatcagcctgcccgaggacgtggagcccggcaccctggtggccatgctgaccgccatcgacgccgacctggagcccgccttcagactgatggacttcgccatcgagagaggcgacaccgagggcaccttcggcctggactgggagcccgacagcggccacgtgagactgagactgtgcaagaacctgagctacgaggccgcccccagccacgaggtggtggtggtggtgcagagcgtggccaagctggtgggccccggccccggccccggcgccaccgccaccgtgaccgtgctggtggagagagtgatgcccccccccaagctggaccaggagagctacgaggccagcgtgcccatcagcgcccccgccggcagcttcctgctgaccatccagcccagcgaccccatcagcagaaccctgagattcagcctggtgaacgacagcgagggctggctgtgcatcgagaagttcagcggcgaggtgcacaccgcccagagcctgcagggcgcccagcccggcgacacctacaccgtgctggtggaggcccaggacaccgacgagcccagactgagcgccagcgcccccctggtgatccacttcctgaaggccccccccgcccccgccctgaccctggcccccgtgcccagccagtacctgtgcacccccagacaggaccacggcctgatcgtgagcggccccagcaaggaccccgacctggccagcggccacggcccctacagcttcaccctgggccccaaccccaccgtgcagagagactggagactgcagaccctgaacggcagccacgcctacctgaccctggccctgcactgggtggagcccagagagcacatcatccccgtggtggtgagccacaacgcccagatgtggcagctgctggtgagagtgatcgtgtgcagatgcaacgtggagggccagtgcatgagaaaggtgggcagaatgaagggcatgcccaccaagctgagcgccgtgggcatcctggtgggcaccctggtggccatcggcatcttcctgatcctgatcttcacccactggaccatgagcagaaagaaggaccccgaccagcccgccgacagcgtgcccctgaaggccaccgtgtag

SEQ ID NO: 74850 - DNA, 2499 bp, Artificial Sequence
  Description of Artificial Sequence: Synthetic coding sequence
atgatcctgcaggcccacctgcacagcctgtgcctgctgatgctgtacctggccaccggctacggccaggagggcaagttcagcggccccctgaagcccatgaccttcagcatctacgagggccaggagcccagccagatcatcttccagttcaaggccaacccccccgccgtgaccttcgagctgaccggcgagaccgacaacatcttcgtgatcgagagagagggcctgctgtactacaacagagccctggacagagagaccagaagcacccacaacctgcaggtggccgccctggacgccaacggcatcatcgtggagggccccgtgcccatcaccatcaaggtgaaggacatcaacgacaacagacccaccttcctgcagagcaagtacgagggcagcgtgagacagaacagcagacccggcaagcccttcctgtacgtgaacgccaccgacctggacgaccccgccacccccaacggccagctgtactaccagatcgtgatccagctgcccatgatcaacaacgtgatgtacttccagatcaacaacaagaccggcgccatcagcctgaccagagagggcagccaggagctgaaccccgccaagaaccccagctacaacctggtgatcagcgtgaaggacatgggcggccagagcgagaacagcttcagcgacaccaccagcgtggacatcatcgtgaccgagaacatctggaaggcccccaagcccgtggagatggtggagaacagcaccgacccccaccccatcaagatcacccaggtgagatggaacgaccccggcgcccagtacagcctggtggacaaggagaagctgcccagattccccttcagcatcgaccaggagggcgacatctacgtgacccagcccctggacagagaggagaaggacgcctacgtgttctacgccgtggccaaggacgagtacggcaagcccctgagctaccccctggagatccacgtgaaggtgaaggacatcaacgacaacccccccacctgccccagccccgtgaccgtgttcgaggtgcaggagaacgagagactgggcaacagcatcggcaccctgaccgcccacgacagagacgaggagaacaccgccaacagcttcctgaactacagaatcgtggagcagacccccaagctgcccatggacggcctgttcctgatccagacctacgccggcatgctgcagctggccaagcagagcctgaagaagcaggacaccccccagtacaacctgaccatcgaggtgagcgacaaggacttcaagaccctgtgcttcgtgcagatcaacgtgatcgacatcaacgaccagatccccatcttcgagaagagcgactacggcaacctgaccctggccgaggacaccaacatcggcagcaccatcctgaccatccaggccaccgacgccgacgagcccttcaccggcagcagcaagatcctgtaccacatcatcaagggcgacagcgagggcagactgggcgtggacaccgacccccacaccaacaccggctacgtgatcatcaagaagcccctggacttcgagaccgccgccgtgagcaacatcgtgttcaaggccgagaaccccgagcccctggtgttcggcgtgaagtacaacgccagcagcttcgccaagttcaccctgatcgtgaccgacgtgaacgaggccccccagttcagccagcacgtgttccaggccaaggtgagcgaggacgtggccatcggcaccaaggtgggcaacgtgaccgccaaggaccccgagggcctggacatcagctacagcctgagaggcgacaccagaggctggctgaagatcgaccacgtgaccggcgagatcttcagcgtggcccccctggacagagaggccggcagcccctacagagtgcaggtggtggccaccgaggtgggcggcagcagcctgagcagcgtgagcgagttccacctgatcctgatggacgtgaacgacaacccccccagactggccaaggactacaccggcctgttcttctgccaccccctgagcgcccccggcagcctgatcttcgaggccaccgacgacgaccagcacctgttcagaggcccccacttcaccttcagcctgggcagcggcagcctgcagaacgactgggaggtgagcaagatcaacggcacccacgccagactgagcaccagacacaccgagttcgaggagagagagtacgtggtgctgatcagaatcaacgacggcggcagaccccccctggagggcatcgtgagcctgcccgtgaccttctgcagctgcgtggagggcagctgcttcagacccgccggccaccagaccggcatccccaccgtgggcatggccgtgggcatcctgctgaccaccctgctggtgatcggcatcatcctggccgtggtgttcatcagaatcaagaaggacaagggcaaggacaacgtggagagcgcccaggccagcgaggtgaagcccctgagaagctag

SEQ ID NO: 74851 - DNA, 2499 bp, Artificial Sequence; identical to SEQ ID NO: 74850
  Description of Artificial Sequence: Synthetic coding sequence

SEQ ID NO: 74852 - DNA, 444 bp, Artificial Sequence
  Description of Artificial Sequence: Synthetic coding sequence
atgatcctgcaggcccacctgcacagcctgtgcctgctgatgctgtacctggccaccggctacggccaggagggcaagttcagcggccccctgaagcccatgaccttcagcatctacgagggccaggagcccagccagatcatcttccagttcaaggccaacccccccgccgtgaccttcgagctgaccggcgagaccgacaacatcttcgtgatcgagagagagggcctgctgtactacaacagagccctggacagagagaccagaagcacccacaacctgcaggtggccgccctggacgccaacggcatcatcgtggagggccccgtgcccatcaccatcaaggtgaaggacatcaacgacaacagacccaccttcctgcagagcaagtacgagggcagcgtgagacagaacagcagacccggcaagcccttcctgtactag

SEQ ID NO: 74853 - DNA, 2373 bp, Artificial Sequence
  Description of Artificial Sequence: Synthetic coding sequence
atgaagatcaccagcaccagctgcatctgccccgtgctggtgtgcctgtgcttcgtgcagagatgctacggcaccgcccaccacagcagcatcaaggtgatgagaaaccagaccaagcacatcgagggcgagaccgaggtgcaccacagacccaagagaggctgggtgtggaaccagttcttcgtgctggaggagcacatgggccccgacccccagtacgtgggcaagctgcacagcaacagcgacaagggcgacggcagcgtgaagtacatcctgaccggcgagggcgccggcaccatcttcatcatcgacgacaccaccggcgacatccacagcaccaagagcctggacagagagcagaagacccactacgtgctgcacgcccaggccatcgacagaagaaccaacaagcccctggagcccgagagcgagttcatcatcaaggtgcaggacatcaacgacaacgcccccaagttcaccgacggcccctacatcgtgaccgtgcccgagatgagcgacatgggcaccagcgtgctgcaggtgaccgccaccgacgccgacgaccccacctacggcaacagcgccagagtggtgtacagcatcctgcagggccagccctacttcagcgtggaccccaagaccggcgtgatcagaaccgccctgcacaacatggacagagaggccagagagcactacagcgtggtgatccaggccaaggacatggccggccaggtgggcggcctgagcggcagcaccaccgtgaacatcaccctgaccgacgtgaacgacaacccccccagattcccccagaagcactaccagctgtacgtgcccgagagcgcccaggtgggcagcgccgtgggcaagatcaaggccaacgacgccgacaccggcagcaacgccgacatgacctacagcatcatcaacggcgacggcatgggcatcttcagcatcagcaccgacaaggagaccagagagggcatcctgagcctgaagaagcccctgaactacgagaagaagaagagctacaccctgaacatcgagggcgccaacacccacctggacttcagattcagccacctgggccccttcaaggacgccaccatgctgaagatcatcgtgggcgacgtggacgagccccccctgttcagcatgcccagctacctgatggaggtgtacgagaacgccaagatcggcaccgtggtgggcaccgtgctggcccaggaccccgacagcaccaacagcctggtgagatacttcatcaactacaacgtggaggacgacagattcttcaacatcgacgccaacaccggcaccatcagaaccaccaaggtgctggacagagaggagaccccctggtacaacatcaccgtgaccgccagcgagatcgacaaccccgacctgctgagccacgtgaccgtgggcatcagagtgctggacgtgaacgacaacccccccgagctggccagagagtacgacatcatcgtgtgcgagaacagcaagcccggccaggtgatccacaccatcagcgccaccgacaaggacgacttcgccaacggccccagattcaacttcttcctggacgagagactgcccgtgaaccccaacttcaccctgaaggacaacgaggacaacaccgccagcatcctgaccagaagaagaagattcagcagaaccgtgcaggacgtgtactacctgcccatcatgatcagcgacggcggcatccccagcctgagcagcagcagcaccctgaccatcagagtgtgcgcctgcgagagagacggcagagtgagaacctgccacgccgaggccttcctgagcagcgccggcctgagcaccggcgccctgatcgccatcctgctgtgcgtgctgatcctgctggccatcgtggtgctgttcatcaccctgagaagaagcaagaaggagcccctgatcatcagcgaggaggacgtgagagagaacgtggtgacctacgacgacgagggcggcggcgaggaggacaccgaggccttcgacatcaccgccctgagaaaccccagcgccgccgaggagctgaagtacagaagagacatcagacccgaggtgaagctgacccccagacaccagaccagcagcaccctggagagcatcgacgtgcaggagttcatcaagcagagactggccgaggccgacctggaccccagcgtgcccccctacgacagcctgcagacctacgcctacgagggccagagaagcgaggccggcagcatcagcagcctggacagcgccaccacccagagcgaccaggactaccactacctgggcgactggggccccgagttcaagaagctggccgagctgtacggcgagatcgagagcgagagaaccacctag

SEQ ID NO: 74854 - DNA, 2373 bp, Artificial Sequence; identical to SEQ ID NO: 74853
  Description of Artificial Sequence: Synthetic coding sequence

SEQ ID NO: 74855 - DNA, 1725 bp, Artificial Sequence
  Description of Artificial Sequence: Synthetic coding sequence
atgaagatcaccagcaccagctgcatctgccccgtgctggtgtgcctgtgcttcgtgcagagatgctacggcaccgcccaccacagcagcatcaaggtgatgagaaaccagaccaagcacatcgagggcgagaccgaggtgcaccacagacccaagagaggctgggtgtggaaccagttcttcgtgctggaggagcacatgggccccgacccccagtacgtgggcaagctgcacagcaacagcgacaagggcgacggcagcgtgaagtacatcctgaccggcgagggcgccggcaccatcttcatcatcgacgacaccaccggcgacatccacagcaccaagagcctggacagagagcagaagacccactacgtgctgcacgcccaggccatcgacagaagaaccaacaagcccctggagcccgagagcgagttcatcatcaaggtgcaggacatcaacgacaacgcccccaagttcaccgacggcccctacatcgtgaccgtgcccgagatgagcgacatgggcaccagcgtgctgcaggtgaccgccaccgacgccgacgaccccacctacggcaacagcgccagagtggtgtacagcatcctgcagggccagccctacttcagcgtggaccccaagaccggcgtgatcagaaccgccctgcacaacatggacagagaggccagagagcactacagcgtggtgatccaggccaaggacatggccggccaggtgggcggcctgagcggcagcaccaccgtgaacatcaccctgaccgacgtgaacgacaacccccccagattcccccagaagcactaccagctgtacgtgcccgagagcgcccaggtgggcagcgccgtgggcaagatcaaggccaacgacgccgacaccggcagcaacgccgacatgacctacagcatcatcaacggcgacggcatgggcatcttcagcatcagcaccgacaaggagaccagagagggcatcctgagcctgaagaagcccctgaactacgagaagaagaagagctacaccctgaacatcgagggcgccaacacccacctggacttcagattcagccacctgggccccttcaaggacgccaccatgctgaagatcatcgtgggcgacgtggacgagccccccctgttcagcatgcccagctacctgatggaggtgtacgagaacgccaagatcggcaccgtggtgggcaccgtgctggcccaggaccccgacagcaccaacagcctggtgagatacttcatcaactacaacgtggaggacgacagattcttcaacatcgacgccaacaccggcaccatcagaaccaccaaggtgctggacagagaggagaccccctggtacaacatcaccgtgaccgccagcgagatcgacaaccccgacctgctgagccacgtgaccgtgggcatcagagtgctggacgtgaacgacaacccccccgagctggccagagagtacgacatcatcgtgtgcgagaacagcaagcccggccaggtgatccacaccatcagcgccaccgacaaggacgacttcgccaacggccccagattcaacttcttcctggacgagagactgcccgtgaaccccaacttcaccctgaaggacaacgaggccgccgcccccagccccagcggcttcgtgcacgccagagagatgggcgtgtgcggccccgccatgcagaagcccagctgccccagactggtgtag

SEQ ID NO: 74856 - DNA, 2373 bp, Artificial Sequence; identical to SEQ ID NO: 74853
  Description of Artificial Sequence: Synthetic coding sequence

SEQ ID NO: 74857 - DNA, 2373 bp, Artificial Sequence; identical to SEQ ID NO: 74853
  Description of Artificial Sequence: Synthetic coding sequence

SEQ ID NO: 74858 - DNA, 2319 bp, Artificial Sequence
  Description of Artificial Sequence: Synthetic coding sequence
atgaactgctacctgctgctgagattcatgctgggcatccccctgctgtggccctgcctgggcgccaccgagaacagccagaccaagaaggtgaagcagcccgtgagaagccacctgagagtgaagagaggctgggtgtggaaccagttcttcgtgcccgaggagatgaacaccaccagccaccacatcggccagctgagaagcgacctggacaacggcaacaacagcttccagtacaagctgctgggcgccggcgccggcagcaccttcatcatcgacgagagaaccggcgacatctacgccatccagaagctggacagagaggagagaagcctgtacatcctgagagcccaggtgatcgacatcgccaccggcagagccgtggagcccgagagcgagttcgtgatcaaggtgagcgacatcaacgacaacgagcccaagttcctggacgagccctacgaggccatcgtgcccgagatgagccccgagggcaccctggtgatccaggtgaccgccagcgacgccgacgaccccagcagcggcaacaacgccagactgctgtacagcctgctgcagggccagccctacttcagcgtggagcccaccaccggcgtgatcagaatcagcagcaagatggacagagagctgcaggacgagtactgggtgatcatccaggccaaggacatgatcggccagcccggcgccctgagcggcaccaccagcgtgctgatcaagctgagcgacgtgaacgacaacaagcccatcttcaaggagagcctgtacagactgaccgtgagcgagagcgcccccaccggcaccagcatcggcaccatcatggcctacgacaacgacatcggcgagaacgccgagatggactacagcatcgaggaggacgacagccagaccttcgacatcatcaccaaccacgagacccaggagggcatcgtgatcctgaagaagaaggtggacttcgagcaccagaaccactacggcatcagagccaaggtgaagaaccaccacgtgcccgagcagctgatgaagtaccacaccgaggccagcaccaccttcatcaagatccaggtggaggacgtggacgagccccccctgttcctgctgccctactacgtgttcgaggtgttcgaggagaccccccagggcagcttcgtgggcgtggtgagcgccaccgaccccgacaacagaaagagccccatcagatacagcatcaccagaagcaaggtgttcaacatcaacgacaacggcaccatcaccaccagcaacagcctggacagagagatcagcgcctggtacaacctgagcatcaccgccaccgagaagtacaacatcgagcagatcagcagcatccccctgtacgtgcaggtgctgaacatcaacgaccacgcccccgagttcagccagtactacgagacctacgtgtgcgagaacgccggcagcggccaggtgatccagaccatcagcgccgtggacagagacgagagcatcgaggagcaccacttctacttcaacctgagcgtggaggacaccaacaacagcagcttcaccatcatcgacaaccaggacaacaccgccgtgatcctgaccaacagaaccggcttcaacctgcaggaggagcccgtgttctacatcagcatcctgatcgccgacaacggcatccccagcctgaccagcaccaacaccctgaccatccacgtgtgcgactgcggcgacagcggcagcacccagacctgccagtaccaggagctggtgctgagcatgggcttcaagaccgaggtgatcatcgccatcctgatctgcatcatgatcatcttcggcttcatcttcctgaccctgggcctgaagcagagaagaaagcagatcctgttccccgagaagagcgaggacttcagagagaacatcttccagtacgacgacgagggcggcggcgaggaggacaccgaggccttcgacatcgccgagctgagaagcagcaccatcatgagagagagaaagaccagaaagaccaccagcgccgagatcagaagcctgtacagacagagcctgcaggtgggccccgacagcgccatcttcagaaagttcatcctggagaagctggaggaggccaacaccgacccctgcgccccccccttcgacagcctgcagacctacgccttcgagggcaccggcagcctggccggcagcctgagcagcctggagagcgccgtgagcgaccaggacgagagctacgactacctgaacgagctgggccccagattcaagagactggcctgcatgttcggcagcgccgtgcagagcaacaactag

SEQ ID NO: 74859 - DNA, 1173 bp, Artificial Sequence
  Description of Artificial Sequence: Synthetic coding sequence
atgaacaccaccagccaccacatcggccagctgagaagcgacctggacaacggcaacaacagcttccagtacaagctgctgggcgccggcgccggcagcaccttcatcatcgacgagagaaccggcgacatctacgccatccagaagctggacagagaggagagaagcctgtacatcctgagagcccaggtgatcgacatcgccaccggcagagccgtggagcccgagagcgagttcgtgatcaaggtgagcgacatcaacgacaacgagcccaagttcctggacgagccctacgaggccatcgtgcccgagatgagccccgagggcaccctggtgatccaggtgaccgccagcgacgccgacgaccccagcagcggcaacaacgccagactgctgtacagcctgctgcagggccagccctacttcagcgtggagcccaccaccggcgtgatcagaatcagcagcaagatggacagagagctgcaggacgagtactgggtgatcatccaggccaaggacatgatcggccagcccggcgccctgagcggcaccaccagcgtgctgatcaagctgagcgacgtgaacgacaacaagcccatcttcaaggagagcctgtacagactgaccgtgagcgagagcgcccccaccggcaccagcatcggcaccatcatggcctacgacaacgacatcggcgagaacgccgagatggactacagcatcgaggaggacgacagccagaccttcgacatcatcaccaaccacgagacccaggagggcatcgtgatcctgaagaagaaggtggacttcgagcaccagaaccactacggcatcagagccaaggtgaagaaccaccacgtgcccgagcagctgatgaagtaccacaccgaggccagcaccaccttcatcaagatccaggtggaggacgtggacgagccccccctgttcctgctgccctactacgtgttcgaggtgttcgaggagaccccccagggcagcttcgtgggcgtggtgagcgccaccgaccccgacaacagaaagagccccatcagatacagcatcaccagaagcaaggtgttcaacatcaacgacaacggcaccatcaccaccagcaacagcctggacagagagatcagcgcctggtacaacctgagcatcaccgccaccgagaagtag

SEQ ID NO: 74860 - DNA, 1473 bp, Artificial Sequence
  Description of Artificial Sequence: Synthetic coding sequence
atgaactgctacctgctgctgagattcatgctgggcatccccctgctgtggccctgcctgggcgccaccgagaacagccagaccaagaaggtgaagcagcccgtgagaagccacctgagagtgaagagaggctgggtgtggaaccagttcttcgtgcccgaggagatgaacaccaccagccaccacatcggccagctgagaagcgacctggacaacggcaacaacagcttccagtacaagctgctgggcgccggcgccggcagcaccttcatcatcgacgagagaaccggcgacatctacgccatccagaagctggacagagaggagagaagcctgtacatcctgagagcccaggtgatcgacatcgccaccggcagagccgtggagcccgagagcgagttcgtgatcaaggtgagcgacatcaacgacaacgagcccaagttcctggacgagccctacgaggccatcgtgcccgagatgagccccgagggcaccctggtgatccaggtgaccgccagcgacgccgacgaccccagcagcggcaacaacgccagactgctgtacagcctgctgcagggccagccctacttcagcgtggagcccaccaccggcgtgatcagaatcagcagcaagatggacagagagctgcaggacgagtactgggtgatcatccaggccaaggacatgatcggccagcccggcgccctgagcggcaccaccagcgtgctgatcaagctgagcgacgtgaacgacaacaagcccatcttcaaggagagcctgtacagactgaccgtgagcgagagcgcccccaccggcaccagcatcggcaccatcatggcctacgacaacgacatcggcgagaacgccgagatggactacagcatcgaggaggacgacagccagaccttcgacatcatcaccaaccacgagacccaggagggcatcgtgatcctgaagaagaaggtggacttcgagcaccagaaccactacggcatcagagccaaggtgaagaaccaccacgtgcccgagcagctgatgaagtaccacaccgaggccagcaccaccttcatcaagatccaggtggaggacgtggacgagccccccctgttcctgctgccctactacgtgttcgaggtgttcgaggagaccccccagggcagcttcgtgggcgtggtgagcgccaccgaccccgacaacagaaagagccccatcagatacagcatcaccagaagcaaggtgttcaacatcaacgacaacggcaccatcaccaccagcaacagcctggacagagagatcagcgcctggtacaacctgagcatcaccgccaccgagaagtacaacatcgagcagatcagcagcatccccctgtacgtgcaggtgctgaacatcaacgaccacgcccccgagttcagccagtactacgagacctacgtgtgcgagaacgccggcagcggccagggcctgttcttctag

SEQ ID NO: 74861 - DNA, 2406 bp, Artificial Sequence
  Description of Artificial Sequence: Synthetic coding sequence
atgtggaccagcggcagaatgagcaacgccaagaactggctgggcctgggcatgagcctgtacttctggggcctgatggacctgaccaccaccgtgctgagcgacacccccaccccccagggcgagctggaggccctgctgagcgacaagccccagagccaccagagaaccaagagaagctgggtgtggaaccagttcttcgtgctggaggagtacaccggcaccgaccccctgtacgtgggcaagctgcacagcgacatggacagaggcgacggcagcatcaagtacatcctgagcggcgagggcgccggcatcgtgttcaccatcgacgacaccaccggcgacatccacgccatccagagactggacagagaggagagagcccagtacaccctgagagcccaggccctggacagaagaaccggcagacccatggagcccgagagcgagttcatcatcaagatccaggacatcaacgacaacgagcccaagttcctggacggcccctacgtggccaccgtgcccgagatgagccccgtgggcaccagcgtgatccaggtgaccgccaccgacgccgacgaccccacctacggcaacagcgccagagtggtgtacagcatcctgcagggccagccctacttcagcgtggacagcaagaccggcgtgatcagaaccgccctgatgaacatggacagagaggccaaggagtactacgaggtgatcatccaggccaaggacatgggcggccagctgggcggcctggccggcaccaccaccgtgaacatcaccctgagcgacgtgaacgacaacccccccagattcccccagaagcactaccagatgagcgtgctggagagcgcccccatcagcagcaccgtgggcagagtgttcgccaaggacctggacgagggcatcaacgccgagatgaagtacaccatcgtggacggcgacggcgccgacgccttcgacatcagcaccgaccccaacttccaggtgggcatcatcaccgtgaagaagcccctgagcttcgagagcaagaagagctacaccctgaaggtggagggcgccaacccccacctggagatgagattcctgaacctgggccccttccaggacaccaccaccgtgcacatcagcgtggaggacgtggacgagccccccgtgttcgagcccggcttctacttcgtggaggtgcccgaggacgtggccatcggcaccaccatccagatcatcagcgccaaggaccccgacgtgaccaacaacagcatcagatacagcatcgacagaagcagcgaccccggcagattcttctacgtggacatcaccaccggcgccctgatgaccgccagacccctggacagagaggagttcagctggcacaacatcaccgtgctggccatggagatgaacaaccccagccaggtgggcagcgtgcccgtgaccatcaaggtgctggacgtgaacgacaacgcccccgagttccccagattctacgaggccttcgtgtgcgagaacgccaaggccggccagctgatccagaccgtgagcgccgtggaccaggacgaccccagaaacggccagcacttctactacagcctggcccccgaggccgccaacaaccccaacttcaccatcagagacaaccaggacaacaccgccagaatcctgaccagaagaagcggcttcagacagcaggagcagagcgtgttccacctgcccatcctgatcgccgacagcggccagcccgtgctgagcagcaccggcaccctgaccatccaggtgtgcagctgcgacgacgacggccacgtgatgagctgcagccccgaggcctacatgctgcccgtgagcctgagcagaggcgccctgatcgccatcctggcctgcatcttcgtgctgctggtgctggtgctgctgatcctgagcatgagaagacacagaaagcagccctacatcatcgacgacgaggagaacatccacgagaacatcgtgagatacgacgacgagggcggcggcgaggaggacaccgaggccttcgacatcgccgccatgtggaaccccagagaggcccaggccggcgccgcccccaagaccagacaggacatgctgcccgagatcgagagcctgagcagatacgtgccccagacctgcgccgtgaacagcaccgtgcacagctacgtgctggccaagctgtacgaggccgacatggacctgtgggccccccccttcgacagcctgcagacctacatgttcgagggcgacggcagcgtggccggcagcctgagcagcctgcagagcgccaccagcgacagcgagcagagcttcgacttcctgaccgactggggccccagattcagaaagctggccgagctgtacggcgccagcgagggccccgcccccctgtggtag

SEQ ID NO: 74862 - DNA, 2406 bp, Artificial Sequence; identical to SEQ ID NO: 74861
  Description of Artificial Sequence: Synthetic coding sequence

SEQ ID NO: 74863 - DNA, 2406 bp, Artificial Sequence; identical to SEQ ID NO: 74861
  Description of Artificial Sequence: Synthetic coding sequence

SEQ ID NO: 74864 - DNA, 2487 bp, Artificial Sequence
  Description of Artificial Sequence: Synthetic coding sequence
atgagacccagacccgagggcagaggcctgagagccggcgtggccctgagccccgccctgctgctgctgctgctgctgccccccccccccaccctgctgggcagactgtgggccgccggcacccccagccccagcgcccccggcgccagacaggacggcgccctgggcgccggcagagtgaagagaggctgggtgtggaaccagttcttcgtggtggaggagtacaccggcaccgagcccctgtacgtgggcaagatccacagcgacagcgacgagggcgacggcgccatcaagtacaccatcagcggcgagggcgccggcaccatcttcctgatcgacgagctgaccggcgacatccacgccatggagagactggacagagagcagaagaccttctacaccctgagagcccaggccagagacagagccaccaacagactgctggagcccgagagcgagttcatcatcaaggtgcaggacatcaacgacagcgagcccagattcctgcacggcccctacatcggcagcgtggccgagctgagccccaccggcaccagcgtgatgcaggtgatggccagcgacgccgacgaccccacctacggcagcagcgccagactggtgtacagcgtgctggacggcgagcaccacttcaccgtggaccccaagaccggcgtgatcagaaccgccgtgcccgacctggacagagagagccaggagagatacgaggtggtgatccaggccaccgacatggccggccagctgggcggcctgagcggcagcaccaccgtgaccatcgtggtgaccgacgtgaacgacaacccccccagattcccccagaagatgtaccagttcagcatccaggagagcgcccccatcggcaccgccgtgggcagagtgaaggccgaggacagcgacgtgggcgagaacaccgacatgacctaccacctgaaggacgagagcagcagcggcggcgacgtgttcaaggtgaccaccgacagcgacacccaggaggccatcatcgtggtgcagaagagactggacttcgagagccagcccgtgcacaccgtgatcctggaggccctgaacaagttcgtggaccccagattcgccgacctgggcaccttcagagaccaggccatcgtgagagtggccgtgaccgacgtggacgagccccccgagttcagaccccccagcggcctgctggaggtgcaggaggacgcccaggtgggcagcctggtgggcgtggtgaccgccagagaccccgacgccgccaacagacccgtgagatacgccatcgacagagagagcgacctggaccagatcttcgacatcgacgccgacaccggcgccatcgtgaccggcaagggcctggacagagagaccgccggctggcacaacatcaccgtgctggccatggaggccgacaaccacgcccagctgagcagagccagcctgagaatcagaatcctggacgtgaacgacaacccccccgagctggccaccccctacgaggccgccgtgtgcgaggacgccaagcccggccagctgatccagaccatcagcgtggtggacagagacgagccccagggcggccacagattctacttcagactggtgcccgaggcccccagcaacccccacttcagcctgctggacatccaggacaacaccgccgccgtgcacacccagcacgtgggcttcaacagacaggagcaggacgtgttcttcctgcccatcctggtggtggacagcggcccccccaccctgagcagcaccggcaccctgaccatcagaatctgcggctgcgacagcagcggcaccatccagagctgcaacaccaccgccttcgtgatggccgccagcctgagccccggcgccctgatcgccctgctggtgtgcgtgctgatcctggtggtgctggtgctgctgatcctgaccctgagaagacaccacaagagccacctgagcagcgacgaggacgaggacatgagagacaacgtgatcaagtacaacgacgagggcggcggcgagcaggacaccgaggcctacgacatgagcgccctgagaagcctgtacgacttcggcgagctgaagggcggcgacggcggcggcagcgccggcggcggcgccggcggcggcagcggcggcggcgccggcagccccccccaggcccacctgcccagcgagagacacagcctgccccagggcccccccagccccgagcccgacttcagcgtgttcagagacttcatcagcagaaaggtggccctggccgacggcgacctgagcgtgcccccctacgacgccttccagacctacgccttcgagggcgccgacagccccgccgccagcctgagcagcctgcacagcggcagcagcggcagcgagcaggacttcgcctacctgagcagctggggccccagattcagacccctggccgccctgtacgccggccacagaggcgacgacgaggcccaggccagctag

SEQ ID NO: 74865 - DNA, 2487 bp, Artificial Sequence; identical to SEQ ID NO: 74864
  Description of Artificial Sequence: Synthetic coding sequence

SEQ ID NO: 74866 - DNA, 2490 bp, Artificial Sequence
  Description of Artificial Sequence: Synthetic coding sequence
atgggcctgcccagaggccccctggccagcctgctgctgctgcaggtgtgctggctgcagtgcgccgccagcgagccctgcagagccgtgttcagagaggccgaggtgaccctggaggccggcggcgccgagcaggagcccggccaggccctgggcaaggtgttcatgggctgccccggccaggagcccgccctgttcagcaccgacaacgacgacttcaccgtgagaaacggcgagaccgtgcaggagagaagaagcctgaaggagagaaaccccctgaagatcttccccagcaagagaatcctgagaagacacaagagagactgggtggtggcccccatcagcgtgcccgagaacggcaagggccccttcccccagagactgaaccagctgaagagcaacaaggacagagacaccaagatcttctacagcatcaccggccccggcgccgacagcccccccgagggcgtgttcgccgtggagaaggagaccggctggctgctgctgaacaagcccctggacagagaggagatcgccaagtacgagctgttcggccacgccgtgagcgagaacggcgccagcgtggaggaccccatgaacatcagcatcatcgtgaccgaccagaacgaccacaagcccaagttcacccaggacaccttcagaggcagcgtgctggagggcgtgctgcccggcaccagcgtgatgcaggtgaccgccaccgacgaggacgacgccatctacacctacaacggcgtggtggcctacagcatccacagccaggagcccaaggacccccacgacctgatgttcaccatccacagaagcaccggcaccatcagcgtgatcagcagcggcctggacagagagaaggtgcccgagtacaccctgaccatccaggccaccgacatggacggcgacggcagcaccaccaccgccgtggccgtggtggagatcctggacgccaacgacaacgcccccatgttcgacccccagaagtacgaggcccacgtgcccgagaacgccgtgggccacgaggtgcagagactgaccgtgaccgacctggacgcccccaacagccccgcctggagagccacctacctgatcatgggcggcgacgacggcgaccacttcaccatcaccacccaccccgagagcaaccagggcatcctgaccaccagaaagggcctggacttcgaggccaagaaccagcacaccctgtacgtggaggtgaccaacgaggcccccttcgtgctgaagctgcccaccagcaccgccaccatcgtggtgcacgtggaggacgtgaacgaggcccccgtgttcgtgccccccagcaaggtggtggaggtgcaggagggcatccccaccggcgagcccgtgtgcgtgtacaccgccgaggaccccgacaaggagaaccagaagatcagctacagaatcctgagagaccccgccggctggctggccatggaccccgacagcggccaggtgaccgccgtgggcaccctggacagagaggacgagcagttcgtgagaaacaacatctacgaggtgatggtgctggccatggacaacggcagcccccccaccaccggcaccggcaccctgctgctgaccctgatcgacgtgaacgaccacggccccgtgcccgagcccagacagatcaccatctgcaaccagagccccgtgagacaggtgctgaacatcaccgacaaggacctgagcccccacaccagccccttccaggcccagctgaccgacgacagcgacatctactggaccgccgaggtgaacgaggagggcgacaccgtggtgctgagcctgaagaagttcctgaagcaggacacctacgacgtgcacctgagcctgagcgaccacggcaacaaggagcagctgaccgtgatcagagccaccgtgtgcgactgccacggccacgtggagacctgccccggcccctggaagggcggcttcatcctgcccgtgctgggcgccgtgctggccctgctgttcctgctgctggtgctgctgctgctggtgagaaagaagagaaagatcaaggagcccctgctgctgcccgaggacgacaccagagacaacgtgttctactacggcgaggagggcggcggcgaggaggaccaggactacgacatcacccagctgcacagaggcctggaggccagacccgaggtggtgctgagaaacgacgtggcccccaccatcatccccacccccatgtacagacccagacccgccaaccccgacgagatcggcaacttcatcatcgagaacctgaaggccgccaacaccgaccccaccgcccccccctacgacaccctgctggtgttcgactacgagggcagcggcagcgacgccgccagcctgagcagcctgaccagcagcgccagcgaccaggaccaggactacgactacctgaacgagtggggcagcagattcaagaagctggccgacatgtacggcggcggcgaggacgactag

SEQ ID NO: 74867 - DNA, 2355 bp, Artificial Sequence
  Description of Artificial Sequence: Synthetic coding sequence
atgggcctgcccagaggccccctggccagcctgctgctgctgcaggtgtgctggctgcagtgcgccgccagcgagccctgcagagccgtgttcagagaggccgaggtgaccctggaggccggcggcgccgagcaggagcccggccaggccctgggcaaggtgttcatgggctgccccggccaggagcccgccctgttcagcaccgacaacgacgacttcaccgtgagaaacggcgagaccgtgcaggagagaagaagcctgaaggagagaaaccccctgaagatcttccccagcaagagaatcctgagaagacacaagagagactgggtggtggcccccatcagcgtgcccgagaacggcaagggccccttcccccagagactgaaccagctgaagagcaacaaggacagagacaccaagatcttctacagcatcaccggccccggcgccgacagcccccccgagggcgtgttcgccgtggagaaggagaccggctggctgctgctgaacaagcccctggacagagaggagatcgccaagtacgagctgttcggccacgccgtgagcgagaacggcgccagcgtggaggaccccatgaacatcagcatcatcgtgaccgaccagaacgaccacaagcccaagttcacccaggacaccttcagaggcagcgtgctggagggcgtgctgcccggcaccagcgtgatgcaggtgaccgccaccgacgaggacgacgccatctacacctacaacggcgtggtggcctacagcatccacagccaggagcccaaggacccccacgacctgatgttcaccatccacagaagcaccggcaccatcagcgtgatcagcagcggcctggacagagagaaggtgcccgagtacaccctgaccatccaggccaccgacatggacggcgacggcagcaccaccaccgccgtggccgtggtggagatcctggacgccaacgacaacgcccccatgttcgacccccagaagtacgaggcccacgtgcccgagaacgccgtgggccacgaggtgcagagactgaccgtgaccgacctggacgcccccaacagccccgcctggagagccacctacctgatcatgggcggcgacgacggcgaccacttcaccatcaccacccaccccgagagcaaccagggcatcctgaccaccagaaagggcctggacttcgaggccaagaaccagcacaccctgtacgtggaggtgaccaacgaggcccccttcgtgctgaagctgcccaccagcaccgccaccatcgtggtgcacgtggaggacgtgaacgaggcccccgtgttcgtgccccccagcaaggtggtggaggtgcaggagggcatccccaccggcgagcccgtgtgcgtgtacaccgccgaggaccccgacaaggagaaccagaagatcagctacagaatcctgagagaccccgccggctggctggccatggaccccgacagcggccaggtgaccgccgtgggcaccctggacagagaggacgagcagttcgtgagaaacaacatctacgaggtgatggtgctggccatggacaacggcagcccccccaccaccggcaccggcaccctgctgctgaccctgatcgacgtgaacgaccacggccccgtgcccgagcccagacagatcaccatctgcaaccagagccccgtgagacaggtgctgaacatcaccgacaaggacctgagcccccacaccagccccttccaggcccagctgaccgacgacagcgacatctactggaccgccgaggtgaacgaggagggcgacaccgtggtgctgagcctgaagaagttcctgaagcaggacacctacgacgtgcacctgagcctgagcgaccacggcaacaaggagcagctgaccgtgatcagagccaccgtgtgcgactgccacggccacgtggagacctgccccggcccctggaagggcggcttcatcctgcccgtgctgggcgccgtgctggccctgctgttcctgctgctggtgctgctgctgctggtgagaaagaagagaaagatcaaggagcccctgctgctgcccgaggacgacaccagagacaacgtgttctactacggcgaggagggcggcggcgaggaggaccaggactacgacatcacccagctgcacagaggcctggaggccagacccgaggtggtgctgagaaacgacgtggcccccaccatcatccccacccccatgtacagacccagacccgccaaccccgacgagatcggcaacttcatcatcgagggcagaggcgagagaggcagccagagaggcaacggcggcctgcagctggccagaggcagaaccagaagaagctag

SEQ ID NO: 74868 - DNA, 2325 bp, Artificial Sequence
  Description of Artificial Sequence: Synthetic coding sequence
atgggctgccccggccaggagcccgccctgttcagcaccgacaacgacgacttcaccgtgagaaacggcgagaccgtgcaggagagaagaagcctgaaggagagaaaccccctgaagatcttccccagcaagagaatcctgagaagacacaagagagactgggtggtggcccccatcagcgtgcccgagaacggcaagggccccttcccccagagactgaaccagctgaagagcaacaaggacagagacaccaagatcttctacagcatcaccggccccggcgccgacagcccccccgagggcgtgttcgccgtggagaaggagaccggctggctgctgctgaacaagcccctggacagagaggagatcgccaagtacgagctgttcggccacgccgtgagcgagaacggcgccagcgtggaggaccccatgaacatcagcatcatcgtgaccgaccagaacgaccacaagcccaagttcacccaggacaccttcagaggcagcgtgctggagggcgtgctgcccggcaccagcgtgatgcaggtgaccgccaccgacgaggacgacgccatctacacctacaacggcgtggtggcctacagcatccacagccaggagcccaaggacccccacgacctgatgttcaccatccacagaagcaccggcaccatcagcgtgatcagcagcggcctggacagagagaaggtgcccgagtacaccctgaccatccaggccaccgacatggacggcgacggcagcaccaccaccgccgtggccgtggtggagatcctggacgccaacgacaacgcccccatgttcgacccccagaagtacgaggcccacgtgcccgagaacgccgtgggccacgaggtgcagagactgaccgtgaccgacctggacgcccccaacagccccgcctggagagccacctacctgatcatgggcggcgacgacggcgaccacttcaccatcaccacccaccccgagagcaaccagggcatcctgaccaccagaaagggcctggacttcgaggccaagaaccagcacaccctgtacgtggaggtgaccaacgaggcccccttcgtgctgaagctgcccaccagcaccgccaccatcgtggtgcacgtggaggacgtgaacgaggcccccgtgttcgtgccccccagcaaggtggtggaggtgcaggagggcatccccaccggcgagcccgtgtgcgtgtacaccgccgaggaccccgacaaggagaaccagaagatcagctacagaatcctgagagaccccgccggctggctggccatggaccccgacagcggccaggtgaccgccgtgggcaccctggacagagaggacgagcagttcgtgagaaacaacatctacgaggtgatggtgctggccatggacaacggcagcccccccaccaccggcaccggcaccctgctgctgaccctgatcgacgtgaacgaccacggccccgtgcccgagcccagacagatcaccatctgcaaccagagccccgtgagacaggtgctgaacatcaccgacaaggacctgagcccccacaccagccccttccaggcccagctgaccgacgacagcgacatctactggaccgccgaggtgaacgaggagggcgacaccgtggtgctgagcctgaagaagttcctgaagcaggacacctacgacgtgcacctgagcctgagcgaccacggcaacaaggagcagctgaccgtgatcagagccaccgtgtgcgactgccacggccacgtggagacctgccccggcccctggaagggcggcttcatcctgcccgtgctgggcgccgtgctggccctgctgttcctgctgctggtgctgctgctgctggtgagaaagaagagaaagatcaaggagcccctgctgctgcccgaggacgacaccagagacaacgtgttctactacggcgaggagggcggcggcgaggaggaccaggactacgacatcacccagctgcacagaggcctggaggccagacccgaggtggtgctgagaaacgacgtggcccccaccatcatccccacccccatgtacagacccagacccgccaaccccgacgagatcggcaacttcatcatcgagaacctgaaggccgccaacaccgaccccaccgcccccccctacgacaccctgctggtgttcgactacgagggcagcggcagcgacgccgccagcctgagcagcctgaccagcagcgccagcgaccaggaccaggactacgactacctgaacgagtggggcagcagattcaagaagctggccgacatgtacggcggcggcgaggacgactag

SEQ ID NO: 74869 - DNA, 2751 bp, Artificial Sequence
  Description of Artificial Sequence: Synthetic coding sequence
atgaccgccggcgccggcgtgctgctgctgctgctgagcctgagcggcgccctgagagcccacaacgaggacctgaccaccagagagacctgcaaggccggcttcagcgaggacgactacaccgccctgatcagccagaacatcctggagggcgagaagctgctgcaggtgaagttcagcagctgcgtgggcaccaagggcacccagtacgagaccaacagcatggacttcaaggtgggcgccgacggcaccgtgttcgccaccagagagctgcaggtgcccagcgagcaggtggccttcaccgtgaccgcctgggacagccagaccgccgagaagtgggacgccgtggtgagactgctggtggcccagaccagcagcccccacagcggccacaagccccagaagggcaagaaggtggtggccctggaccccagccccccccccaaggacaccctgctgccctggccccagcaccagaacgccaacggcctgagaagaagaaagagagactgggtgatcccccccatcaacgtgcccgagaacagcagaggccccttcccccagcagctggtgagaatcagaagcgacaaggacaacgacatccccatcagatacagcatcaccggcgtgggcgccgaccagccccccatggaggtgttcagcatcgacagcatgagcggcagaatgtacgtgaccagacccatggacagagaggagcacgccagctaccacctgagagcccacgccgtggacatgaacggcaacaaggtggagaaccccatcgacctgtacatctacgtgatcgacatgaacgacaacagacccgagttcatcaaccaggtgtacaacggcagcgtggacgagggcagcaagcccggcacctacgtgatgaccgtgaccgccaacgacgccgacgacagcaccaccgccaacggcatggtgagatacagaatcgtgacccagaccccccagagccccagccagaacatgttcaccatcaacagcgagaccggcgacatcgtgaccgtggccgccggcctggacagagagaaggtgcagcagtacaccgtgatcgtgcaggccaccgacatggagggcaacctgaactacggcctgagcaacaccgccaccgccatcatcaccgtgaccgacgtgaacgacaacccccccgagttcaccgccagcaccttcgccggcgaggtgcccgagaacagagtggagaccgtggtggccaacctgaccgtgatggacagagaccagccccacagccccaactggaacgccgtgtacagaatcatcagcggcgaccccagcggccacttcagcgtgagaaccgaccccgtgaccaacgagggcatggtgaccgtggtgaaggccgtggactacgagctgaacagagccttcatgctgaccgtgatggtgagcaaccaggcccccctggccagcggcatccagatgagcttccagagcaccgccggcgtgaccatcagcatcatggacatcaacgaggccccctacttccccagcaaccacaagctgatcagactggaggagggcgtgccccccggcaccgtgctgaccaccttcagcgccgtggaccccgacagattcatgcagcaggccgtgagatacagcaagctgagcgaccccgccagctggctgcacatcaacgccaccaacggccagatcaccaccgccgccgtgctggacagagagagcctgtacaccaagaacaacgtgtacgaggccaccttcctggccgccgacaacggcatcccccccgccagcggcaccggcaccctgcagatctacctgatcgacatcaacgacaacgcccccgagctgctgcccaaggaggcccagatctgcgagaagcccaacctgaacgccatcaacatcaccgccgccgacgccgacgtggaccccaacatcggcccctacgtgttcgagctgcccttcgtgcccgccgccgtgagaaagaactggaccatcaccagactgaacggcgactacgcccagctgagcctgagaatcctgtacctggaggccggcatgtacgacgtgcccatcatcgtgaccgacagcggcaacccccccctgagcaacaccagcatcatcaaggtgaaggtgtgcccctgcgacgacaacggcgactgcaccaccatcggcgccgtggccgccgccggcctgggcaccggcgccatcgtggccatcctgatctgcatcctgatcctgctgaccatggtgctgctgttcgtgatgtggatgaagagaagagagaaggagagacacaccaagcagctgctgatcgaccccgaggacgacgtgagagacaacatcctgaagtacgacgaggagggcggcggcgaggaggaccaggactacgacctgagccagctgcagcagcccgaggccatgggccacgtgcccagcaaggcccccggcgtgagaagagtggacgagagacccgtgggcgccgagccccagtaccccatcagacccatggtgccccaccccggcgacatcggcgacttcatcaacgagggcctgagagccgccgacaacgaccccaccgcccccccctacgacagcctgctggtgttcgactacgagggcagcggcagcaccgccggcagcgtgagcagcctgaacagcagcagcagcggcgaccaggactacgactacctgaacgactggggccccagattcaagaagctggccgacatgtacggcggcggcgaggaggactag

SEQ ID NO: 74870 - DNA, 2475 bp, Artificial Sequence
  Description of Artificial Sequence: Synthetic coding sequence
atgcccaagagcaccggcatgctgcacggcggcagagagaacgccggcgtgaagttcagcagctgcgtgggcaccaagggcacccagtacgagaccagcagcccccacagcggccacaagccccagaagggcaagaaggtggtggccctggaccccagccccccccccaaggacaccctgctgccctggccccagcaccagaacgccaacggcctgagaagaagaaagagagactgggtgatcccccccatcaacgtgcccgagaacagcagaggccccttcccccagcagctggtgagaatcagaagcgacaaggacaacgacatccccatcagatacagcatcaccggcgtgggcgccgaccagccccccatggaggtgttcagcatcgacagcatgagcggcagaatgtacgtgaccagacccatggacagagaggagcacgccagctaccacctgagagcccacgccgtggacatgaacggcaacaaggtggagaaccccatcgacctgtacatctacgtgatcgacatgaacgacaacagacccgagttcatcaaccaggtgtacaacggcagcgtggacgagggcagcaagcccggcacctacgtgatgaccgtgaccgccaacgacgccgacgacagcaccaccgccaacggcatggtgagatacagaatcgtgacccagaccccccagagccccagccagaacatgttcaccatcaacagcgagaccggcgacatcgtgaccgtggccgccggcctggacagagagaaggtgcagcagtacaccgtgatcgtgcaggccaccgacatggagggcaacctgaactacggcctgagcaacaccgccaccgccatcatcaccgtgaccgacgtgaacgacaacccccccgagttcaccgccagcaccttcgccggcgaggtgcccgagaacagagtggagaccgtggtggccaacctgaccgtgatggacagagaccagccccacagccccaactggaacgccgtgtacagaatcatcagcggcgaccccagcggccacttcagcgtgagaaccgaccccgtgaccaacgagggcatggtgaccgtggtgaaggccgtggactacgagctgaacagagccttcatgctgaccgtgatggtgagcaaccaggcccccctggccagcggcatccagatgagcttccagagcaccgccggcgtgaccatcagcatcatggacatcaacgaggccccctacttccccagcaaccacaagctgatcagactggaggagggcgtgccccccggcaccgtgctgaccaccttcagcgccgtggaccccgacagattcatgcagcaggccgtgagatacagcaagctgagcgaccccgccagctggctgcacatcaacgccaccaacggccagatcaccaccgccgccgtgctggacagagagagcctgtacaccaagaacaacgtgtacgaggccaccttcctggccgccgacaacggcatcccccccgccagcggcaccggcaccctgcagatctacctgatcgacatcaacgacaacgcccccgagctgctgcccaaggaggcccagatctgcgagaagcccaacctgaacgccatcaacatcaccgccgccgacgccgacgtggaccccaacatcggcccctacgtgttcgagctgcccttcgtgcccgccgccgtgagaaagaactggaccatcaccagactgaacggcgactacgcccagctgagcctgagaatcctgtacctggaggccggcatgtacgacgtgcccatcatcgtgaccgacagcggcaacccccccctgagcaacaccagcatcatcaaggtgaaggtgtgcccctgcgacgacaacggcgactgcaccaccatcggcgccgtggccgccgccggcctgggcaccggcgccatcgtggccatcctgatctgcatcctgatcctgctgaccatggtgctgctgttcgtgatgtggatgaagagaagagagaaggagagacacaccaagcagctgctgatcgaccccgaggacgacgtgagagacaacatcctgaagtacgacgaggagggcggcggcgaggaggaccaggactacgacctgagccagctgcagcagcccgaggccatgggccacgtgcccagcaaggcccccggcgtgagaagagtggacgagagacccgtgggcgccgagccccagtaccccatcagacccatggtgccccaccccggcgacatcggcgacttcatcaacgagggcctgagagccgccgacaacgaccccaccgcccccccctacgacagcctgctggtgttcgactacgagggcagcggcagcaccgccggcagcgtgagcagcctgaacagcagcagcagcggcgaccaggactacgactacctgaacgactggggccccagattcaagaagctggccgacatgtacggcggcggcgaggaggactag

SEQ ID NO: 74871 - DNA, 2529 bp, Artificial Sequence
  Description of Artificial Sequence: Synthetic coding sequence
atggacttcaaggtgggcgccgacggcaccgtgttcgccaccagagagctgcaggtgcccagcgagcaggtggccttcaccgtgaccgcctgggacagccagaccgccgagaagtgggacgccgtggtgagactgctggtggcccagaccagcagcccccacagcggccacaagccccagaagggcaagaaggtggtggccctggaccccagccccccccccaaggacaccctgctgccctggccccagcaccagaacgccaacggcctgagaagaagaaagagagactgggtgatcccccccatcaacgtgcccgagaacagcagaggccccttcccccagcagctggtgagaatcagaagcgacaaggacaacgacatccccatcagatacagcatcaccggcgtgggcgccgaccagccccccatggaggtgttcagcatcgacagcatgagcggcagaatgtacgtgaccagacccatggacagagaggagcacgccagctaccacctgagagcccacgccgtggacatgaacggcaacaaggtggagaaccccatcgacctgtacatctacgtgatcgacatgaacgacaacagacccgagttcatcaaccaggtgtacaacggcagcgtggacgagggcagcaagcccggcacctacgtgatgaccgtgaccgccaacgacgccgacgacagcaccaccgccaacggcatggtgagatacagaatcgtgacccagaccccccagagccccagccagaacatgttcaccatcaacagcgagaccggcgacatcgtgaccgtggccgccggcctggacagagagaaggtgcagcagtacaccgtgatcgtgcaggccaccgacatggagggcaacctgaactacggcctgagcaacaccgccaccgccatcatcaccgtgaccgacgtgaacgacaacccccccgagttcaccgccagcaccttcgccggcgaggtgcccgagaacagagtggagaccgtggtggccaacctgaccgtgatggacagagaccagccccacagccccaactggaacgccgtgtacagaatcatcagcggcgaccccagcggccacttcagcgtgagaaccgaccccgtgaccaacgagggcatggtgaccgtggtgaaggccgtggactacgagctgaacagagccttcatgctgaccgtgatggtgagcaaccaggcccccctggccagcggcatccagatgagcttccagagcaccgccggcgtgaccatcagcatcatggacatcaacgaggccccctacttccccagcaaccacaagctgatcagactggaggagggcgtgccccccggcaccgtgctgaccaccttcagcgccgtggaccccgacagattcatgcagcaggccgtgagatacagcaagctgagcgaccccgccagctggctgcacatcaacgccaccaacggccagatcaccaccgccgccgtgctggacagagagagcctgtacaccaagaacaacgtgtacgaggccaccttcctggccgccgacaacggcatcccccccgccagcggcaccggcaccctgcagatctacctgatcgacatcaacgacaacgcccccgagctgctgcccaaggaggcccagatctgcgagaagcccaacctgaacgccatcaacatcaccgccgccgacgccgacgtggaccccaacatcggcccctacgtgttcgagctgcccttcgtgcccgccgccgtgagaaagaactggaccatcaccagactgaacggcgactacgcccagctgagcctgagaatcctgtacctggaggccggcatgtacgacgtgcccatcatcgtgaccgacagcggcaacccccccctgagcaacaccagcatcatcaaggtgaaggtgtgcccctgcgacgacaacggcgactgcaccaccatcggcgccgtggccgccgccggcctgggcaccggcgccatcgtggccatcctgatctgcatcctgatcctgctgaccatggtgctgctgttcgtgatgtggatgaagagaagagagaaggagagacacaccaagcagctgctgatcgaccccgaggacgacgtgagagacaacatcctgaagtacgacgaggagggcggcggcgaggaggaccaggactacgacctgagccagctgcagcagcccgaggccatgggccacgtgcccagcaaggcccccggcgtgagaagagtggacgagagacccgtgggcgccgagccccagtaccccatcagacccatggtgccccaccccggcgacatcggcgacttcatcaacgagggcctgagagccgccgacaacgaccccaccgcccccccctacgacagcctgctggtgttcgactacgagggcagcggcagcaccgccggcagcgtgagcagcctgaacagcagcagcagcggcgaccaggactacgactacctgaacgactggggccccagattcaagaagctggccgacatgtacggcggcggcgaggaggactag

SEQ ID NO: 74872 - DNA, 2358 bp, Artificial Sequence
  Description of Artificial Sequence: Synthetic coding sequence
atgaagctgggcaaggtggagttctgccacttcctgcagctgatcgccctgttcctgtgcttcagcggcatgagccaggccgagctgagcagaagcagaagcaagccctacttccagagcggcagaagcagaaccaagagaagctgggtgtggaaccagttcttcgtgctggaggagtacatgggcagcgaccccctgtacgtgggcaagctgcacagcgacgtggacaagggcgacggcagcatcaagtacatcctgagcggcgagggcgccagcagcatcttcatcatcgacgagaacaccggcgacatccacgccaccaagagactggacagagaggagcaggcctactacaccctgagagcccaggccctggacagactgaccaacaagcccgtggagcccgagagcgagttcgtgatcaagatccaggacatcaacgacaacgagcccaagttcctggacggcccctacaccgccggcgtgcccgagatgagccccgtgggcaccagcgtggtgcaggtgaccgccaccgacgccgacgaccccacctacggcaacagcgccagagtggtgtacagcatcctgcagggccagccctacttcagcgtggagcccaagaccggcgtgatcaagaccgccctgcccaacatggacagagaggccaaggaccagtacctgctggtgatccaggccaaggacatggtgggccagaacggcggcctgagcggcaccaccagcgtgaccgtgaccctgaccgacgtgaacgacaacccccccagattccccagaagaagctaccagtacaacgtgcccgagagcctgcccgtggccagcgtggtggccagaatcaaggccgccgacgccgacatcggcgccaacgccgagatggagtacaagatcgtggacggcgacggcctgggcatcttcaagatcagcgtggacaaggagacccaggagggcatcatcaccatccagaaggagctggacttcgaggccaagaccagctacaccctgagaatcgaggccgccaacaaggacgccgaccccagattcctgagcctgggccccttcagcgacaccaccaccgtgaagatcatcgtggaggacgtggacgagccccccgtgttcagcagccccctgtaccccatggaggtgagcgaggccacccaggtgggcaacatcatcggcaccgtggccgcccacgaccccgacagcagcaacagccccgtgagatacagcatcgacagaaacaccgacctggagagatacttcaacatcgacgccaacagcggcgtgatcaccaccgccaagagcctggacagagagaccaacgccatccacaacatcaccgtgctggccatggagagccagaaccccagccaggtgggcagaggctacgtggccatcaccatcctggacatcaacgacaacgcccccgagttcgccatggactacgagaccaccgtgtgcgagaacgcccagcccggccaggtgatccagaagatcagcgccgtggacaaggacgagcccagcaacggccaccagttctacttcagcctgaccaccgacgccaccaacaaccacaacttcagcctgaaggacaacaaggacaacaccgccagcatcctgaccagaagaaacggcttcagaagacaggagcagagcgtgtactacctgcccatcttcatcgtggacagcggcagccccagcctgagcagcaccaacaccctgaccatcagagtgtgcgactgcgacgccgacggcgtggcccagacctgcaacgccgaggcctacgtgctgcccgccggcctgagcaccggcgccctgatcgccatcctggcctgcgtgctgaccctgctggtgctgatcctgctgatcgtgaccatgagaagaagaaagaaggagcccctgatcttcgacgaggagagagacatcagagagaacatcgtgagatacgacgacgagggcggcggcgaggaggacaccgaggccttcgacatggccgccctgagaaacctgaacgtgatcagagacaccaagaccagaagagacgtgacccccgagatccagttcctgagcagacccgccttcaagagcatccccgacaacgtgatcttcagagagttcatctgggagagactgaaggaggccgacgtggaccccggcgcccccccctacgacagcctgcagacctacgccttcgagggcaacggcagcgtggccgagagcctgagcagcctggacagcatcagcagcaacagcgaccagaactacgactacctgagcgactggggccccagattcaagagactggccgacatgtacggcaccggccaggagagcctgtacagctag

SEQ ID NO: 74873 - DNA, 2358 bp, Artificial Sequence; identical to SEQ ID NO: 74872
  Description of Artificial Sequence: Synthetic coding sequence

SEQ ID NO: 74874 - DNA, 2358 bp, Artificial Sequence; identical to SEQ ID NO: 74872
  Description of Artificial Sequence: Synthetic coding sequence

SEQ ID NO: 74875 - DNA, 1893 bp, Artificial Sequence
  Description of Artificial Sequence: Synthetic coding sequence
atgaagctgggcaaggtggagttctgccacttcctgcagctgatcgccctgttcctgtgcttcagcggcatgagccaggccgagctgagcagaagcagaagcaagccctacttccagagcggcagaagcagaaccaagagaagctgggtgtggaaccagttcttcgtgctggaggagtacatgggcagcgaccccctgtacgtgggcaagctgcacagcgacgtggacaagggcgacggcagcatcaagtacatcctgagcggcgagggcgccagcagcatcttcatcatcgacgagaacaccggcgacatccacgccaccaagagactggacagagaggagcaggcctactacaccctgagagcccaggccctggacagactgaccaacaagcccgtggagcccgagagcgagttcgtgatcaagatccaggacatcaacgacaacgagcccaagttcctggacggcccctacaccgccggcgtgcccgagatgagccccgtgggcaccagcgtggtgcaggtgaccgccaccgacgccgacgaccccacctacggcaacagcgccagagtggtgtacagcatcctgcagggccagccctacttcagcgtggagcccaagaccggcgtgatcaagaccgccctgcccaacatggacagagaggccaaggaccagtacctgctggtgatccaggccaaggacatggtgggccagaacggcggcctgagcggcaccaccagcgtgaccgtgaccctgaccgacgtgaacgacaacccccccagattccccagaagaagctaccagtacaacgtgcccgagagcctgcccgtggccagcgtggtggccagaatcaaggccgccgacgccgacatcggcgccaacgccgagatggagtacaagatcgtggacggcgacggcctgggcatcttcaagatcagcgtggacaaggagacccaggagggcatcatcaccatccagaaggagctggacttcgaggccaagaccagctacaccctgagaatcgaggccgccaacaaggacgccgaccccagattcctgagcctgggccccttcagcgacaccaccaccgtgaagatcatcgtggaggacgtggacgagccccccgtgttcagcagccccctgtaccccatggaggtgagcgaggccacccaggtgggcaacatcatcggcaccgtggccgcccacgaccccgacagcagcaacagccccgtgagatacagcatcgacagaaacaccgacctggagagatacttcaacatcgacgccaacagcggcgtgatcaccaccgccaagagcctggacagagagaccaacgccatccacaacatcaccgtgctggccatggagagccagaaccccagccaggtgggcagaggctacgtggccatcaccatcctggacatcaacgacaacgcccccgagttcgccatggactacgagaccaccgtgtgcgagaacgcccagcccggccaggtgatccagaagatcagcgccgtggacaaggacgagcccagcaacggccaccagttctacttcagcctgaccaccgacgccaccaacaaccacaacttcagcctgaaggacaacaaggacaacaccgccagcatcctgaccagaagaaacggcttcagaagacaggagcagagcgtgtactacctgcccatcttcatcgtggacagcggcagccccagcctgagcagcaccaacaccctgaccatcagagtgtgcgactgcgacgccgacggcgtggcccagacctgcaacgccgaggcctacgtgctgcccgccggcctgagcaccggcgccctgatcgccatcctggcctgcgtgctgaccctgctgggcagatactgcttccagggcctgctgtag

SEQ ID NO: 74876 - DNA, 2400 bp, Artificial Sequence
  Description of Artificial Sequence: Synthetic coding sequence
atgcccgagagactggccgagatgctgctggacctgtggacccccctgatcatcctgtggatcaccctgcccccctgcatctacatggcccccatgaaccagagccaggtgctgatgagcggcagccccctggagctgaacagcctgggcgaggagcagagaatcctgaacagaagcaagagaggctgggtgtggaaccagatgttcgtgctggaggagttcagcggccccgagcccatcctggtgggcagactgcacaccgacctggaccccggcagcaagaagatcaagtacatcctgagcggcgacggcgccggcaccatcttccagatcaacgacgtgaccggcgacatccacgccatcaagagactggacagagaggagaaggccgagtacaccctgaccgcccaggccgtggactgggagaccagcaagcccctggagccccccagcgagttcatcatcaaggtgcaggacatcaacgacaacgcccccgagttcctgaacggcccctaccacgccaccgtgcccgagatgagcatcctgggcaccagcgtgaccaacgtgaccgccaccgacgccgacgaccccgtgtacggcaacagcgccaagctggtgtacagcatcctggagggccagccctacttcagcatcgagcccgagaccgccatcatcaagaccgccctgcccaacatggacagagaggccaaggaggagtacctggtggtgatccaggccaaggacatgggcggccacagcggcggcctgagcggcaccaccaccctgaccgtgaccctgaccgacgtgaacgacaacccccccaagttcgcccagagcctgtaccacttcagcgtgcccgaggacgtggtgctgggcaccgccatcggcagagtgaaggccaacgaccaggacatcggcgagaacgcccagagcagctacgacatcatcgacggcgacggcaccgccctgttcgagatcaccagcgacgcccaggcccaggacggcatcatcagactgagaaagcccctggacttcgagaccaagaagagctacaccctgaaggtggaggccgccaacgtgcacatcgaccccagattcagcggcagaggccccttcaaggacaccgccaccgtgaagatcgtggtggaggacgccgacgagccccccgtgttcagcagccccacctacctgctggaggtgcacgagaacgccgccctgaacagcgtgatcggccaggtgaccgccagagaccccgacatcaccagcagccccatcagattcagcatcgacagacacaccgacctggagagacagttcaacatcaacgccgacgacggcaagatcaccctggccacccccctggacagagagctgagcgtgtggcacaacatcaccatcatcgccaccgagatcagaaaccacagccagatcagcagagtgcccgtggccatcaaggtgctggacgtgaacgacaacgcccccgagttcgccagcgagtacgaggccttcctgtgcgagaacggcaagcccggccaggtgatccagaccgtgagcgccatggacaaggacgaccccaagaacggccactacttcctgtacagcctgctgcccgagatggtgaacaaccccaacttcaccatcaagaagaacgaggacaacagcctgagcatcctggccaagcacaacggcttcaacagacagaagcaggaggtgtacctgctgcccatcatcatcagcgacagcggcaacccccccctgagcagcaccagcaccctgaccatcagagtgtgcggctgcagcaacgacggcgtggtgcagagctgcaacgtggaggcctacgtgctgcccatcggcctgagcatgggcgccctgatcgccatcctggcctgcatcatcctgctgctggtgatcgtggtgctgttcgtgaccctgagaagacacaagaacgagcccctgatcatcaaggacgacgaggacgtgagagagaacatcatcagatacgacgacgagggcggcggcgaggaggacaccgaggccttcgacatcgccaccctgcagaaccccgacggcatcaacggcttcctgcccagaaaggacatcaagcccgacctgcagttcatgcccagacagggcctggcccccgtgcccaacggcgtggacgtggacgagttcatcaacgtgagactgcacgaggccgacaacgaccccaccgcccccccctacgacagcatccagatctacggctacgagggcagaggcagcgtggccggcagcctgagcagcctggagagcaccaccagcgacagcgaccagaacttcgactacctgagcgactggggccccagattcaagagactgggcgagctgtacagcgtgggcgagagcgacaaggagacctag

SEQ ID NO: 74877 - DNA, 2400 bp, Artificial Sequence; identical to SEQ ID NO: 74876
  Description of Artificial Sequence: Synthetic coding sequence

SEQ ID NO: 74878 - DNA, 795 bp, Artificial Sequence
  Description of Artificial Sequence: Synthetic coding sequence
atgaccaagttcagcagcttcagcctgttcttcctgatcgtgggcgcctacatgacccacgtgtgcttcaacatggagatcatcggcggcaaggaggtgagcccccacagcagacccttcatggccagcatccagtacggcggccaccacgtgtgcggcggcgtgctgatcgacccccagtgggtgctgaccgccgcccactgccagtacagattcaccaagggccagagccccaccgtggtgctgggcgcccacagcctgagcaagaacgaggccagcaagcagaccctggagatcaagaagttcatccccttcagcagagtgaccagcgacccccagagcaacgacatcatgctggtgaagctgcagaccgccgccaagctgaacaagcacgtgaagatgctgcacatcagaagcaagaccagcctgagaagcggcaccaagtgcaaggtgaccggctggggcgccaccgaccccgacagcctgagacccagcgacaccctgagagaggtgaccgtgaccgtgctgagcagaaagctgtgcaacagccagagctactacaacggcgaccccttcatcaccaaggacatggtgtgcgccggcgacgccaagggccagaaggacagctgcaagggcgacagcggcggccccctgatctgcaagggcgtgttccacgccatcgtgagcggcggccacgagtgcggcgtggccaccaagcccggcatctacaccctgctgaccaagaagtaccagacctggatcaagagcaacctggtgcccccccacaccaactag

SEQ ID NO: 74879 - DNA, 246 bp, Artificial Sequence
  Description of Artificial Sequence: Synthetic coding sequence
atgagaacctaccactacatccccctgttcatctggacctacatgttccacaccgtggacaccatcctgctgcaggagaagcccaacagctacctgagcagcaagaagatcgccggcctgaccaaggacgacggcaagatgctgagaagaaccaagagaggctggatgtggaaccagttcttcctgctggaggagtacaccggcaccgacacccagtacgtgggcaagctgcacaccgaccagtag

SEQ ID NO: 74880 - DNA, 399 bp, Artificial Sequence
  Description of Artificial Sequence: Synthetic coding sequence
atgagaacctaccactacatccccctgttcatctggacctacatgttccacaccgtggacaccatcctgctgcaggagaagcccaacagctacctgagcagcaagaagatcgccggcctgaccaaggacgacggcaagatgctgagaagaaccaagagaggctggatgtggaaccagttcttcctgctggaggagtacaccggcaccgacacccagtacgtgggcaagctgcacaccgaccaggacaagggcgacggcaacctgaagtacatcctgaccggcgacggcgccggcagcctgttcgtgatcgacgagaacaccggcgacatccacgccgccaagaagctggacagagaggagaagagcctgtacatcctgagagccaaggccatcgactag

SEQ ID NO: 74881 - DNA, 9045 bp, Artificial Sequence
  Description of Artificial Sequence: Synthetic coding sequence
atggcccccccccccccccccgtgctgcccgtgctgctgctgctggccgccgccgccgccctgcccgccatgggcctgagagccgccgcctgggagcccagagtgcccggcggcaccagagccttcgccctgagacccggctgcacctacgccgtgggcgccgcctgcacccccagagcccccagagagctgctggacgtgggcagagacggcagactggccggcagaagaagagtgagcggcgccggcagacccctgcccctgcaggtgagactggtggccagaagcgcccccaccgccctgagcagaagactgagagccagaacccacctgcccggctgcggcgccagagccagactgtgcggcaccggcgccagactgtgcggcgccctgtgcttccccgtgcccggcggctgcgccgccgcccagcacagcgccctggccgcccccaccaccctgcccgcctgcagatgcccccccagacccagacccagatgccccggcagacccatctgcctgccccccggcggcagcgtgagactgagactgctgtgcgccctgagaagagccgccggcgccgtgagagtgggcctggccctggaggccgccaccgccggcacccccagcgccagccccagccccagcccccccctgccccccaacctgcccgaggccagagccggccccgccagaagagccagaagaggcaccagcggcagaggcagcctgaagttccccatgcccaactaccaggtggccctgttcgagaacgagcccgccggcaccctgatcctgcagctgcacgcccactacaccatcgagggcgaggaggagagagtgagctactacatggagggcctgttcgacgagagaagcagaggctacttcagaatcgacagcgccaccggcgccgtgagcaccgacagcgtgctggacagagagaccaaggagacccacgtgctgagagtgaaggccgtggactacagcaccccccccagaagcgccaccacctacatcaccgtgctggtgaaggacaccaacgaccacagccccgtgttcgagcagagcgagtacagagagagagtgagagagaacctggaggtgggctacgaggtgctgaccatcagagccagcgacagagacagccccatcaacgccaacctgagatacagagtgctgggcggcgcctgggacgtgttccagctgaacgagagcagcggcgtggtgagcaccagagccgtgctggacagagaggaggccgccgagtaccagctgctggtggaggccaacgaccagggcagaaaccccggccccctgagcgccaccgccaccgtgtacatcgaggtggaggacgagaacgacaactacccccagttcagcgagcagaactacgtggtgcaggtgcccgaggacgtgggcctgaacaccgccgtgctgagagtgcaggccaccgacagagaccagggccagaacgccgccatccactacagcatcctgagcggcaacgtggccggccagttctacctgcacagcctgagcggcatcctggacgtgatcaaccccctggacttcgaggacgtgcagaagtacagcctgagcatcaaggcccaggacggcggcagaccccccctgatcaacagcagcggcgtggtgagcgtgcaggtgctggacgtgaacgacaacgagcccatcttcgtgagcagccccttccaggccaccgtgctggagaacgtgcccctgggctaccccgtggtgcacatccaggccgtggacgccgacagcggcgagaacgccagactgcactacagactggtggacaccgccagcaccttcctgggcggcggcagcgccggccccaagaaccccgcccccacccccgacttccccttccagatccacaacagcagcggctggatcaccgtgtgcgccgagctggacagagaggaggtggagcactacagcttcggcgtggaggccgtggaccacggcagcccccccatgagcagcagcaccagcgtgagcatcaccgtgctggacgtgaacgacaacgaccccgtgttcacccagcccacctacgagctgagactgaacgaggacgccgccgtgggcagcagcgtgctgaccctgcaggccagagacagagacgccaacagcgtgatcacctaccagctgaccggcggcaacaccagaaacagattcgccctgagcagccagagaggcggcggcctgatcaccctggccctgcccctggactacaagcaggagcagcagtacgtgctggccgtgaccgccagcgacggcaccagaagccacaccgcccacgtgctgatcaacgtgaccgacgccaacacccacagacccgtgttccagagcagccactacaccgtgagcgtgagcgaggacagacccgtgggcaccagcatcgccaccctgagcgccaacgacgaggacaccggcgagaacgccagaatcacctacgtgatccaggaccccgtgccccagttcagaatcgaccccgacagcggcaccatgtacaccatgatggagctggactacgagaaccaggtggcctacaccctgaccatcatggcccaggacaacggcatcccccagaagagcgacaccaccaccctggagatcctgatcctggacgccaacgacaacgccccccagttcctgtgggacttctaccagggcagcatcttcgaggacgccccccccagcaccagcatcctgcaggtgagcgccaccgacagagacagcggccccaacggcagactgctgtacaccttccagggcggcgacgacggcgacggcgacttctacatcgagcccaccagcggcgtgatcagaacccagagaagactggacagagagaacgtggccgtgtacaacctgtgggccctggccgtggacagaggcagccccacccccctgagcgccagcgtggagatccaggtgaccatcctggacatcaacgacaacgcccccatgttcgagaaggacgagctggagctgttcgtggaggagaacaaccccgtgggcagcgtggtggccaagatcagagccaacgaccccgacgagggccccaacgcccagatcatgtaccagatcgtggagggcgacatgagacacttcttccagctggacctgctgaacggcgacctgagagccatggtggagctggacttcgaggtgagaagagagtacgtgctggtggtgcaggccaccagcgcccccctggtgagcagagccaccgtgcacatcctgctggtggaccagaacgacaacccccccgtgctgcccgacttccagatcctgttcaacaactacgtgaccaacaagagcaacagcttccccaccggcgtgatcggctgcatccccgcccacgaccccgacgtgagcgacagcctgaactacaccttcgtgcagggcaacgagctgagactgctgctgctggaccccgccaccggcgagctgcagctgagcagagacctggacaacaacagacccctggaggccctgatggaggtgagcgtgagcgacggcatccacagcgtgaccgccttctgcaccctgagagtgaccatcatcaccgacgacatgctgaccaacagcatcaccgtgagactggagaacatgagccaggagaagttcctgagccccctgctggccctgttcgtggagggcgtggccgccgtgctgagcaccaccaaggacgacgtgttcgtgttcaacgtgcagaacgacaccgacgtgagcagcaacatcctgaacgtgaccttcagcgccctgctgcccggcggcgtgagaggccagttcttccccagcgaggacctgcaggagcagatctacctgaacagaaccctgctgaccaccatcagcacccagagagtgctgcccttcgacgacaacatctgcctgagagagccctgcgagaactacatgaagtgcgtgagcgtgctgagattcgacagcagcgcccccttcctgagcagcaccaccgtgctgttcagacccatccaccccatcaacggcctgagatgcagatgcccccccggcttcaccggcgactactgcgagaccgagatcgacctgtgctacagcgacccctgcggcgccaacggcagatgcagaagcagagagggcggctacacctgcgagtgcttcgaggacttcaccggcgagcactgcgaggtggacgccagaagcggcagatgcgccaacggcgtgtgcaagaacggcggcacctgcgtgaacctgctgatcggcggcttccactgcgtgtgcccccccggcgagtacgagagaccctactgcgaggtgaccaccagaagcttccccccccagagcttcgtgaccttcagaggcctgagacagagattccacttcaccatcagcctgaccttcgccacccaggagagaaacggcctgctgctgtacaacggcagattcaacgagaagcacgacttcatcgccctggagatcgtggacgagcaggtgcagctgaccttcagcgccggcgagaccaccaccaccgtggcccccaaggtgcccagcggcgtgagcgacggcagatggcacagcgtgcaggtgcagtactacaacaagcccaacatcggccacctgggcctgccccacggccccagcggcgagaagatggccgtggtgaccgtggacgactgcgacaccaccatggccgtgagattcggcaaggacatcggcaactacagctgcgccgcccagggcacccagaccggcagcaagaagagcctggacctgaccggccccctgctgctgggcggcgtgcccaacctgcccgaggacttccccgtgcacaacagacagttcgtgggctgcatgagaaacctgagcgtggacggcaagaacgtggacatggccggcttcatcgccaacaacggcaccagagagggctgcgccgccagaagaaacttctgcgacggcagaagatgccagaacggcggcacctgcgtgaacagatggaacatgtacctgtgcgagtgccccctgagattcggcggcaagaactgcgagcaggccatgccccacccccagctgttcagcggcgagagcgtggtgagctggagcgacctgaacatcatcatcagcgtgccctggtacctgggcctgatgttcagaaccagaaaggaggacagcgtgctgatggaggccaccagcggcggccccaccagcttcagactgcagatcctgaacaactacctgcagttcgaggtgagccacggccccagcgacgtggagagcgtgatgctgagcggcctgagagtgaccgacggcgagtggcaccacctgctgatcgagctgaagaacgtgaaggaggacagcgagatgaagcacctggtgaccatgaccctggactacggcatggaccagaacaaggccgacatcggcggcatgctgcccggcctgaccgtgagaagcgtggtggtgggcggcgccagcgaggacaaggtgagcgtgagaagaggcttcagaggctgcatgcagggcgtgagaatgggcggcacccccaccaacgtggccaccctgaacatgaacaacgccctgaaggtgagagtgaaggacggctgcgacgtggacgacccctgcaccagcagcccctgcccccccaacagcagatgccacgacgcctgggaggactacagctgcgtgtgcgacaagggctacctgggcatcaactgcgtggacgcctgccacctgaacccctgcgagaacatgggcgcctgcgtgagaagccccggcagcccccagggctacgtgtgcgagtgcggccccagccactacggcccctactgcgagaacaagctggacctgccctgccccagaggctggtggggcaaccccgtgtgcggcccctgccactgcgccgtgagcaagggcttcgaccccgactgcaacaagaccaacggccagtgccagtgcaaggagaactactacaagctgctggcccaggacacctgcctgccctgcgactgcttcccccacggcagccacagcagaacctgcgacatggccaccggccagtgcgcctgcaagcccggcgtgatcggcagacagtgcaacagatgcgacaaccccttcgccgaggtgaccaccctgggctgcgaggtgatctacaacggctgccccaaggccttcgaggccggcatctggtggccccagaccaagttcggccagcccgccgccgtgccctgccccaagggcagcgtgggcaacgccgtgagacactgcagcggcgagaagggctggctgccccccgagctgttcaactgcaccaccatcagcttcgtggacctgagagccatgaacgagaagctgagcagaaacgagacccaggtggacggcgccagagccctgcagctggtgagagccctgagaagcgccacccagcacaccggcaccctgttcggcaacgacgtgagaaccgcctaccagctgctgggccacgtgctgcagcacgagagctggcagcagggcttcgacctggccgccacccaggacgccgacttccacgaggacgtgatccacagcggcagcgccctgctggcccccgccaccagagccgcctgggagcagatccagagaagcgagggcggcaccgcccagctgctgagaagactggagggctacttcagcaacgtggccagaaacgtgagaagaacctacctgagacccttcgtgatcgtgaccgccaacatgatcctggccgtggacatcttcgacaagttcaacttcaccggcgccagagtgcccagattcgacaccatccacgaggagttccccagagagctggagagcagcgtgagcttccccgccgacttcttcagaccccccgaggagaaggagggccccctgctgagacccgccggcagaagaaccaccccccagaccaccagacccggccccggcaccgagagagaggcccccatcagcagaagaagaagacaccccgacgacgccggccagttcgccgtggccctggtgatcatctacagaaccctgggccagctgctgcccgagagatacgaccccgacagaagaagcctgagactgccccacagacccatcatcaacacccccatggtgagcaccctggtgtacagcgagggcgcccccctgcccagacccctggagagacccgtgctggtggagttcgccctgctggaggtggaggagagaaccaagcccgtgtgcgtgttctggaaccacagcctggccgtgggcggcaccggcggctggagcgccagaggctgcgagctgctgagcagaaacagaacccacgtggcctgccagtgcagccacaccgccagcttcgccgtgctgatggacatcagcagaagagagaacggcgaggtgctgcccctgaagatcgtgacctacgccgccgtgagcctgagcctggccgccctgctggtggccttcgtgctgctgagcctggtgagaatgctgagaagcaacctgcacagcatccacaagcacctggccgtggccctgttcctgagccagctggtgttcgtgatcggcatcaaccagaccgagaaccccttcctgtgcaccgtggtggccatcctgctgcactacatctacatgagcaccttcgcctggaccctggtggagagcctgcacgtgtacagaatgctgaccgaggtgagaaacatcgacaccggccccatgagattctactacgtggtgggctggggcatccccgccatcgtgaccggcctggccgtgggcctggacccccagggctacggcaaccccgacttctgctggctgagcctgcaggacaccctgatctggagcttcgccggccccatcggcgccgtgatcatcatcaacaccgtgaccagcgtgctgagcgccaaggtgagctgccagagaaagcaccactactacggcaagaagggcatcgtgagcctgctgagaaccgccttcctgctgctgctgctgatcagcgccacctggctgctgggcctgctggccgtgaacagagacgccctgagcttccactacctgttcgccatcttcagcggcctgcagggccccttcgtgctgctgttccactgcgtgctgaaccaggaggtgagaaagcacctgaagggcgtgctgggcggcagaaagctgcacctggaggacagcgccaccaccagagccaccctgctgaccagaagcctgaactgcaacaccaccttcggcgacggccccgacatgctgagaaccgacctgggcgagagcaccgccagcctggacagcatcgtgagagacgagggcatccagaagctgggcgtgagcagcggcctggtgagaggcagccacggcgagcccgacgccagcctgatgcccagaagctgcaaggacccccccggccacgacagcgacagcgacagcgagctgagcctggacgagcagagcagcagctacgccagcagccacagcagcgacagcgaggacgacggcgtgggcgccgaggagaagtgggaccccgccagaggcgccgtgcacagcacccccaagggcgacgccgtggccaaccacgtgcccgccggctggcccgaccagagcctggccgagagcgacagcgaggaccccagcggcaagcccagactgaaggtggagaccaaggtgagcgtggagctgcacagagaggagcagggcagccacagaggcgagtacccccccgaccaggagagcggcggcgccgccagactggccagcagccagccccccgagcagagaaagggcatcctgaagaacaaggtgacctaccccccccccctgaccctgaccgagcagaccctgaagggcagactgagagagaagctggccgactgcgagcagagccccaccagcagcagaaccagcagcctgggcagcggcggccccgactgcgccatcaccgtgaagagccccggcagagagcccggcagagaccacctgaacggcgtggccatgaacgtgagaaccggcagcgcccaggccgacggcagcgacagcgagaagccctag

SEQ ID NO: 74882 - DNA, 4194 bp, Artificial Sequence
  Description of Artificial Sequence: Synthetic coding sequence
atggcccccccccccccccccgtgctgcccgtgctgctgctgctggccgccgccgccgccctgcccgccatgggcctgagagccgccgcctgggagcccagagtgcccggcggcaccagagccttcgccctgagacccggctgcacctacgccgtgggcgccgcctgcacccccagagcccccagagagctgctggacgtgggcagagacggcagactggccggcagaagaagagtgagcggcgccggcagacccctgcccctgcaggtgagactggtggccagaagcgcccccaccgccctgagcagaagactgagagccagaacccacctgcccggctgcggcgccagagccagactgtgcggcaccggcgccagactgtgcggcgccctgtgcttccccgtgcccggcggctgcgccgccgcccagcacagcgccctggccgcccccaccaccctgcccgcctgcagatgcccccccagacccagacccagatgccccggcagacccatctgcctgccccccggcggcagcgtgagactgagactgctgtgcgccctgagaagagccgccggcgccgtgagagtgggcctggccctggaggccgccaccgccggcacccccagcgccagccccagccccagcccccccctgccccccaacctgcccgaggccagagccggccccgccagaagagccagaagaggcaccagcggcagaggcagcctgaagttccccatgcccaactaccaggtggccctgttcgagaacgagcccgccggcaccctgatcctgcagctgcacgcccactacaccatcgagggcgaggaggagagagtgagctactacatggagggcctgttcgacgagagaagcagaggctacttcagaatcgacagcgccaccggcgccgtgagcaccgacagcgtgctggacagagagaccaaggagacccacgtgctgagagtgaaggccgtggactacagcaccccccccagaagcgccaccacctacatcaccgtgctggtgaaggacaccaacgaccacagccccgtgttcgagcagagcgagtacagagagagagtgagagagaacctggaggtgggctacgaggtgctgaccatcagagccagcgacagagacagccccatcaacgccaacctgagatacagagtgctgggcggcgcctgggacgtgttccagctgaacgagagcagcggcgtggtgagcaccagagccgtgctggacagagaggaggccgccgagtaccagctgctggtggaggccaacgaccagggcagaaaccccggccccctgagcgccaccgccaccgtgtacatcgaggtggaggacgagaacgacaactacccccagttcagcgagcagaactacgtggtgcaggtgcccgaggacgtgggcctgaacaccgccgtgctgagagtgcaggccaccgacagagaccagggccagaacgccgccatccactacagcatcctgagcggcaacgtggccggccagttctacctgcacagcctgagcggcatcctggacgtgatcaaccccctggacttcgaggacgtgcagaagtacagcctgagcatcaaggcccaggacggcggcagaccccccctgatcaacagcagcggcgtggtgagcgtgcaggtgctggacgtgaacgacaacgagcccatcttcgtgagcagccccttccaggccaccgtgctggagaacgtgcccctgggctaccccgtggtgcacatccaggccgtggacgccgacagcggcgagaacgccagactgcactacagactggtggacaccgccagcaccttcctgggcggcggcagcgccggccccaagaaccccgcccccacccccgacttccccttccagatccacaacagcagcggctggatcaccgtgtgcgccgagctggacagagaggaggtggagcactacagcttcggcgtggaggccgtggaccacggcagcccccccatgagcagcagcaccagcgtgagcatcaccgtgctggacgtgaacgacaacgaccccgtgttcacccagcccacctacgagctgagactgaacgaggacgccgccgtgggcagcagcgtgctgaccctgcaggccagagacagagacgccaacagcgtgatcacctaccagctgaccggcggcaacaccagaaacagattcgccctgagcagccagagaggcggcggcctgatcaccctggccctgcccctggactacaagcaggagcagcagtacgtgctggccgtgaccgccagcgacggcaccagaagccacaccgcccacgtgctgatcaacgtgaccgacgccaacacccacagacccgtgttccagagcagccactacaccgtgagcgtgagcgaggacagacccgtgggcaccagcatcgccaccctgagcgccaacgacgaggacaccggcgagaacgccagaatcacctacgtgatccaggaccccgtgccccagttcagaatcgaccccgacagcggcaccatgtacaccatgatggagctggactacgagaaccaggtggcctacaccctgaccatcatggcccaggacaacggcatcccccagaagagcgacaccaccaccctggagatcctgatcctggacgccaacgacaacgccccccagttcctgtgggacttctaccagggcagcatcttcgaggacgccccccccagcaccagcatcctgcaggtgagcgccaccgacagagacagcggccccaacggcagactgctgtacaccttccagggcggcgacgacggcgacggcgacttctacatcgagcccaccagcggcgtgatcagaacccagagaagactggacagagagaacgtggccgtgtacaacctgtgggccctggccgtggacagaggcagccccacccccctgagcgccagcgtggagatccaggtgaccatcctggacatcaacgacaacgcccccatgttcgagaaggacgagctggagctgttcgtggaggagaacaaccccgtgggcagcgtggtggccaagatcagagccaacgaccccgacgagggccccaacgcccagatcatgtaccagatcgtggagggcgacatgagacacttcttccagctggacctgctgaacggcgacctgagagccatggtggagctggacttcgaggtgagaagagagtacgtgctggtggtgcaggccaccagcgcccccctggtgagcagagccaccgtgcacatcctgctggtggaccagaacgacaacccccccgtgctgcccgacttccagatcctgttcaacaactacgtgaccaacaagagcaacagcttccccaccggcgtgatcggctgcatccccgcccacgaccccgacgtgagcgacagcctgaactacaccttcgtgcagggcaacgagctgagactgctgctgctggaccccgccaccggcgagctgcagctgagcagagacctggacaacaacagacccctggaggccctgatggaggtgagcgtgagcgacggcatccacagcgtgaccgccttctgcaccctgagagtgaccatcatcaccgacgacatgctgaccaacagcatcaccgtgagactggagaacatgagccaggagaagttcctgagccccctgctggccctgttcgtggagggcgtggccgccgtgctgagcaccaccaaggacgacgtgttcgtgttcaacgtgcagaacgacaccgacgtgagcagcaacatcctgaacgtgaccttcagcgccctgctgcccggcggcgtgagaggccagttcttccccagcgaggacctgcaggagcagatctacctgaacagaaccctgctgaccaccatcagcacccagagagtgctgcccttcgacgacaacatctgcctgagagagccctgcgagaactacatgaagtgcgtgagcgtgctgagattcgacagcagcgcccccttcctgagcagcaccaccgtgctgttcagacccatccaccccatcaacggcctgagatgcagatgcccccccggcttcaccggcgactactgcgagaccgagatcgacctgtgctacagcgacccctgcggcgccaacggcagatgcagaagcagagagggcggctacacctgcgagtgcttcgaggacttcaccgccgtgagctag

SEQ ID NO: 74883 - DNA, 2319 bp, Artificial Sequence
  Description of Artificial Sequence: Synthetic coding sequence
tgagacttccccttccagatccacaacagcagcggctggatcaccgtgtgcgccgagctggacagagaggaggtggagcactacagcttcggcgtggaggccgtggaccacggcagcccccccatgagcagcagcaccagcgtgagcatcaccgtgctggacgtgaacgacaacgaccccgtgttcacccagcccacctacgagctgagactgaacgaggacgccgccgtgggcagcagcgtgctgaccctgcaggccagagacagagacgccaacagcgtgatcacctaccagctgaccggcggcaacaccagaaacagattcgccctgagcagccagagaggcggcggcctgatcaccctggccctgcccctggactacaagcaggagcagcagtacgtgctggccgtgaccgccagcgacggcaccagaagccacaccgcccacgtgctgatcaacgtgaccgacgccaacacccacagacccgtgttccagagcagccactacaccgtgagcgtgagcgaggacagacccgtgggcaccagcatcgccaccctgagcgccaacgacgaggacaccggcgagaacgccagaatcacctacgtgatccaggaccccgtgccccagttcagaatcgaccccgacagcggcaccatgtacaccatgatggagctggactacgagaaccaggtggcctacaccctgaccatcatggcccaggacaacggcatcccccagaagagcgacaccaccaccctggagatcctgatcctggacgccaacgacaacgccccccagttcctgtgggacttctaccagggcagcatcttcgaggacgccccccccagcaccagcatcctgcaggtgagcgccaccgacagagacagcggccccaacggcagactgctgtacaccttccagggcggcgacgacggcgacggcgacttctacatcgagcccaccagcggcgtgatcagaacccagagaagactggacagagagaacgtggccgtgtacaacctgtgggccctggccgtggacagaggcagccccacccccctgagcgccagcgtggagatccaggtgaccatcctggacatcaacgacaacgcccccatgttcgagaaggacgagctggagctgttcgtggaggagaacaaccccgtgggcagcgtggtggccaagatcagagccaacgaccccgacgagggccccaacgcccagatcatgtaccagatcgtggagggcgacatgagacacttcttccagctggacctgctgaacggcgacctgagagccatggtggagctggacttcgaggtgagaagagagtacgtgctggtggtgcaggccaccagcgcccccctggtgagcagagccaccgtgcacatcctgctggtggaccagaacgacaacccccccgtgctgcccgacttccagatcctgttcaacaactacgtgaccaacaagagcaacagcttccccaccggcgtgatcggctgcatccccgcccacgaccccgacgtgagcgacagcctgaactacaccttcgtgcagggcaacgagctgagactgctgctgctggaccccgccaccggcgagctgcagctgagcagagacctggacaacaacagacccctggaggccctgatggaggtgagcgtgagcgacggcatccacagcgtgaccgccttctgcaccctgagagtgaccatcatcaccgacgacatgctgaccaacagcatcaccgtgagactggagaacatgagccaggagaagttcctgagccccctgctggccctgttcgtggagggcgtggccgccgtgctgagcaccaccaaggacgacgtgttcgtgttcaacgtgcagaacgacaccgacgtgagcagcaacatcctgaacgtgaccttcagcgccctgctgcccggcggcgtgagaggccagttcttccccagcgaggacctgcaggagcagatctacctgaacagaaccctgctgaccaccatcagcacccagagagtgctgcccttcgacgacaacatctgcctgagagagccctgcgagaactacatgaagtgcgtgagcgtgctgagattcgacagcagcgcccccttcctgagcagcaccaccgtgctgttcagacccatccaccccatcaacggcctgagatgcagatgcccccccggcttcaccggcgactactgcgagaccgagatcgacctgtgctacagcgacccctgcggcgccaacggcagatgcagaagcagagagggcggctacacctgcgagtgcttcgaggacttcaccgagatcagctag

SEQ ID NO: 74884 - DNA, 8772 bp, Artificial Sequence
  Description of Artificial Sequence: Synthetic coding sequence
atgagaagccccgccaccggcgtgcccctgcccaccccccccccccccctgctgctgctgctgctgctgctgctgcccccccccctgctgggcgaccaggtgggcccctgcagaagcctgggcagcagaggcagaggcagcagcggcgcctgcgcccccatgggctggctgtgccccagcagcgccagcaacctgtggctgtacaccagcagatgcagagacgccggcaccgagctgaccggccacctggtgccccaccacgacggcctgagagtgtggtgccccgagagcgaggcccacatccccctgccccccgcccccgagggctgcccctggagctgcagactgctgggcatcggcggccacctgagcccccagggcaagctgaccctgcccgaggagcacccctgcctgaaggcccccagactgagatgccagagctgcaagctggcccaggcccccggcctgagagccggcgagagaagccccgaggagagcctgggcggcagaagaaagagaaacgtgaacaccgccccccagttccagccccccagctaccaggccaccgtgcccgagaaccagcccgccggcacccccgtggccagcctgagagccatcgaccccgacgagggcgaggccggcagactggagtacaccatggacgccctgttcgacagcagaagcaaccagttcttcagcctggaccccgtgaccggcgccgtgaccaccgccgaggagctggacagagagaccaagagcacccacgtgttcagagtgaccgcccaggaccacggcatgcccagaagaagcgccctggccaccctgaccatcctggtgaccgacaccaacgaccacgaccccgtgttcgagcagcaggagtacaaggagagcctgagagagaacctggaggtgggctacgaggtgctgaccgtgagagccaccgacggcgacgccccccccaacgccaacatcctgtacagactgctggagggcagcggcggcagccccagcgaggtgttcgagatcgaccccagaagcggcgtgatcagaaccagaggccccgtggacagagaggaggtggagagctaccagctgaccgtggaggccagcgaccagggcagagaccccggccccagaagcaccaccgccgccgtgttcctgagcgtggaggacgacaacgacaacgccccccagttcagcgagaagagatacgtggtgcaggtgagagaggacgtgacccccggcgcccccgtgctgagagtgaccgccagcgacagagacaagggcagcaacgccgtggtgcactacagcatcatgagcggcaacgccagaggccagttctacctggacgcccagaccggcgccctggacgtggtgagccccctggactacgagaccaccaaggagtacaccctgagagtgagagcccaggacggcggcagaccccccctgagcaacgtgagcggcctggtgaccgtgcaggtgctggacatcaacgacaacgcccccatcttcgtgagcacccccttccaggccaccgtgctggagagcgtgcccctgggctacctggtgctgcacgtgcaggccatcgacgccgacgccggcgacaacgccagactggagtacagactggccggcgtgggccacgacttccccttcaccatcaacaacggcaccggctggatcagcgtggccgccgagctggacagagaggaggtggacttctacagcttcggcgtggaggccagagaccacggcacccccgccctgaccgccagcgccagcgtgagcgtgaccgtgctggacgtgaacgacaacaaccccaccttcacccagcccgagtacaccgtgagactgaacgaggacgccgccgtgggcaccagcgtggtgaccgtgagcgccgtggacagagacgcccacagcgtgatcacctaccagatcaccagcggcaacaccagaaacagattcagcatcaccagccagagcggcggcggcctggtgagcctggccctgcccctggactacaagctggagagacagtacgtgctggccgtgaccgccagcgacggcaccagacaggacaccgcccagatcgtggtgaacgtgaccgacgccaacacccacagacccgtgttccagagcagccactacaccgtgaacgtgaacgaggacagacccgccggcaccaccgtggtgctgatcagcgccaccgacgaggacaccggcgagaacgccagaatcacctacttcatggaggacagcatcccccagttcagaatcgacgccgacaccggcgccgtgaccacccaggccgagctggactacgaggaccaggtgagctacaccctggccatcaccgccagagacaacggcatcccccagaagagcgacaccacctacctggagatcctggtgaacgacgtgaacgacaacgccccccagttcctgagagacagctaccagggcagcgtgtacgaggacgtgccccccttcaccagcgtgctgcagatcagcgccaccgacagagacagcggcctgaacggcagagtgttctacaccttccagggcggcgacgacggcgacggcgacttcatcgtggagagcaccagcggcatcgtgagaaccctgagaagactggacagagagaacgtggcccagtacgtgctgagagcctacgccgtggacaagggcatgccccccgccagaacccccatggaggtgaccgtgaccgtgctggacgtgaacgacaacccccccgtgttcgagcaggacgagttcgacgtgttcgtggaggagaacagccccatcggcctggccgtggccagagtgaccgccaccgaccccgacgagggcaccaacgcccagatcatgtaccagatcgtggagggcaacatccccgaggtgttccagctggacatcttcagcggcgagctgaccgccctggtggacctggactacgaggacagacccgagtacgtgctggtgatccaggccaccagcgcccccctggtgagcagagccaccgtgcacgtgagactgctggacagaaacgacaacccccccgtgctgggcaacttcgagatcctgttcaacaactacgtgaccaacagaagcagcagcttccccggcggcgccatcggcagagtgcccgcccacgaccccgacatcagcgacagcctgacctacagcttcgagagaggcaacgagctgagcctggtgctgctgaacgccagcaccggcgagctgaagctgagcagagccctggacaacaacagacccctggaggccatcatgagcgtgctggtgagcgacggcgtgcacagcgtgaccgcccagtgcgccctgagagtgaccatcatcaccgacgagatgctgacccacagcatcaccctgagactggaggacatgagccccgagagattcctgagccccctgctgggcctgttcatccaggccgtggccgccaccctggccaccccccccgaccacgtggtggtgttcaacgtgcagagagacaccgacgcccccggcggccacatcctgaacgtgagcctgagcgtgggccagccccccggccccggcggcggcccccccttcctgcccagcgaggacctgcaggagagactgtacctgaacagaagcctgctgaccgccatcagcgcccagagagtgctgcccttcgacgacaacatctgcctgagagagccctgcgagaactacatgagatgcgtgagcgtgctgagattcgacagcagcgcccccttcatcgccagcagcagcgtgctgttcagacccatccaccccgtgggcggcctgagatgcagatgcccccccggcttcaccggcgactactgcgagaccgaggtggacctgtgctacagcagaccctgcggcccccacggcagatgcagaagcagagagggcggctacacctgcctgtgcagagacggctacaccggcgagcactgcgaggtgagcgccagaagcggcagatgcacccccggcgtgtgcaagaacggcggcacctgcgtgaacctgctggtgggcggcttcaagtgcgactgccccagcggcgacttcgagaagccctactgccaggtgaccaccagaagcttccccgcccacagcttcatcaccttcagaggcctgagacagagattccacttcaccctggccctgagcttcgccaccaaggagagagacggcctgctgctgtacaacggcagattcaacgagaagcacgacttcgtggccctggaggtgatccaggagcaggtgcagctgaccttcagcgccggcgagagcaccaccaccgtgagccccttcgtgcccggcggcgtgagcgacggccagtggcacaccgtgcagctgaagtactacaacaagcccctgctgggccagaccggcctgccccagggccccagcgagcagaaggtggccgtggtgaccgtggacggctgcgacaccggcgtggccctgagattcggcagcgtgctgggcaactacagctgcgccgcccagggcacccagggcggcagcaagaagagcctggacctgaccggccccctgctgctgggcggcgtgcccgacctgcccgagagcttccccgtgagaatgagacagttcgtgggctgcatgagaaacctgcaggtggacagcagacacatcgacatggccgacttcatcgccaacaacggcaccgtgcccggctgccccgccaagaagaacgtgtgcgacagcaacacctgccacaacggcggcacctgcgtgaaccagtgggacgccttcagctgcgagtgccccctgggcttcggcggcaagagctgcgcccaggagatggccaacccccagcacttcctgggcagcagcctggtggcctggcacggcctgagcctgcccatcagccagccctggtacctgagcctgatgttcagaaccagacaggccgacggcgtgctgctgcaggccatcaccagaggcagaagcaccatcaccctgcagctgagagagggccacgtgatgctgagcgtggagggcaccggcctgcaggccagcagcctgagactggagcccggcagagccaacgacggcgactggcaccacgcccagctggccctgggcgccagcggcggccccggccacgccatcctgagcttcgactacggccagcagagagccgagggcaacctgggccccagactgcacggcctgcacctgagcaacatcaccgtgggcggcatccccggccccgccggcggcgtggccagaggcttcagaggctgcctgcagggcgtgagagtgagcgacacccccgagggcgtgaacagcctggaccccagccacggcgagagcatcaacgtggagcagggctgcagcctgcccgacccctgcgacagcaacccctgccccgccaacagctactgcagcaacgactgggacagctacagctgcagctgcgaccccggctactacggcgacaactgcaccaacgtgtgcgacctgaacccctgcgagcaccagagcgtgtgcaccagaaagcccagcgccccccacggctacacctgcgagtgcccccccaactacctgggcccctactgcgagaccagaatcgaccagccctgccccagaggctggtggggccaccccacctgcggcccctgcaactgcgacgtgagcaagggcttcgaccccgactgcaacaagaccagcggcgagtgccactgcaaggagaaccactacagaccccccggcagccccacctgcctgctgtgcgactgctaccccaccggcagcctgagcagagtgtgcgaccccgaggacggccagtgcccctgcaagcccggcgtgatcggcagacagtgcgacagatgcgacaaccccttcgccgaggtgaccaccaacggctgcgaggtgaactacgacagctgccccagagccatcgaggccggcatctggtggcccagaaccagattcggcctgcccgccgccgccccctgccccaagggcagcttcggcaccgccgtgagacactgcgacgagcacagaggctggctgccccccaacctgttcaactgcaccagcatcaccttcagcgagctgaagggcttcgccgagagactgcagagaaacgagagcggcctggacagcggcagaagccagcagctggccctgctgctgagaaacgccacccagcacaccgccggctacttcggcagcgacgtgaaggtggcctaccagctggccaccagactgctggcccacgagagcacccagagaggcttcggcctgagcgccacccaggacgtgcacttcaccgagaacctgctgagagtgggcagcgccctgctggacaccgccaacaagagacactgggagctgatccagcagaccgagggcggcaccgcctggctgctgcagcactacgaggcctacgccagcgccctggcccagaacatgagacacacctacctgagccccttcaccatcgtgacccccaacatcgtgatcagcgtggtgagactggacaagggcaacttcgccggcgccaagctgcccagatacgaggccctgagaggcgagcagccccccgacctggagaccaccgtgatcctgcccgagagcgtgttcagagagaccccccccgtggtgagacccgccggccccggcgaggcccaggagcccgaggagctggccagaagacagagaagacaccccgagctgagccagggcgaggccgtggccagcgtgatcatctacagaaccctggccggcctgctgccccacaactacgaccccgacaagagaagcctgagagtgcccaagagacccatcatcaacacccccgtggtgagcatcagcgtgcacgacgacgaggagctgctgcccagagccctggacaagcccgtgaccgtgcagttcagactgctggagaccgaggagagaaccaagcccatctgcgtgttctggaaccacagcatcctggtgagcggcaccggcggctggagcgccagaggctgcgaggtggtgttcagaaacgagagccacgtgagctgccagtgcaaccacatgaccagcttcgccgtgctgatggacgtgagcagaagagagaacggcgagatcctgcccctgaagaccctgacctacgtggccctgggcgtgaccctggccgccctgctgctgaccttcttcttcctgaccctgctgagaatcctgagaagcaaccagcacggcatcagaagaaacctgaccgccgccctgggcctggcccagctggtgttcctgctgggcatcaaccaggccgacctgcccttcgcctgcaccgtgatcgccatcctgctgcacttcctgtacctgtgcaccttcagctgggccctgctggaggccctgcacctgtacagagccctgaccgaggtgagagacgtgaacaccggccccatgagattctactacatgctgggctggggcgtgcccgccttcatcaccggcctggccgtgggcctggaccccgagggctacggcaaccccgacttctgctggctgagcatctacgacaccctgatctggagcttcgccggccccgtggccttcgccgtgagcatgagcgtgttcctgtacatcctggccgccagagccagctgcgccgcccagagacagggcttcgagaagaagggccccgtgagcggcctgcagcccagcttcgccgtgctgctgctgctgagcgccacctggctgctggccctgctgagcgtgaacagcgacaccctgctgttccactacctgttcgccacctgcaactgcatccagggccccttcatcttcctgagctacgtggtgctgagcaaggaggtgagaaaggccctgaagctggcctgcagcagaaagcccagccccgaccccgccctgaccaccaagagcaccctgaccagcagctacaactgccccagcccctacgccgacggcagactgtaccagccctacggcgacagcgccggcagcctgcacagcaccagcagaagcggcaagagccagcccagctacatccccttcctgctgagagaggagagcgccctgaaccccggccagggcccccccggcctgggcgaccccggcagcctgttcctggagggccaggaccagcagcacgaccccgacaccgacagcgacagcgacctgagcctggaggacgaccagagcggcagctacgccagcacccacagcagcgacagcgaggaggaggaggaggaggaggaggaggaggccgccttccccggcgagcagggctgggacagcctgctgggccccggcgccgagagactgcccctgcacagcacccccaaggacggcggccccggccccggcaaggccccctggcccggcgacttcggcaccaccgccaaggagagcagcggcaacggcgcccccgaggagagactgagagagaacggcgacgccctgagcagagagggcagcctgggccccctgcccggcagcagcgcccagccccacaagggcatcctgaagaagaagtgcctgcccaccatcagcgagaagagcagcctgctgagactgcccctggagcagtgcaccggcagcagcagaggcagcagcgccagcgagggcagcagaggcggccccccccccagacccccccccagacagagcctgcaggagcagctgaacggcgtgatgcccatcgccatgagcatcaaggccggcaccgtggacgaggacagcagcggcagcgagttcctgttcttcaacttcctgcactag

SEQ ID NO: 74885 - DNA, 9939 bp, Artificial Sequence
  Description of Artificial Sequence: Synthetic coding sequence
atgatggccagaagacccccctggagaggcctgggcggcagaagcacccccatcctgctgctgctgctgctgagcctgttccccctgagccaggaggagctgggcggcggcggccaccagggctgggaccccggcctggccgccaccaccggccccagagcccacatcggcggcggcgccctggccctgtgccccgagagcagcggcgtgagagaggacggcggccccggcctgggcgtgagagagcccatcttcgtgggcctgagaggcagaagacagagcgccagaaacagcagaggcccccccgagcagcccaacgaggagctgggcatcgagcacggcgtgcagcccctgggcagcagagagagagagaccggccagggccccggcagcgtgctgtactggagacccgaggtgagcagctgcggcagaaccggccccctgcagagaggcagcctgagccccggcgccctgagcagcggcgtgcccggcagcggcaacagcagccccctgcccagcgacttcctgatcagacaccacggccccaagcccgtgagcagccagagaaacgccggcaccggcagcagaaagagagtgggcaccgccagatgctgcggcgagctgtgggccaccggcagcaagggccagggcgagagagccaccaccagcggcgccgagagaaccgcccccagaagaaactgcctgcccggcgccagcggcagcggccccgagctggacagcgcccccagaaccgccagaaccgcccccgccagcggcagcgcccccagagagagcagaaccgcccccgagcccgcccccaagagaatgagaagcagaggcctgttcagatgcagattcctgccccagagacccggccccagaccccccggcctgcccgccagacccgaggccagaaaggtgaccagcgccaacagagccagattcagaagagccgccaacagacacccccagttcccccagtacaactaccagaccctggtgcccgagaacgaggccgccggcaccgccgtgctgagagtggtggcccaggaccccgacgccggcgaggccggcagactggtgtacagcctggccgccctgatgaacagcagaagcctggagctgttcagcatcgacccccagagcggcctgatcagaaccgccgccgccctggacagagagagcatggagagacactacctgagagtgaccgcccaggaccacggcagccccagactgagcgccaccaccatggtggccgtgaccgtggccgacagaaacgaccacagccccgtgttcgagcaggcccagtacagagagaccctgagagagaacgtggaggagggctaccccatcctgcagctgagagccaccgacggcgacgccccccccaacgccaacctgagatacagattcgtgggcccccccgccgccagagccgccgccgccgccgccttcgagatcgaccccagaagcggcctgatcagcaccagcggcagagtggacagagagcacatggagagctacgagctggtggtggaggccagcgaccagggccaggagcccggccccagaagcgccaccgtgagagtgcacatcaccgtgctggacgagaacgacaacgccccccagttcagcgagaagagatacgtggcccaggtgagagaggacgtgagaccccacaccgtggtgctgagagtgaccgccaccgacagagacaaggacgccaacggcctggtgcactacaacatcatcagcggcaacagcagaggccacttcgccatcgacagcctgaccggcgagatccaggtggtggcccccctggacttcgaggccgagagagagtacgccctgagaatcagagcccaggacgccggcagaccccccctgagcaacaacaccggcctggccagcatccaggtggtggacatcaacgaccacatccccatcttcgtgagcacccccttccaggtgagcgtgctggagaacgcccccctgggccacagcgtgatccacatccaggccgtggacgccgaccacggcgagaacgccagactggagtacagcctgaccggcgtggcccccgacacccccttcgtgatcaacagcgccaccggctgggtgagcgtgagcggccccctggacagagagagcgtggagcactacttcttcggcgtggaggccagagaccacggcagcccccccctgagcgccagcgccagcgtgaccgtgaccgtgctggacgtgaacgacaacagacccgagttcaccatgaaggagtaccacctgagactgaacgaggacgccgccgtgggcaccagcgtggtgagcgtgaccgccgtggacagagacgccaacagcgccatcagctaccagatcaccggcggcaacaccagaaacagattcgccatcagcacccagggcggcgtgggcctggtgaccctggccctgcccctggactacaagcaggagagatacttcaagctggtgctgaccgccagcgacagagccctgcacgaccactgctacgtgcacatcaacatcaccgacgccaacacccacagacccgtgttccagagcgcccactacagcgtgagcgtgaacgaggacagacccatgggcagcaccatcgtggtgatcagcgccagcgacgacgacgtgggcgagaacgccagaatcacctacctgctggaggacaacctgccccagttcagaatcgacgccgacagcggcgccatcaccctgcaggcccccctggactacgaggaccaggtgacctacaccctggccatcaccgccagagacaacggcatcccccagaaggccgacaccacctacgtggaggtgatggtgaacgacgtgaacgacaacgccccccagttcgtggccagccactacaccggcctggtgagcgaggacgccccccccttcaccagcgtgctgcagatcagcgccaccgacagagacgcccacgccaacggcagagtgcagtacaccttccagaacggcgaggacggcgacggcgacttcaccatcgagcccaccagcggcatcgtgagaaccgtgagaagactggacagagaggccgtgagcgtgtacgagctgaccgcctacgccgtggacagaggcgtgccccccctgagaacccccgtgagcatccaggtgatggtgcaggacgtgaacgacaacgcccccgtgttccccgccgaggagttcgaggtgagagtgaaggagaacagcatcgtgggcagcgtggtggcccagatcaccgccgtggaccccgacgagggccccaacgcccacatcatgtaccagatcgtggagggcaacatccccgagctgttccagatggacatcttcagcggcgagctgaccgccctgatcgacctggactacgaggccagacaggagtacgtgatcgtggtgcaggccaccagcgcccccctggtgagcagagccaccgtgcacgtgagactggtggaccagaacgacaacagccccgtgctgaacaacttccagatcctgttcaacaactacgtgagcaacagaagcgacaccttccccagcggcatcatcggcagaatccccgcctacgaccccgacgtgagcgaccacctgttctacagcttcgagagaggcaacgagctgcagctgctggtggtgaaccagaccagcggcgagctgagactgagcagaaagctggacaacaacagacccctggtggccagcatgctggtgaccgtgaccgacggcctgcacagcgtgaccgcccagtgcgtgctgagagtggtgatcatcaccgaggagctgctggccaacagcctgaccgtgagactggagaacatgtggcaggagagattcctgagccccctgctgggcagattcctggagggcgtggccgccgtgctggccacccccgccgaggacgtgttcatcttcaacatccagaacgacaccgacgtgggcggcaccgtgctgaacgtgagcttcagcgccctggcccccagaggcgccggcgccggcgccgccggcccctggttcagcagcgaggagctgcaggagcagctgtacgtgagaagagccgccctggccgccagaagcctgctggacgtgctgcccttcgacgacaacgtgtgcctgagagagccctgcgagaactacatgaagtgcgtgagcgtgctgagattcgacagcagcgcccccttcctggccagcgccagcaccctgttcagacccatccagcccatcgccggcctgagatgcagatgcccccccggcttcaccggcgacttctgcgagaccgagctggacctgtgctacagcaacccctgcagaaacggcggcgcctgcgccagaagagagggcggctacacctgcgtgtgcagacccagattcaccggcgaggactgcgagctggacaccgaggccggcagatgcgtgcccggcgtgtgcagaaacggcggcacctgcaccgacgcccccaacggcggcttcagatgccagtgccccgccggcggcgccttcgagggccccagatgcgaggtggccgccagaagcttcccccccagcagcttcgtgatgttcagaggcctgagacagagattccacctgaccctgagcctgagcttcgccaccgtgcagcagagcggcctgctgttctacaacggcagactgaacgagaagcacgacttcctggccctggagctggtggccggccaggtgagactgacctacagcaccggcgagagcaacaccgtggtgagccccaccgtgcccggcggcctgagcgacggccagtggcacaccgtgcacctgagatactacaacaagcccagaaccgacgccctgggcggcgcccagggccccagcaaggacaaggtggccgtgctgagcgtggacgactgcgacgtggccgtggccctgcagttcggcgccgagatcggcaactacagctgcgccgccgccggcgtgcagaccagcagcaagaagagcctggacctgaccggccccctgctgctgggcggcgtgcccaacctgcccgagaacttccccgtgagccacaaggacttcatcggctgcatgagagacctgcacatcgacggcagaagagtggacatggccgccttcgtggccaacaacggcaccatggccggctgccaggccaagctgcacttctgcgacagcggcccctgcaagaacagcggcttctgcagcgagagatggggcagcttcagctgcgactgccccgtgggcttcggcggcaaggactgccagctgaccatggcccacccccaccacttcagaggcaacggcaccctgagctggaacttcggcagcgacatggccgtgagcgtgccctggtacctgggcctggccttcagaaccagagccacccagggcgtgctgatgcaggtgcaggccggcccccacagcaccctgctgtgccagctggacagaggcctgctgagcgtgaccgtgaccagaggcagcggcagagccagccacctgctgctggaccaggtgaccgtgagcgacggcagatggcacgacctgagactggagctgcaggaggagcccggcggcagaagaggccaccacgtgctgatggtgagcctggacttcagcctgttccaggacaccatggccgtgggcagcgagctgcagggcctgaaggtgaagcagctgcacgtgggcggcctgccccccggcagcgccgaggaggccccccagggcctggtgggctgcatccagggcgtgtggctgggcagcacccccagcggcagccccgccctgctgccccccagccacagagtgaacgccgagcccggctgcgtggtgaccaacgcctgcgccagcggcccctgccccccccacgccgactgcagagacctgtggcagaccttcagctgcacctgccagcccggctactacggccccggctgcgtggacgcctgcctgctgaacccctgccagaaccagggcagctgcagacacctgcccggcgccccccacggctacacctgcgactgcgtgggcggctacttcggccaccactgcgagcacagaatggaccagcagtgccccagaggctggtggggcagccccacctgcggcccctgcaactgcgacgtgcacaagggcttcgaccccaactgcaacaagaccaacggccagtgccactgcaaggagttccactacagacccagaggcagcgacagctgcctgccctgcgactgctaccccgtgggcagcaccagcagaagctgcgccccccacagcggccagtgcccctgcagacccggcgccctgggcagacagtgcaacagctgcgacagccccttcgccgaggtgaccgccagcggctgcagagtgctgtacgacgcctgccccaagagcctgagaagcggcgtgtggtggccccagaccaagttcggcgtgctggccaccgtgccctgccccagaggcgccctgggcgccgccgtgagactgtgcgacgaggcccagggctggctggagcccgacctgttcaactgcaccagccccgccttcagagagctgagcctgctgctggacggcctggagctgaacaagaccgccctggacaccatggaggccaagaagctggcccagagactgagagaggtgaccggccacaccgaccactacttcagccaggacgtgagagtgaccgccagactgctggcccacctgctggccttcgagagccaccagcagggcttcggcctgaccgccacccaggacgcccacttcaacgagaacctgctgtgggccggcagcgccctgctggcccccgagaccggcgacctgtgggccgccctgggccagagagcccccggcggcagccccggcagcgccggcctggtgagacacctggaggagtacgccgccaccctggccagaaacatggagctgacctacctgaaccccatgggcctggtgacccccaacatcatgctgagcatcgacagaatggagcaccccagcagccccagaggcgccagaagataccccagataccacagcaacctgttcagaggccaggacgcctgggacccccacacccacgtgctgctgcccagccagagccccagacccagccccagcgaggtgctgcccaccagcagcagcatcgagaacagcaccaccagcagcgtggtgcccccccccgccccccccgagcccgagcccggcatcagcatcatcatcctgctggtgtacagaaccctgggcggcctgctgcccgcccagttccaggccgagagaagaggcgccagactgccccagaaccccgtgatgaacagccccgtggtgagcgtggccgtgttccacggcagaaacttcctgagaggcatcctggagagccccatcagcctggagttcagactgctgcagaccgccaacagaagcaaggccatctgcgtgcagtgggacccccccggcctggccgagcagcacggcgtgtggaccgccagagactgcgagctggtgcacagaaacggcagccacgccagatgcagatgcagcagaaccggcaccttcggcgtgctgatggacgccagccccagagagagactggagggcgacctggagctgctggccgtgttcacccacgtggtggtggccgtgagcgtggccgccctggtgctgaccgccgccatcctgctgagcctgagaagcctgaagagcaacgtgagaggcatccacgccaacgtggccgccgccctgggcgtggccgagctgctgttcctgctgggcatccacagaacccacaaccagctggtgtgcaccgccgtggccatcctgctgcactacttcttcctgagcaccttcgcctggctgttcgtgcagggcctgcacctgtacagaatgcaggtggagcccagaaacgtggacagaggcgccatgagattctaccacgccctgggctggggcgtgcccgccgtgctgctgggcctggccgtgggcctggaccccgagggctacggcaaccccgacttctgctggatcagcgtgcacgagcccctgatctggagcttcgccggccccgtggtgctggtgatcgtgatgaacggcaccatgttcctgctggccgccagaaccagctgcagcaccggccagagagaggccaagaagaccagcgccctgaccctgagaagcagcttcctgctgctgctgctggtgagcgccagctggctgttcggcctgctggccgtgaaccacagcatcctggccttccactacctgcacgccggcctgtgcggcctgcagggcctggccgtgctgctgctgttctgcgtgctgaacgccgacgccagagccgcctggatgcccgcctgcctgggcagaaaggccgcccccgaggaggccagacccgcccccggcctgggccccggcgcctacaacaacaccgccctgttcgaggagagcggcctgatcagaatcaccctgggcgccagcaccgtgagcagcgtgagcagcgccagaagcggcagaacccaggaccaggacagccagagaggcagaagctacctgagagacaacgtgctggtgagacacggcagcgccgccgaccacaccgaccacagcctgcaggcccacgccggccccaccgacctggacgtggccatgttccacagagacgccggcgccgacagcgacagcgacagcgacctgagcctggaggaggagagaagcctgagcatccccagcagcgagagcgaggacaacggcagaaccagaggcagattccagagacccctgtgcagagccgcccagagcgagagactgctgacccaccccaaggacgtggacggcaacgacctgctgagctactggcccgccctgggcgagtgcgaggccgccccctgcgccctgcagacctggggcagcgagagaagactgggcctggacaccagcaaggacgccgccaacaacaaccagcccgaccccgccctgaccagcggcgacgagaccagcctgggcagagcccagagacagagaaagggcatcctgaagaacagactgcagtaccccctggtgccccagaccagaggcgcccccgagctgagctggtgcagagccgccaccctgggccacagagccgtgcccgccgccagctacggcagaatctacgccggcggcggcaccggcagcctgagccagcccgccagcagatacagcagcagagagcagctggacctgctgctgagaagacagctgagcagagagagactggaggaggcccccgcccccgtgctgagacccctgagcagacccggcagccaggagtgcatggacgccgcccccggcagactggagcccaaggacagaggcagcaccctgcccagaagacagccccccagagactaccccggcgccatggccggcagattcggcagcagagacgccctggacctgggcgcccccagagagtggctgagcaccctgcccccccccagaagaaccagagacctggacccccagcccccccccctgcccctgagcccccagagacagctgagcagagaccccctgctgcccagcagacccctggacagcctgagcagaagcagcaacagcagagagcagctggaccaggtgcccagcagacaccccagcagagaggccctgggccccctgccccagctgctgagagccagagaggacagcgtgagcggccccagccacggccccagcaccgagcagctggacatcctgagcagcatcctggccagcttcaacagcagcgccctgagcagcgtgcagagcagcagcacccccctgggcccccacaccaccgccacccccagcgccaccgccagcgtgctgggccccagcacccccagaagcgccaccagccacagcatcagcgagctgagccccgacagcgaggtgcccagaagcgagggccacagctag

SEQ ID NO: 74886 - DNA, 9954 bp, Artificial Sequence
  Description of Artificial Sequence: Synthetic coding sequence
atgatggccagaagacccccctggagaggcctgggcggcagaagcacccccatcctgctgctgctgctgctgagcctgttccccctgagccaggaggagctgggcggcggcggccaccagggctgggaccccggcctggccgccaccaccggccccagagcccacatcggcggcggcgccctggccctgtgccccgagagcagcggcgtgagagaggacggcggccccggcctgggcgtgagagagcccatcttcgtgggcctgagaggcagaagacagagcgccagaaacagcagaggcccccccgagcagcccaacgaggagctgggcatcgagcacggcgtgcagcccctgggcagcagagagagagagaccggccagggccccggcagcgtgctgtactggagacccgaggtgagcagctgcggcagaaccggccccctgcagagaggcagcctgagccccggcgccctgagcagcggcgtgcccggcagcggcaacagcagccccctgcccagcgacttcctgatcagacaccacggccccaagcccgtgagcagccagagaaacgccggcaccggcagcagaaagagagtgggcaccgccagatgctgcggcgagctgtgggccaccggcagcaagggccagggcgagagagccaccaccagcggcgccgagagaaccgcccccagaagaaactgcctgcccggcgccagcggcagcggccccgagctggacagcgcccccagaaccgccagaaccgcccccgccagcggcagcgcccccagagagagcagaaccgcccccgagcccgcccccaagagaatgagaagcagaggcctgttcagatgcagattcctgccccagagacccggccccagaccccccggcctgcccgccagacccgaggccagaaaggtgaccagcgccaacagagccagattcagaagagccgccaacagacacccccagttcccccagtacaactaccagaccctggtgcccgagaacgaggccgccggcaccgccgtgctgagagtggtggcccaggaccccgacgccggcgaggccggcagactggtgtacagcctggccgccctgatgaacagcagaagcctggagctgttcagcatcgacccccagagcggcctgatcagaaccgccgccgccctggacagagagagcatggagagacactacctgagagtgaccgcccaggaccacggcagccccagactgagcgccaccaccatggtggccgtgaccgtggccgacagaaacgaccacagccccgtgttcgagcaggcccagtacagagagaccctgagagagaacgtggaggagggctaccccatcctgcagctgagagccaccgacggcgacgccccccccaacgccaacctgagatacagattcgtgggcccccccgccgccagagccgccgccgccgccgccttcgagatcgaccccagaagcggcctgatcagcaccagcggcagagtggacagagagcacatggagagctacgagctggtggtggaggccagcgaccagggccaggagcccggccccagaagcgccaccgtgagagtgcacatcaccgtgctggacgagaacgacaacgccccccagttcagcgagaagagatacgtggcccaggtgagagaggacgtgagaccccacaccgtggtgctgagagtgaccgccaccgacagagacaaggacgccaacggcctggtgcactacaacatcatcagcggcaacagcagaggccacttcgccatcgacagcctgaccggcgagatccaggtggtggcccccctggacttcgaggccgagagagagtacgccctgagaatcagagcccaggacgccggcagaccccccctgagcaacaacaccggcctggccagcatccaggtggtggacatcaacgaccacatccccatcttcgtgagcacccccttccaggtgagcgtgctggagaacgcccccctgggccacagcgtgatccacatccaggccgtggacgccgaccacggcgagaacgccagactggagtacagcctgaccggcgtggcccccgacacccccttcgtgatcaacagcgccaccggctgggtgagcgtgagcggccccctggacagagagagcgtggagcactacttcttcggcgtggaggccagagaccacggcagcccccccctgagcgccagcgccagcgtgaccgtgaccgtgctggacgtgaacgacaacagacccgagttcaccatgaaggagtaccacctgagactgaacgaggacgccgccgtgggcaccagcgtggtgagcgtgaccgccgtggacagagacgccaacagcgccatcagctaccagatcaccggcggcaacaccagaaacagattcgccatcagcacccagggcggcgtgggcctggtgaccctggccctgcccctggactacaagcaggagagatacttcaagctggtgctgaccgccagcgacagagccctgcacgaccactgctacgtgcacatcaacatcaccgacgccaacacccacagacccgtgttccagagcgcccactacagcgtgagcgtgaacgaggacagacccatgggcagcaccatcgtggtgatcagcgccagcgacgacgacgtgggcgagaacgccagaatcacctacctgctggaggacaacctgccccagttcagaatcgacgccgacagcggcgccatcaccctgcaggcccccctggactacgaggaccaggtgacctacaccctggccatcaccgccagagacaacggcatcccccagaaggccgacaccacctacgtggaggtgatggtgaacgacgtgaacgacaacgccccccagttcgtggccagccactacaccggcctggtgagcgaggacgccccccccttcaccagcgtgctgcagatcagcgccaccgacagagacgcccacgccaacggcagagtgcagtacaccttccagaacggcgaggacggcgacggcgacttcaccatcgagcccaccagcggcatcgtgagaaccgtgagaagactggacagagaggccgtgagcgtgtacgagctgaccgcctacgccgtggacagaggcgtgccccccctgagaacccccgtgagcatccaggtgatggtgcaggacgtgaacgacaacgcccccgtgttccccgccgaggagttcgaggtgagagtgaaggagaacagcatcgtgggcagcgtggtggcccagatcaccgccgtggaccccgacgagggccccaacgcccacatcatgtaccagatcgtggagggcaacatccccgagctgttccagatggacatcttcagcggcgagctgaccgccctgatcgacctggactacgaggccagacaggagtacgtgatcgtggtgcaggccaccagcgcccccctggtgagcagagccaccgtgcacgtgagactggtggaccagaacgacaacagccccgtgctgaacaacttccagatcctgttcaacaactacgtgagcaacagaagcgacaccttccccagcggcatcatcggcagaatccccgcctacgaccccgacgtgagcgaccacctgttctacagcttcgagagaggcaacgagctgcagctgctggtggtgaaccagaccagcggcgagctgagactgagcagaaagctggacaacaacagacccctggtggccagcatgctggtgaccgtgaccgacggcctgcacagcgtgaccgcccagtgcgtgctgagagtggtgatcatcaccgaggagctgctggccaacagcctgaccgtgagactggagaacatgtggcaggagagattcctgagccccctgctgggcagattcctggagggcgtggccgccgtgctggccacccccgccgaggacgtgttcatcttcaacatccagaacgacaccgacgtgggcggcaccgtgctgaacgtgagcttcagcgccctggcccccagaggcgccggcgccggcgccgccggcccctggttcagcagcgaggagctgcaggagcagctgtacgtgagaagagccgccctggccgccagaagcctgctggacgtgctgcccttcgacgacaacgtgtgcctgagagagccctgcgagaactacatgaagtgcgtgagcgtgctgagattcgacagcagcgcccccttcctggccagcgccagcaccctgttcagacccatccagcccatcgccggcctgagatgcagatgcccccccggcttcaccggcgacttctgcgagaccgagctggacctgtgctacagcaacccctgcagaaacggcggcgcctgcgccagaagagagggcggctacacctgcgtgtgcagacccagattcaccggcgaggactgcgagctggacaccgaggccggcagatgcgtgcccggcgtgtgcagaaacggcggcacctgcaccgacgcccccaacggcggcttcagatgccagtgccccgccggcggcgccttcgagggccccagatgcgaggtggccgccagaagcttcccccccagcagcttcgtgatgttcagaggcctgagacagagattccacctgaccctgagcctgagcttcgccaccgtgcagcagagcggcctgctgttctacaacggcagactgaacgagaagcacgacttcctggccctggagctggtggccggccaggtgagactgacctacagcaccggcgagagcaacaccgtggtgagccccaccgtgcccggcggcctgagcgacggccagtggcacaccgtgcacctgagatactacaacaagcccagaaccgacgccctgggcggcgcccagggccccagcaaggacaaggtggccgtgctgagcgtggacgactgcgacgtggccgtggccctgcagttcggcgccgagatcggcaactacagctgcgccgccgccggcgtgcagaccagcagcaagaagagcctggacctgaccggccccctgctgctgggcggcgtgcccaacctgcccgagaacttccccgtgagccacaaggacttcatcggctgcatgagagacctgcacatcgacggcagaagagtggacatggccgccttcgtggccaacaacggcaccatggccggctgccaggccaagctgcacttctgcgacagcggcccctgcaagaacagcggcttctgcagcgagagatggggcagcttcagctgcgactgccccgtgggcttcggcggcaaggactgccagctgaccatggcccacccccaccacttcagaggcaacggcaccctgagctggaacttcggcagcgacatggccgtgagcgtgccctggtacctgggcctggccttcagaaccagagccacccagggcgtgctgatgcaggtgcaggccggcccccacagcaccctgctgtgccagctggacagaggcctgctgagcgtgaccgtgaccagaggcagcggcagagccagccacctgctgctggaccaggtgaccgtgagcgacggcagatggcacgacctgagactggagctgcaggaggagcccggcggcagaagaggccaccacgtgctgatggtgagcctggacttcagcctgttccaggacaccatggccgtgggcagcgagctgcagggcctgaaggtgaagcagctgcacgtgggcggcctgccccccggcagcgccgaggaggccccccagggcctggtgggctgcatccagggcgtgtggctgggcagcacccccagcggcagccccgccctgctgccccccagccacagagtgaacgccgagcccggctgcgtggtgaccaacgcctgcgccagcggcccctgccccccccacgccgactgcagagacctgtggcagaccttcagctgcacctgccagcccggctactacggccccggctgcgtggacgcctgcctgctgaacccctgccagaaccagggcagctgcagacacctgcccggcgccccccacggctacacctgcgactgcgtgggcggctacttcggccaccactgcgagcacagaatggaccagcagtgccccagaggctggtggggcagccccacctgcggcccctgcaactgcgacgtgcacaagggcttcgaccccaactgcaacaagaccaacggccagtgccactgcaaggagttccactacagacccagaggcagcgacagctgcctgccctgcgactgctaccccgtgggcagcaccagcagaagctgcgccccccacagcggccagtgcccctgcagacccggcgccctgggcagacagtgcaacagctgcgacagccccttcgccgaggtgaccgccagcggctgcagagtgctgtacgacgcctgccccaagagcctgagaagcggcgtgtggtggccccagaccaagttcggcgtgctggccaccgtgccctgccccagaggcgccctgggcctgagaggcgccggcgccgccgtgagactgtgcgacgaggcccagggctggctggagcccgacctgttcaactgcaccagccccgccttcagagagctgagcctgctgctggacggcctggagctgaacaagaccgccctggacaccatggaggccaagaagctggcccagagactgagagaggtgaccggccacaccgaccactacttcagccaggacgtgagagtgaccgccagactgctggcccacctgctggccttcgagagccaccagcagggcttcggcctgaccgccacccaggacgcccacttcaacgagaacctgctgtgggccggcagcgccctgctggcccccgagaccggcgacctgtgggccgccctgggccagagagcccccggcggcagccccggcagcgccggcctggtgagacacctggaggagtacgccgccaccctggccagaaacatggagctgacctacctgaaccccatgggcctggtgacccccaacatcatgctgagcatcgacagaatggagcaccccagcagccccagaggcgccagaagataccccagataccacagcaacctgttcagaggccaggacgcctgggacccccacacccacgtgctgctgcccagccagagccccagacccagccccagcgaggtgctgcccaccagcagcagcatcgagaacagcaccaccagcagcgtggtgcccccccccgccccccccgagcccgagcccggcatcagcatcatcatcctgctggtgtacagaaccctgggcggcctgctgcccgcccagttccaggccgagagaagaggcgccagactgccccagaaccccgtgatgaacagccccgtggtgagcgtggccgtgttccacggcagaaacttcctgagaggcatcctggagagccccatcagcctggagttcagactgctgcagaccgccaacagaagcaaggccatctgcgtgcagtgggacccccccggcctggccgagcagcacggcgtgtggaccgccagagactgcgagctggtgcacagaaacggcagccacgccagatgcagatgcagcagaaccggcaccttcggcgtgctgatggacgccagccccagagagagactggagggcgacctggagctgctggccgtgttcacccacgtggtggtggccgtgagcgtggccgccctggtgctgaccgccgccatcctgctgagcctgagaagcctgaagagcaacgtgagaggcatccacgccaacgtggccgccgccctgggcgtggccgagctgctgttcctgctgggcatccacagaacccacaaccagctggtgtgcaccgccgtggccatcctgctgcactacttcttcctgagcaccttcgcctggctgttcgtgcagggcctgcacctgtacagaatgcaggtggagcccagaaacgtggacagaggcgccatgagattctaccacgccctgggctggggcgtgcccgccgtgctgctgggcctggccgtgggcctggaccccgagggctacggcaaccccgacttctgctggatcagcgtgcacgagcccctgatctggagcttcgccggccccgtggtgctggtgatcgtgatgaacggcaccatgttcctgctggccgccagaaccagctgcagcaccggccagagagaggccaagaagaccagcgccctgaccctgagaagcagcttcctgctgctgctgctggtgagcgccagctggctgttcggcctgctggccgtgaaccacagcatcctggccttccactacctgcacgccggcctgtgcggcctgcagggcctggccgtgctgctgctgttctgcgtgctgaacgccgacgccagagccgcctggatgcccgcctgcctgggcagaaaggccgcccccgaggaggccagacccgcccccggcctgggccccggcgcctacaacaacaccgccctgttcgaggagagcggcctgatcagaatcaccctgggcgccagcaccgtgagcagcgtgagcagcgccagaagcggcagaacccaggaccaggacagccagagaggcagaagctacctgagagacaacgtgctggtgagacacggcagcgccgccgaccacaccgaccacagcctgcaggcccacgccggccccaccgacctggacgtggccatgttccacagagacgccggcgccgacagcgacagcgacagcgacctgagcctggaggaggagagaagcctgagcatccccagcagcgagagcgaggacaacggcagaaccagaggcagattccagagacccctgtgcagagccgcccagagcgagagactgctgacccaccccaaggacgtggacggcaacgacctgctgagctactggcccgccctgggcgagtgcgaggccgccccctgcgccctgcagacctggggcagcgagagaagactgggcctggacaccagcaaggacgccgccaacaacaaccagcccgaccccgccctgaccagcggcgacgagaccagcctgggcagagcccagagacagagaaagggcatcctgaagaacagactgcagtaccccctggtgccccagaccagaggcgcccccgagctgagctggtgcagagccgccaccctgggccacagagccgtgcccgccgccagctacggcagaatctacgccggcggcggcaccggcagcctgagccagcccgccagcagatacagcagcagagagcagctggacctgctgctgagaagacagctgagcagagagagactggaggaggcccccgcccccgtgctgagacccctgagcagacccggcagccaggagtgcatggacgccgcccccggcagactggagcccaaggacagaggcagcaccctgcccagaagacagccccccagagactaccccggcgccatggccggcagattcggcagcagagacgccctggacctgggcgcccccagagagtggctgagcaccctgcccccccccagaagaaccagagacctggacccccagcccccccccctgcccctgagcccccagagacagctgagcagagaccccctgctgcccagcagacccctggacagcctgagcagaagcagcaacagcagagagcagctggaccaggtgcccagcagacaccccagcagagaggccctgggccccctgccccagctgctgagagccagagaggacagcgtgagcggccccagccacggccccagcaccgagcagctggacatcctgagcagcatcctggccagcttcaacagcagcgccctgagcagcgtgcagagcagcagcacccccctgggcccccacaccaccgccacccccagcgccaccgccagcgtgctgggccccagcacccccagaagcgccaccagccacagcatcagcgagctgagccccgacagcgaggtgcccagaagcgagggccacagctag

SEQ ID NO: 74887 - DNA, 1557 bp, Artificial Sequence
  Description of Artificial Sequence: Synthetic coding sequence
atggccttctgggccggcggcagccccagcgtggtggactacttccccagcgaggacttctacagatgcggctactgcaagaacgagagcggcagcagaagcaacggcatgtgggcccacagcatgaccgtgcaggactaccaggacctgatcgacagaggctggagaagaagcggcaagtacgtgtacaagcccgtgatgaaccagacctgctgcccccagtacaccatcagatgcagacccctgcagttccagcccagcaagagccacaagaaggtgctgaagaagatgctgaagttcctggccaagggcgaggtgcccaagggcagctgcgaggacgagcccatggacagcaccatggacgacgccgtggccggcgacttcgccctgatcaacaagctggacatccagtgcgacctgaagaccctgagcgacgacatcaaggagagcctggagagcgagggcaagaacagcaagaaggaggagccccaggagctgctgcagagccaggacttcgtgggcgagaagctgggcagcggcgagcccagccacagcgtgaaggtgcacaccgtgcccaagcccggcaagggcgccgacctgagcaagcccccctgcagaaaggccaaggagatcagaaaggagagaaagagactgaagctgatgcagcagaaccccgccggcgagctggagggcttccaggcccagggccacccccccagcctgttcccccccaaggccaagagcaaccagcccaagagcctggaggacctgatcttcgagagcctgcccgagaacgccagccacaagctggaggtgagagtggtgagaagcagcccccccagcagccagttcaaggccaccctgctggagagctaccaggtgtacaagagataccagatggtgatccacaagaacccccccgacacccccaccgagagccagttcaccagattcctgtgcagcagccccctggaggccgagaccccccccaacggccccgactgcggctacggcagcttccaccagcagtactggctggacggcaagatcatcgccgtgggcgtgatcgacatcctgcccaactgcgtgagcagcgtgtacctgtactacgaccccgactacagcttcctgagcctgggcgtgtacagcgccctgagagagatcgccttcaccagacagctgcacgagaagaccagccagctgagctactactacatgggcttctacatccacagctgccccaagatgaagtacaagggccagtacagacccagcgacctgctgtgccccgagacctacgtgtgggtgcccatcgagcagtgcctgcccagcctggagaacagcaagtactgcagattcaaccaggaccccgaggccgtggacgaggacagaagcaccgagcccgacagactgcaggtgttccacaagagagccatcatgccctacggcgtgtacaagaagcagcagaaggaccccagcgaggaggccgccgtgctgcagtacgccagcctggtgggccagaagtgcagcgagagaatgctgctgttcagaaactag

SEQ ID NO: 74888 - DNA, 3195 bp, Artificial Sequence
  Description of Artificial Sequence: Synthetic coding sequence
atgggcagacacgtggccaccagctgccacgtggcctggctgctggtgctgatcagcggctgctggggccaggtgaacagactgcccttcttcaccaaccacttcttcgacacctacctgctgatcagcgaggacacccccgtgggcagcagcgtgacccagctgctggcccaggacatggacaacgaccccctggtgttcggcgtgagcggcgaggaggccagcagattcttcgccgtggagcccgacaccggcgtggtgtggctgagacagcccctggacagagagaccaagagcgagttcaccgtggagttcagcgtgagcgaccaccagggcgtgatcaccagaaaggtgaacatccaggtgggcgacgtgaacgacaacgcccccaccttccacaaccagccctacagcgtgagaatccccgaggtgggcgccaccggcaacacccccgtgggcacccccatcttcatcgtgaacgccaccgaccccgacctgggcgccggcggcagcgtgctgtacagcttccagccccccagccagttcttcgccatcgacagcgccagaggcatcgtgaccgtgatcagagagctggactacgagaccacccaggcctaccagctgaccgtgaacgccaccgaccaggacaagaccagacccctgagcaccctggccaacctggccatcatcatcaccgacgtgcaggacatggaccccatcttcatcaacctgccctacagcaccaacatctacgagcacagcccccccggcaccaccgtgagaatcatcaccgccatcgaccaggacaagggcagacccagaggcatcggctacaccatcgtgagcggcaacaccaacagcatcttcgccctggactacatcagcggcgtgctgaccctgaacggcctgctggacagagagaaccccctgtacagccacggcttcatcctgaccgtgaagggcaccgagctgaacgacgacagaacccccagcgacgccaccgtgaccaccaccttcaacatcctggtgatcgacatcaacgacaacgcccccgagttcaacagcagcgagtacagcgtggccatcaccgagctggcccaggtgggcttcgccctgcccctgttcatccaggtggtggacaaggacgagggcctgaacagcatgttcgaggtgtacctggtgggcaacaacagccaccacttcatcatcagccccaccagcgtgcagggcaaggccgacatcagaatcagagtggccatccccctggactacgagaccgtggacagatacgacttcgacctgttcgccaacgagagcgtgcccgaccacgtgggctacgccaaggtgaagatcaccctgatcaacgagaacgacaacagacccatcttcagccagcccctgtacaacatcagcctgtacgagaacgtgaccgtgggcaccagcgtgctgaccgtgctggccaccgacaacgacgccggcaccttcggcgaggtgagctacttcttcagcgacgaccccgacagattcagcctggacaaggacaccggcctgatcatgctgatcgccagactggactacgagctgatccagagattcaccctgaccatcatcgccagagacggcggcggcgaggagaccaccggcagagtgagaatcaacgtgctggacgtgaacgacaacgtgcccaccttccagaaggacgcctacgtgggcgccctgagagagaacgagcccagcgtgacccagctggtgagactgagagccaccgacgaggacagcccccccaacaaccagatcacctacagcatcgtgagcgccagcgccttcggcagctacttcgacatcagcctgtacgagggctacggcgtgatcagcgtgagcagacccctggactacgagcagatcagcaacggcctgatctacctgaccgtgatggccatggacgccggcaacccccccctgaacagcaccgtgcccgtgaccatcgaggtgttcgacgagaacgacaacccccccaccttcagcaagcccgcctacttcgtgagcgtggtggagaacatcatggccggcgccaccgtgctgttcctgaacgccaccgacctggacagaagcagagagtacggccaggagagcatcatctacagcctggagggcagcacccagttcagaatcaacgccagaagcggcgagatcaccaccaccagcctgctggacagagagaccaagagcgagtacatcctgatcgtgagagccgtggacggcggcgtgggccacaaccagaagaccggcatcgccaccgtgaacatcaccctgctggacatcaacgacaaccaccccacctggaaggacgccccctactacatcaacctggtggagatgaccccccccgacagcgacgtgaccaccgtggtggccgtggaccccgacctgggcgagaacggcaccctggtgtacagcatccagccccccaacaagttctacagcctgaacagcaccaccggcaagatcagaaccacccacgccatgctggacagagagaaccccgacccccacgaggccgagctgatgagaaagatcgtggtgagcgtgaccgactgcggcagaccccccctgaaggccaccagcagcgccaccgtgttcgtgaacctgctggacctgaacgacaacgaccccaccttccagaacctgcccttcgtggccgaggtgctggagggcatccccgccggcgtgagcatctaccaggtggtggccatcgacctggacgagggcctgaacggcctggtgagctacagaatgcccgtgggcatgcccagaatggacttcctgatcaacagcagcagcggcgtggtggtgaccaccaccgagctggacagagagagaatcgccgagtaccagctgagagtggtggccagcgacgccggcacccccaccaagagcagcaccagcaccctgaccatccacgtgctggacgtgaacgacgagacccccaccttcttccccgccgtgtacaacgtgagcgtgagcgaggacgtgcccagagagttcagagtggtgtggctgaactgcaccgacaacgacgtgggcctgaacgccgagctgagctacttcatcaccggcgccgcccccgccagcgcccacctgtgcagaccccccggcgccctgcccccccccctgcccgacggccagcccgactag

SEQ ID NO: 74889 - DNA, 3345 bp, Artificial Sequence
  Description of Artificial Sequence: Synthetic coding sequence
atggtgaagagccccatgaacagagagctggtggccacctacgaggtgaccctgagcgtgatcgacaacgccagcgacctgcccgagagaagcgtgagcgtgcccaacgccaagctgaccgtgaacgtgctggacgtgaacgacaacaccccccagttcaagcccttcggcatcacctactacatggagagaatcctggagggcgccacccccggcaccaccctgatcgccgtggccgccgtggaccccgacaagggcctgaacggcctggtgacctacaccctgctggacctggtgccccccggctacgtgcagctggaggacagcagcgccggcaaggtgatcgccaacagaaccgtggactacgaggaggtgcactggctgaacttcaccgtgagagccagcgacaacggcagcccccccagagccgccgagatccccgtgtacctggagatcgtggacatcaacgacaacaaccccatcttcgaccagcccagctaccaggaggccgtgttcgaggacgtgcccgtgggcaccatcatcctgaccgtgaccgccaccgacgccgacagcggcaacttcgccctgatcgagtacagcctgggcgacggcgagagcaagttcgccatcaaccccaccaccggcgacatctacgtgctgagcagcctggacagagagaagaaggaccactacatcctgaccgccctggccaaggacaaccccggcgacgtggccagcaacagaagagagaacagcgtgcaggtggtgatccaggtgctggacgtgaacgactgcagaccccagttcagcaagccccagttcagcaccagcgtgtacgagaacgagcccgccggcaccagcgtgatcaccatgatggccaccgaccaggacgagggccccaacggcgagctgacctacagcctggagggccccggcgtggaggccttccacgtggacatggacagcggcctggtgaccacccagagacccctgcagagctacgagaagttcagcctgaccgtggtggccaccgacggcggcgagccccccctgtggggcaccaccatgctgctggtggaggtgatcgacgtgaacgacaacagacccgtgttcgtgagaccccccaacggcaccatcctgcacatcagagaggagatccccctgagaagcaacgtgtacgaggtgtacgccaccgacaaggacgagggcctgaacggcgccgtgagatacagcttcctgaagaccgccggcaacagagactgggagttcttcatcatcgaccccatcagcggcctgatccagaccgcccagagactggacagagagagccaggccgtgtacagcctgatcctggtggccagcgacctgggccagcccgtgccctacgagaccatgcagcccctgcaggtggccctggaggacatcgacgacaacgagcccctgttcgtgagaccccccaagggcagcccccagtaccagctgctgaccgtgcccgagcacagccccagaggcaccctggtgggcaacgtgaccggcgccgtggacgccgacgagggccccaacgccatcgtgtactacttcatcgccgccggcaacgaggagaagaacttccacctgcagcccgacggctgcctgctggtgctgagagacctggacagagagagagaggccatcttcagcttcatcgtgaaggccagcagcaacagaagctggaccccccccagaggccccagccccaccctggacctggtggccgacctgaccctgcaggaggtgagagtggtgctggaggacatcaacgaccagccccccagattcaccaaggccgagtacaccgccggcgtggccaccgacgccaaggtgggcagcgagctgatccaggtgctggccctggacgccgacatcggcaacaacagcctggtgttctacagcatcctggccatccactacttcagagccctggccaacgacagcgaggacgtgggccaggtgttcaccatgggcagcatggacggcatcctgagaaccttcgacctgttcatggcctacagccccggctacttcgtggtggacatcgtggccagagacctggccggccacaacgacaccgccatcatcggcatctacatcctgagagacgaccagagagtgaagatcgtgatcaacgagatccccgacagagtgagaggcttcgaggaggagttcatccacctgctgagcaacatcaccggcgccatcgtgaacaccgacaacgtgcagttccacgtggacaagaagggcagagtgaacttcgcccagaccgagctgctgatccacgtggtgaacagagacaccaacagaatcctggacgtggacagagtgatccagatgatcgacgagaacaaggagcagctgagaaacctgttcagaaactacaacgtgctggacgtgcagcccgccatcagcgtgagactgcccgacgacatgagcgccctgcagatggccatcatcgtgctggccatcctgctgttcctggccgccatgctgttcgtgctgatgaactggtactacagaaccgtgcacaagagaaagctgaaggccatcgtggccggcagcgccggcaacagaggcttcatcgacatcatggacatgcccaacaccaacaagtacagcttcgacggcgccaaccccgtgtggctggaccccttctgcagaaacctggagctggccgcccaggccgagcacgaggacgacctgcccgagaacctgagcgagatcgccgacctgtggaacagccccaccagaacccacggcaccttcggcagagagcccgccgccgtgaagcccgacgacgacagatacctgagagccgccatccaggagtacgacaacatcgccaagctgggccagatcatcagagagggccccatcaagggcagcctgctgaaggtggtgctggaggactacctgagactgaagaagctgttcgcccagagaatggtgcagaaggccagcagctgccacagcagcatcagcgagctgatccagaccgagctggacgaggagcccggcgaccacagccccggccagggcagcctgagattcagacacaagccccccgtggagctgaagggccccgacggcatccacgtggtgcacggcagcaccggcaccctgctggccaccgacctgaacagcctgcccgaggaggaccagaagggcctgggcagaagcctggagaccctgaccgccgccgaggccaccgccttcgagagaaacgccagaaccgagagcgccaagagcacccccctgcacaagctgagagacgtgatcatggagacccccctggagatcaccgagctgtag

SEQ ID NO: 74890 - DNA, 1368 bp, Artificial Sequence
  Description of Artificial Sequence: Synthetic coding sequence
atgagagccagcctgggcgtgtgcggcaccgccagcagcatggtgatcgtgtacgtggaggacatcaacgacgaggcccccgtgttcacccagcagcagtacagcagactgggcctgagagagaccgccggcatcggcaccagcgtgatcgtggtgcaggccaccgacagagacagcggcgacggcggcctggtgaactacagaatcctgagcggcgccgagggcaagttcgagatcgacgagagcaccggcctgatcatcaccgtgaactacctggactacgagaccaagaccagctacatgatgaacgtgagcgccaccgaccaggccccccccttcaaccagggcttctgcagcgtgtacatcaccctgctgaacgagctggacgaggccgtgcagttcagcaacgccagctacgaggccgccatcctggagaacctggccctgggcaccgagatcgtgagagtgcaggcctacagcatcgacaacctgaaccagatcacctacagattcaacgcctacaccagcacccaggccaaggccctgttcaagatcgacgccatcaccggcgtgatcaccgtgcagggcctggtggacagagagaagggcgacttctacaccctgaccgtggtggccgacgacggcggccccaaggtggacagcaccgtggtgtacatcaccgtgctggacgagaacgacaacagccccagattcgacttcaccagcgacagcgccgtgagcatccccgaggactgccccgtgggccagagagtggccaccgtgaaggcctgggaccccgacgccggcagcaacggccaggtggtgttcagcctggccagcggcaacatcgccggcgccttcgagatcgtgaccaccaacgacagcatcggcgaggtgttcgtggccagacccctggacagagaggagctggaccactacatcctgcaggtggtggccagcgacagaggcaccccccccagaaagaaggaccacatcctgcaggtgaccatcctggacatcaacgacaacccccccgtgatcgagagccccttcggctacaacgtgagcgtgaacgagaacgtgggcggcggcaccgccgtggtgcaggtgagagccaccgacagagacatcggcatcaacagcgtgctgagctactacatcaccgagggcaacaaggacatggccttcagaatggacagaatcagcggcgagatcgccaccagacccgccccccccgacagagagagacagagcttctaccacctggtggccaccgtggaggacgagggcacccccaccctgagcgtgagcgacggcggcggccacagagaggagagagtgggccagggcagcagcgccagcgagtag

SEQ ID NO: 74891 - DNA, 1593 bp, Artificial Sequence
  Description of Artificial Sequence: Synthetic coding sequence
atgggcagacacgtggccaccagctgccacgtggcctggctgctggtgctgatcagcggctgctggggccaggtgaacagactgcccttcttcaccaaccacttcttcgacacctacctgctgatcagcgaggacacccccgtgggcagcagcgtgacccagctgctggcccaggacatggacaacgaccccctggtgttcggcgtgagcggcgaggaggccagcagattcttcgccgtggagcccgacaccggcgtggtgtggctgagacagcccctggacagagagaccaagagcgagttcaccgtggagttcagcgtgagcgaccaccagggcgtgatcaccagaaaggtgaacatccaggtgggcgacgtgaacgacaacgcccccaccttccacaaccagccctacagcgtgagaatccccgagaacacccccgtgggcacccccatcttcatcgtgaacgccaccgaccccgacctgggcgccggcggcagcgtgctgtacagcttccagccccccagccagttcttcgccatcgacagcgccagaggcatcgtgaccgtgatcagagagctggactacgagaccacccaggcctaccagctgaccgtgaacgccaccgaccaggacaagaccagacccctgagcaccctggccaacctggccatcatcatcaccgacgtgcaggacatggaccccatcttcatcaacctgccctacagcaccaacatctacgagcacagcccccccggcaccaccgtgagaatcatcaccgccatcgaccaggacaagggcagacccagaggcatcggctacaccatcgtgagcggcaacaccaacagcatcttcgccctggactacatcagcggcgtgctgaccctgaacggcctgctggacagagagaaccccctgtacagccacggcttcatcctgaccgtgaagggcaccgagctgaacgacgacagaacccccagcgacgccaccgtgaccaccaccttcaacatcctggtgatcgacatcaacgacaacgcccccgagttcaacagcagcgagtacagcgtggccatcaccgagctggcccaggtgggcttcgccctgcccctgttcatccaggtggtggacaaggacgagaacctgggcctgaacagcatgttcgaggtgtacctggtgggcaacaacagccaccacttcatcatcagccccaccagcgtgcagggcaaggccgacatcagaatcagagtggccatccccctggactacgagaccgtggacagatacgacttcgacctgttcgccaacgagagcgtgcccgaccacgtgggctacgccaaggtgaagatcaccctgatcaacgagaacgacaacagacccatcttcagccagcccctgtacaacatcagcctgtacgagaacgtgaccgtgggcaccagcgtgctgaccgtgctggtgagccccagattcaccgccggccccctgagcagccccggccccaccgtggtgagacaccccgagggcttctgccccagagacctgagcaaccagggcagaagacacccccagatccccgagctgtgcctgctggtgtactag

SEQ ID NO: 74892 - DNA, 3639 bp, Artificial Sequence
  Description of Artificial Sequence: Synthetic coding sequence
atgggcagacacgtggccaccagctgccacgtggcctggctgctggtgctgatcagcggctgctggggccaggtgaacagactgcccttcttcaccaaccacttcttcgacacctacctgctgatcagcgaggacacccccgtgggcagcagcgtgacccagctgctggcccaggacatggacaacgaccccctggtgttcggcgtgagcggcgaggaggccagcagattcttcgccgtggagcccgacaccggcgtggtgtggctgagacagcccctggacagagagaccaagagcgagttcaccgtggagttcagcgtgagcgaccaccagggcgtgatcaccagaaaggtgaacatccaggtgggcgacgtgaacgacaacgcccccaccttccacaaccagccctacagcgtgagaatccccgagaacacccccgtgggcacccccatcttcatcgtgaacgccaccgaccccgacctgggcgccggcggcagcgtgctgtacagcttccagccccccagccagttcttcgccatcgacagcgccagaggcatcgtgaccgtgatcagagagctggactacgagaccacccaggcctaccagctgaccgtgaacgccaccgaccaggacaagaccagacccctgagcaccctggccaacctggccatcatcatcaccgacgtgcaggacatggaccccatcttcatcaacctgccctacagcaccaacatctacgagcacagcccccccggcaccaccgtgagaatcatcaccgccatcgaccaggacaagggcagacccagaggcatcggctacaccatcgtgagcggcaacaccaacagcatcttcgccctggactacatcagcggcgtgctgaccctgaacggcctgctggacagagagaaccccctgtacagccacggcttcatcctgaccgtgaagggcaccgagctgaacgacgacagaacccccagcgacgccaccgtgaccaccaccttcaacatcctggtgatcgacatcaacgacaacgcccccgagttcaacagcagcgagtacagcgtggccatcaccgagctggcccaggtgggcttcgccctgcccctgttcatccaggtggtggacaaggacgagacccagggcctgaacagcatgttcgaggtgtacctggtgggcaacaacagccaccacttcatcatcagccccaccagcgtgcagggcaaggccgacatcagaatcagagtggccatccccctggactacgagaccgtggacagatacgacttcgacctgttcgccaacgagagcgtgcccgaccacgtgggctacgccaaggtgaagatcaccctgatcaacgagaacgacaacagacccatcttcagccagcccctgtacaacatcagcctgtacgagaacgtgaccgtgggcaccagcgtgctgaccgtgctggccaccgacaacgacgccggcaccttcggcgaggtgagctacttcttcagcgacgaccccgacagattcagcctggacaaggacaccggcctgatcatgctgatcgccagactggactacgagctgatccagagattcaccctgaccatcatcgccagagacggcggcggcgaggagaccaccggcagagtgagaatcaacgtgctggacgtgaacgacaacgtgcccaccttccagaaggacgcctacgtgggcgccctgagagagaacgagcccagcgtgacccagctggtgagactgagagccaccgacgaggacagcccccccaacaaccagatcacctacagcatcgtgagcgccagcgccttcggcagctacttcgacatcagcctgtacgagggctacggcgtgatcagcgtgagcagacccctggactacgagcagatcagcaacggcctgatctacctgaccgtgatggccatggacgccggcaacccccccctgaacagcaccgtgcccgtgaccatcgaggtgttcgacgagaacgacaacccccccaccttcagcaagcccgcctacttcgtgagcgtggtggagaacatcatggccggcgccaccgtgctgttcctgaacgccaccgacctggacagaagcagagagtacggccaggagagcatcatctacagcctggagggcagcacccagttcagaatcaacgccagaagcggcgagatcaccaccaccagcctgctggacagagagaccaagagcgagtacatcctgatcgtgagagccgtggacggcggcgtgggccacaaccagaagaccggcatcgccaccgtgaacatcaccctgctggacatcaacgacaaccaccccacctggaaggacgccccctactacatcaacctggtggagatgaccccccccgacagcgacgtgaccaccgtggtggccgtggaccccgacctgggcgagaacggcaccctggtgtacagcatccagccccccaacaagttctacagcctgaacagcaccaccggcaagatcagaaccacccacgccatgctggacagagagaaccccgacccccacgaggccgagctgatgagaaagatcgtggtgagcgtgaccgactgcggcagaccccccctgaaggccaccagcagcgccaccgtgttcgtgaacctgctggacctgaacgacaacgaccccaccttccagaacctgcccttcgtggccgaggtgctggagggcatccccgccggcgtgagcatctaccaggtggtggccatcgacctggacgagggcctgaacggcctggtgagctacagaatgcccgtgggcatgcccagaatggacttcctgatcaacagcagcagcggcgtggtggtgaccaccaccgagctggacagagagagaatcgccgagtaccagctgagagtggtggccagcgacgccggcacccccaccaagagcagcaccagcaccctgaccatccacgtgctggacgtgaacgacgagacccccaccttcttccccgccgtgtacaacgtgagcgtgagcgaggacgtgcccagagagttcagagtggtgtggctgaactgcaccgacaacgacgtgggcctgaacgccgagctgagctacttcatcaccggcggcaacgtggacggcaagttcagcgtgggctacagagacgccgtggtgagaaccgtggtgggcctggacagagagaccaccgccgcctacatgctgatcctggaggccatcgacaacggccccgtgggcaagagacacaccggcaccgccaccgtgttcgtgaccgtgctggacgtgaacgacaacagacccatcttcctgcagagcagctacgaggccagcgtgcccgaggacatccccgagggccacagcatcctgcaggaggaggacctggccagcccctgcatcagccccgccccccccagaagagccttccagagcagcggcgagaaggagaccagccagttccccggcaaggagctgagaagagagcccggccccagcaaggcccagaacagagccgccttcaccgagcccctggccgaggcccccctgctgggcagcaagcaggcccaggaggagagagcccccctgcccagagagcaggcccagcagctgcagggcagcgagggcgagaagggcggcccctag

SEQ ID NO: 74893 - DNA, 1593 bp, Artificial Sequence
  Description of Artificial Sequence: Synthetic coding sequence
atgggcagacacgtggccaccagctgccacgtggcctggctgctggtgctgatcagcggctgctggggccaggtgaacagactgcccttcttcaccaaccacttcttcgacacctacctgctgatcagcgaggacacccccgtgggcagcagcgtgacccagctgctggcccaggacatggacaacgaccccctggtgttcggcgtgagcggcgaggaggccagcagattcttcgccgtggagcccgacaccggcgtggtgtggctgagacagcccctggacagagagaccaagagcgagttcaccgtggagttcagcgtgagcgaccaccagggcgtgatcaccagaaaggtgaacatccaggtgggcgacgtgaacgacaacgcccccaccttccacaaccagccctacagcgtgagaatccccgagaacacccccgtgggcacccccatcttcatcgtgaacgccaccgaccccgacctgggcgccggcggcagcgtgctgtacagcttccagccccccagccagttcttcgccatcgacagcgccagaggcatcgtgaccgtgatcagagagctggactacgagaccacccaggcctaccagctgaccgtgaacgccaccgaccaggacaagaccagacccctgagcaccctggccaacctggccatcatcatcaccgacgtgcaggacatggaccccatcttcatcaacctgccctacagcaccaacatctacgagcacagcccccccggcaccaccgtgagaatcatcaccgccatcgaccaggacaagggcagacccagaggcatcggctacaccatcgtgagcggcaacaccaacagcatcttcgccctggactacatcagcggcgtgctgaccctgaacggcctgctggacagagagaaccccctgtacagccacggcttcatcctgaccgtgaagggcaccgagctgaacgacgacagaacccccagcgacgccaccgtgaccaccaccttcaacatcctggtgatcgacatcaacgacaacgcccccgagttcaacagcagcgagtacagcgtggccatcaccgagctggcccaggtgggcttcgccctgcccctgttcatccaggtggtggacaaggacgagacctggggcctgaacagcatgttcgaggtgtacctggtgggcaacaacagccaccacttcatcatcagccccaccagcgtgcagggcaaggccgacatcagaatcagagtggccatccccctggactacgagaccgtggacagatacgacttcgacctgttcgccaacgagagcgtgcccgaccacgtgggctacgccaaggtgaagatcaccctgatcaacgagaacgacaacagacccatcttcagccagcccctgtacaacatcagcctgtacgagaacgtgaccgtgggcaccagcgtgctgaccgtgctggtgagccccagattcaccgccggccccctgagcagccccggccccaccgtggtgagacaccccgagggcttctgccccagagacctgagcaaccagggcagaagacacccccagatccccgagctgtgcctgctggtgtactag

SEQ ID NO: 74894 - DNA, 9960 bp, Artificial Sequence
  Description of Artificial Sequence: Synthetic coding sequence
atgggcagacacgtggccaccagctgccacgtggcctggctgctggtgctgatcagcggctgctggggccaggtgaacagactgcccttcttcaccaaccacttcttcgacacctacctgctgatcagcgaggacacccccgtgggcagcagcgtgacccagctgctggcccaggacatggacaacgaccccctggtgttcggcgtgagcggcgaggaggccagcagattcttcgccgtggagcccgacaccggcgtggtgtggctgagacagcccctggacagagagaccaagagcgagttcaccgtggagttcagcgtgagcgaccaccagggcgtgatcaccagaaaggtgaacatccaggtgggcgacgtgaacgacaacgcccccaccttccacaaccagccctacagcgtgagaatccccgagaacacccccgtgggcacccccatcttcatcgtgaacgccaccgaccccgacctgggcgccggcggcagcgtgctgtacagcttccagccccccagccagttcttcgccatcgacagcgccagaggcatcgtgaccgtgatcagagagctggactacgagaccacccaggcctaccagctgaccgtgaacgccaccgaccaggacaagaccagacccctgagcaccctggccaacctggccatcatcatcaccgacgtgcaggacatggaccccatcttcatcaacctgccctacagcaccaacatctacgagcacagcccccccggcaccaccgtgagaatcatcaccgccatcgaccaggacaagggcagacccagaggcatcggctacaccatcgtgagcggcaacaccaacagcatcttcgccctggactacatcagcggcgtgctgaccctgaacggcctgctggacagagagaaccccctgtacagccacggcttcatcctgaccgtgaagggcaccgagctgaacgacgacagaacccccagcgacgccaccgtgaccaccaccttcaacatcctggtgatcgacatcaacgacaacgcccccgagttcaacagcagcgagtacagcgtggccatcaccgagctggcccaggtgggcttcgccctgcccctgttcatccaggtggtggacaaggacgagacccagggcctgaacagcatgttcgaggtgtacctggtgggcaacaacagccaccacttcatcatcagccccaccagcgtgcagggcaaggccgacatcagaatcagagtggccatccccctggactacgagaccgtggacagatacgacttcgacctgttcgccaacgagagcgtgcccgaccacgtgggctacgccaaggtgaagatcaccctgatcaacgagaacgacaacagacccatcttcagccagcccctgtacaacatcagcctgtacgagaacgtgaccgtgggcaccagcgtgctgaccgtgctggccaccgacaacgacgccggcaccttcggcgaggtgagctacttcttcagcgacgaccccgacagattcagcctggacaaggacaccggcctgatcatgctgatcgccagactggactacgagctgatccagagattcaccctgaccatcatcgccagagacggcggcggcgaggagaccaccggcagagtgagaatcaacgtgctggacgtgaacgacaacgtgcccaccttccagaaggacgcctacgtgggcgccctgagagagaacgagcccagcgtgacccagctggtgagactgagagccaccgacgaggacagcccccccaacaaccagatcacctacagcatcgtgagcgccagcgccttcggcagctacttcgacatcagcctgtacgagggctacggcgtgatcagcgtgagcagacccctggactacgagcagatcagcaacggcctgatctacctgaccgtgatggccatggacgccggcaacccccccctgaacagcaccgtgcccgtgaccatcgaggtgttcgacgagaacgacaacccccccaccttcagcaagcccgcctacttcgtgagcgtggtggagaacatcatggccggcgccaccgtgctgttcctgaacgccaccgacctggacagaagcagagagtacggccaggagagcatcatctacagcctggagggcagcacccagttcagaatcaacgccagaagcggcgagatcaccaccaccagcctgctggacagagagaccaagagcgagtacatcctgatcgtgagagccgtggacggcggcgtgggccacaaccagaagaccggcatcgccaccgtgaacatcaccctgctggacatcaacgacaaccaccccacctggaaggacgccccctactacatcaacctggtggagatgaccccccccgacagcgacgtgaccaccgtggtggccgtggaccccgacctgggcgagaacggcaccctggtgtacagcatccagccccccaacaagttctacagcctgaacagcaccaccggcaagatcagaaccacccacgccatgctggacagagagaaccccgacccccacgaggccgagctgatgagaaagatcgtggtgagcgtgaccgactgcggcagaccccccctgaaggccaccagcagcgccaccgtgttcgtgaacctgctggacctgaacgacaacgaccccaccttccagaacctgcccttcgtggccgaggtgctggagggcatccccgccggcgtgagcatctaccaggtggtggccatcgacctggacgagggcctgaacggcctggtgagctacagaatgcccgtgggcatgcccagaatggacttcctgatcaacagcagcagcggcgtggtggtgaccaccaccgagctggacagagagagaatcgccgagtaccagctgagagtggtggccagcgacgccggcacccccaccaagagcagcaccagcaccctgaccatccacgtgctggacgtgaacgacgagacccccaccttcttccccgccgtgtacaacgtgagcgtgagcgaggacgtgcccagagagttcagagtggtgtggctgaactgcaccgacaacgacgtgggcctgaacgccgagctgagctacttcatcaccggcggcaacgtggacggcaagttcagcgtgggctacagagacgccgtggtgagaaccgtggtgggcctggacagagagaccaccgccgcctacatgctgatcctggaggccatcgacaacggccccgtgggcaagagacacaccggcaccgccaccgtgttcgtgaccgtgctggacgtgaacgacaacagacccatcttcctgcagagcagctacgaggccagcgtgcccgaggacatccccgagggccacagcatcctgcagctgaaggccaccgacgccgacgagggcgagttcggcagagtgtggtacagaatcctgcacggcaaccacggcaacaacttcagaatccacgtgagcaacggcctgctgatgagaggccccagacccctggacagagagagaaacagcagccacgtgctgatcgtggaggcctacaaccacgacctgggccccatgagaagcagcgtgagagtgatcgtgtacgtggaggacatcaacgacgaggcccccgtgttcacccagcagcagtacagcagactgggcctgagagagaccgccggcatcggcaccagcgtgatcgtggtgcaggccaccgacagagacagcggcgacggcggcctggtgaactacagaatcctgagcggcgccgagggcaagttcgagatcgacgagagcaccggcctgatcatcaccgtgaactacctggactacgagaccaagaccagctacatgatgaacgtgagcgccaccgaccaggccccccccttcaaccagggcttctgcagcgtgtacatcaccctgctgaacgagctggacgaggccgtgcagttcagcaacgccagctacgaggccgccatcctggagaacctggccctgggcaccgagatcgtgagagtgcaggcctacagcatcgacaacctgaaccagatcacctacagattcaacgcctacaccagcacccaggccaaggccctgttcaagatcgacgccatcaccggcgtgatcaccgtgcagggcctggtggacagagagaagggcgacttctacaccctgaccgtggtggccgacgacggcggccccaaggtggacagcaccgtgcaggtgtacatcaccgtgctggacgagaacgacaacagccccagattcgacttcaccagcgacagcgccgtgagcatccccgaggactgccccgtgggccagagagtggccaccgtgaaggcctgggaccccgacgccggcagcaacggccaggtggtgttcagcctggccagcggcaacatcgccggcgccttcgagatcgtgaccaccaacgacagcatcggcgaggtgttcgtggccagacccctggacagagaggagctggaccactacatcctgcaggtggtggccagcgacagaggcaccccccccagaaagaaggaccacatcctgcaggtgaccatcctggacatcaacgacaacccccccgtgatcgagagccccttcggctacaacgtgagcgtgaacgagaacgtgggcggcggcaccgccgtggtgcaggtgagagccaccgacagagacatcggcatcaacagcgtgctgagctactacatcaccgagggcaacaaggacatggccttcagaatggacagaatcagcggcgagatcgccaccagacccgccccccccgacagagagagacagagcttctaccacctggtggccaccgtggaggacgagggcacccccaccctgagcgccaccacccacgtgtacgtgaccatcgtggacgagaacgacaacgcccccatgttccagcagccccactacgaggtgctgctggacgagggccccgacaccctgaacaccagcctgatcaccatccaggccctggacctggacgagggccccaacggcaccgtgacctacgccatcgtggccggcaacatcgtgaacaccttcagaatcgacagacacatgggcgtgatcaccgccgccaaggagctggactacgagatcagccacggcagatacaccctgatcgtgaccgccaccgaccagtgccccatcctgagccacagactgaccagcaccaccaccgtgctggtgaacgtgaacgacatcaacgacaacgtgcccaccttccccagagactacgagggccccttcgaggtgaccgagggccagcccggccccagagtgtggaccttcctggcccacgacagagacagcggccccaacggccaggtggagtacagcatcatggacggcgaccccctgggcgagttcgtgatcagccccgtggagggcgtgctgagagtgagaaaggacgtggagctggacagagagaccatcgccttctacaacctgaccatctgcgccagagacagaggcatgccccccctgagcagcaccatgctggtgggcatcagagtgctggacatcaacgacaacgaccccgtgctgctgaacctgcccatgaacatcaccatcagcgagaacagccccgtgagcagcttcgtggcccacgtgctggccagcgacgccgacagcggctgcaacgccagactgaccttcaacatcaccgccggcaacagagagagagccttcttcatcaacgccaccaccggcatcgtgaccgtgaacagacccctggacagagagagaatccccgagtacaagctgaccatcagcgtgaaggacaaccccgagaaccccagaatcgccagaagagactacgacctgctgctgatcttcctgagcgacgagaacgacaaccaccccctgttcaccaagagcacctaccaggccgaggtgatggagaacagccccgccggcacccccctgaccgtgctgaacggccccatcctggccctggacgccgaccaggacatctacgccgtggtgacctaccagctgctgggcgcccagagcggcctgttcgacatcaacagcagcaccggcgtggtgaccgtgagaagcggcgtgatcatcgacagagaggccttcagcccccccatcctggagctgctgctgctggccgaggacatcggcctgctgaacagcaccgcccacctgctgatcaccatcctggacgacaacgacaacagacccaccttcagccccgccaccctgaccgtgcacctgctggagaactgcccccccggcttcagcgtgctgcaggtgaccgccaccgacgaggacagcggcctgaacggcgagctggtgtacagaatcgaggccggcgcccaggacagattcctgatccacctggtgaccggcgtgatcagagtgggcaacgccaccatcgacagagaggagcaggagagctacagactgaccgtggtggccaccgacagaggcaccgtgcccctgagcggcaccgccatcgtgaccatcctgatcgacgacatcaacgacagcagacccgagttcctgaaccccatccagaccgtgagcgtgctggagagcgccgagcccggcaccgtgatcgccaacatcaccgccatcgaccacgacctgaaccccaagctggagtaccacatcgtgggcatcgtggccaaggacgacaccgacagactggtgcccaaccaggaggacgccttcgccgtgaacatcaacaccggcagcgtgatggtgaagagccccatgaacagagagctggtggccacctacgaggtgaccctgagcgtgatcgacaacgccagcgacctgcccgagagaagcgtgagcgtgcccaacgccaagctgaccgtgaacgtgctggacgtgaacgacaacaccccccagttcaagcccttcggcatcacctactacatggagagaatcctggagggcgccacccccggcaccaccctgatcgccgtggccgccgtggaccccgacaagggcctgaacggcctggtgacctacaccctgctggacctggtgccccccggctacgtgcagctggaggacagcagcgccggcaaggtgatcgccaacagaaccgtggactacgaggaggtgcactggctgaacttcaccgtgagagccagcgacaacggcagcccccccagagccgccgagatccccgtgtacctggagatcgtggacatcaacgacaacaaccccatcttcgaccagcccagctaccaggaggccgtgttcgaggacgtgcccgtgggcaccatcatcctgaccgtgaccgccaccgacgccgacagcggcaacttcgccctgatcgagtacagcctgggcgacggcgagagcaagttcgccatcaaccccaccaccggcgacatctacgtgctgagcagcctggacagagagaagaaggaccactacatcctgaccgccctggccaaggacaaccccggcgacgtggccagcaacagaagagagaacagcgtgcaggtggtgatccaggtgctggacgtgaacgactgcagaccccagttcagcaagccccagttcagcaccagcgtgtacgagaacgagcccgccggcaccagcgtgatcaccatgatggccaccgaccaggacgagggccccaacggcgagctgacctacagcctggagggccccggcgtggaggccttccacgtggacatggacagcggcctggtgaccacccagagacccctgcagagctacgagaagttcagcctgaccgtggtggccaccgacggcggcgagccccccctgtggggcaccaccatgctgctggtggaggtgatcgacgtgaacgacaacagacccgtgttcgtgagaccccccaacggcaccatcctgcacatcagagaggagatccccctgagaagcaacgtgtacgaggtgtacgccaccgacaaggacgagggcctgaacggcgccgtgagatacagcttcctgaagaccgccggcaacagagactgggagttcttcatcatcgaccccatcagcggcctgatccagaccgcccagagactggacagagagagccaggccgtgtacagcctgatcctggtggccagcgacctgggccagcccgtgccctacgagaccatgcagcccctgcaggtggccctggaggacatcgacgacaacgagcccctgttcgtgagaccccccaagggcagcccccagtaccagctgctgaccgtgcccgagcacagccccagaggcaccctggtgggcaacgtgaccggcgccgtggacgccgacgagggccccaacgccatcgtgtactacttcatcgccgccggcaacgaggagaagaacttccacctgcagcccgacggctgcctgctggtgctgagagacctggacagagagagagaggccatcttcagcttcatcgtgaaggccagcagcaacagaagctggaccccccccagaggccccagccccaccctggacctggtggccgacctgaccctgcaggaggtgagagtggtgctggaggacatcaacgaccagccccccagattcaccaaggccgagtacaccgccggcgtggccaccgacgccaaggtgggcagcgagctgatccaggtgctggccctggacgccgacatcggcaacaacagcctggtgttctacagcatcctggccatccactacttcagagccctggccaacgacagcgaggacgtgggccaggtgttcaccatgggcagcatggacggcatcctgagaaccttcgacctgttcatggcctacagccccggctacttcgtggtggacatcgtggccagagacctggccggccacaacgacaccgccatcatcggcatctacatcctgagagacgaccagagagtgaagatcgtgatcaacgagatccccgacagagtgagaggcttcgaggaggagttcatccacctgctgagcaacatcaccggcgccatcgtgaacaccgacaacgtgcagttccacgtggacaagaagggcagagtgaacttcgcccagaccgagctgctgatccacgtggtgaacagagacaccaacagaatcctggacgtggacagagtgatccagatgatcgacgagaacaaggagcagctgagaaacctgttcagaaactacaacgtgctggacgtgcagcccgccatcagcgtgagactgcccgacgacatgagcgccctgcagatggccatcatcgtgctggccatcctgctgttcctggccgccatgctgttcgtgctgatgaactggtactacagaaccgtgcacaagagaaagctgaaggccatcgtggccggcagcgccggcaacagaggcttcatcgacatcatggacatgcccaacaccaacaagtacagcttcgacggcgccaaccccgtgtggctggaccccttctgcagaaacctggagctggccgcccaggccgagcacgaggacgacctgcccgagaacctgagcgagatcgccgacctgtggaacagccccaccagaacccacggcaccttcggcagagagcccgccgccgtgaagcccgacgacgacagatacctgagagccgccatccaggagtacgacaacatcgccaagctgggccagatcatcagagagggccccatcaagctgatccagaccgagctggacgaggagcccggcgaccacagccccggccagggcagcctgagattcagacacaagccccccgtggagctgaagggccccgacggcatccacgtggtgcacggcagcaccggcaccctgctggccaccgacctgaacagcctgcccgaggaggaccagaagggcctgggcagaagcctggagaccctgaccgccgccgaggccaccgccttcgagagaaacgccagaaccgagagcgccaagagcacccccctgcacaagctgagagacgtgatcatggagacccccctggagatcaccgagctgtag

SEQ ID NO: 74895 - DNA, 10080 bp, Artificial Sequence
  Description of Artificial Sequence: Synthetic coding sequence
atgggcagacacgtggccaccagctgccacgtggcctggctgctggtgctgatcagcggctgctggggccaggtgaacagactgcccttcttcaccaaccacttcttcgacacctacctgctgatcagcgaggacacccccgtgggcagcagcgtgacccagctgctggcccaggacatggacaacgaccccctggtgttcggcgtgagcggcgaggaggccagcagattcttcgccgtggagcccgacaccggcgtggtgtggctgagacagcccctggacagagagaccaagagcgagttcaccgtggagttcagcgtgagcgaccaccagggcgtgatcaccagaaaggtgaacatccaggtgggcgacgtgaacgacaacgcccccaccttccacaaccagccctacagcgtgagaatccccgaggtgggcgccaccggcaacacccccgtgggcacccccatcttcatcgtgaacgccaccgaccccgacctgggcgccggcggcagcgtgctgtacagcttccagccccccagccagttcttcgccatcgacagcgccagaggcatcgtgaccgtgatcagagagctggactacgagaccacccaggcctaccagctgaccgtgaacgccaccgaccaggacaagaccagacccctgagcaccctggccaacctggccatcatcatcaccgacgtgcaggacatggaccccatcttcatcaacctgccctacagcaccaacatctacgagcacagcccccccggcaccaccgtgagaatcatcaccgccatcgaccaggacaagggcagacccagaggcatcggctacaccatcgtgagcgtggccggcaacaccaacagcatcttcgccctggactacatcagcggcgtgctgaccctgaacggcctgctggacagagagaaccccctgtacagccacggcttcatcctgaccgtgaagggcaccgagctgaacgacgacagaacccccagcgacgccaccgtgaccaccaccttcaacatcctggtgatcgacatcaacgacaacgcccccgagttcaacagcagcgagtacagcgtggccatcaccgagctggcccaggtgggcttcgccctgcccctgttcatccaggtggtggacaaggacgagggcctgaacagcatgttcgaggtgtacctggtgggcaacaacagccaccacttcatcatcagccccaccagcgtgcagggcaaggccgacatcagaatcagagtggccatccccctggactacgagaccgtggacagatacgacttcgacctgttcgccaacgagagcgtgcccgaccacgtgggctacgccaaggtgaagatcaccctgatcaacgagaacgacaacagacccatcttcagccagcccctgtacaacatcagcctgtacgagaacgtgaccgtgggcaccagcgtgctgaccgtgctggccaccgacaacgacgccggcaccttcggcgaggtgagctacttcttcagcgacgaccccgacagattcagcctggacaaggacaccggcctgatcatgctgatcgccagactggactacgagctgatccagagattcaccctgaccatcatcgccagagacggcggcggcgaggagaccaccggcagagtgagaatcaacgtgctggacgtgaacgacaacgtgcccaccttccagaaggacgcctacgtgggcgccctgagagagaacgagcccagcgtgacccagctggtgagactgagagccaccgacgaggacagcccccccaacaaccagatcacctacagcatcgtgagcgccagcgccttcggcagctacttcgacatcagcctgtacgagggctacggcgtgatcagcgtgagcagacccctggactacgagcagatcagcaacggcctgatctacctgaccgtgatggccatggacgccggcaacccccccctgaacagcaccgtgcccgtgaccatcgaggtgttcgacgagaacgacaacccccccaccttcagcaagcccgcctacttcgtgagcgtggtggagaacatcatggccggcgccaccgtgctgttcctgaacgccaccgacctggacagaagcagagagtacggccaggagagcatcatctacagcctggagggcagcacccagttcagaatcaacgccagaagcggcgagatcaccaccaccagcctgctggacagagagaccaagagcgagtacatcctgatcgtgagagccgtggacggcggcgtgggccacaaccagaagaccggcatcgccaccgtgaacatcaccctgctggacatcaacgacaaccaccccacctggaaggacgccccctactacatcaacctggtggagatgaccccccccgacagcgacgtgaccaccgtggtggccgtggaccccgacctgggcgagaacggcaccctggtgtacagcatccagccccccaacaagttctacagcctgaacagcaccaccggcaagatcagaaccacccacgccatgctggacagagagaaccccgacccccacgaggccgagctgatgagaaagatcgtggtgagcgtgaccgactgcggcagaccccccctgaaggccaccagcagcgccaccgtgttcgtgaacctgctggacctgaacgacaacgaccccaccttccagaacctgcccttcgtggccgaggtgctggagggcatccccgccggcgtgagcatctaccaggtggtggccatcgacctggacgagggcctgaacggcctggtgagctacagaatgcccgtgggcatgcccagaatggacttcctgatcaacagcagcagcggcgtggtggtgaccaccaccgagctggacagagagagaatcgccgagtaccagctgagagtggtggccagcgacgccggcacccccaccaagagcagcaccagcaccctgaccatccacgtgctggacgtgaacgacgagacccccaccttcttccccgccgtgtacaacgtgagcgtgagcgaggacgtgcccagagagttcagagtggtgtggctgaactgcaccgacaacgacgtgggcctgaacgccgagctgagctacttcatcaccggcggcaacgtggacggcaagttcagcgtgggctacagagacgccgtggtgagaaccgtggtgggcctggacagagagaccaccgccgcctacatgctgatcctggaggccatcgacaacggccccgtgggcaagagacacaccggcaccgccaccgtgttcgtgaccgtgctggacgtgaacgacaacagacccatcttcctgcagagcagctacgaggccagcgtgcccgaggacatccccgagggccacagcatcctgcagctgaaggccaccgacgccgacgagggcgagttcggcagagtgtggtacagaatcctgcacggcaaccacggcaacaacttcagaatccacgtgagcaacggcctgctgatgagaggccccagacccctggacagagagagaaacagcagccacgtgctgatcgtggaggcctacaaccacgacctgggccccatgagaagcagcgtgagagtgatcgtgtacgtggaggacatcaacgacgaggcccccgtgttcacccagcagcagtacagcagactgggcctgagagagaccgccggcatcggcaccagcgtgatcgtggtgcaggccaccgacagagacagcggcgacggcggcctggtgaactacagaatcctgagcggcgccgagggcaagttcgagatcgacgagagcaccggcctgatcatcaccgtgaactacctggactacgagaccaagaccagctacatgatgaacgtgagcgccaccgaccaggccccccccttcaaccagggcttctgcagcgtgtacatcaccctgctgaacgagctggacgaggccgtgcagttcagcaacgccagctacgaggccgccatcctggagaacctggccctgggcaccgagatcgtgagagtgcaggcctacagcatcgacaacctgaaccagatcacctacagattcaacgcctacaccagcacccaggccaaggccctgttcaagatcgacgccatcaccggcgtgatcaccgtgcagggcctggtggacagagagaagggcgacttctacaccctgaccgtggtggccgacgacggcggccccaaggtggacagcaccgtgcaggtgtacatcaccgtgctggacgagaacgacaacagccccagattcgacttcaccagcgacagcgccgtgagcatccccgaggactgccccgtgggccagagagtggccaccgtgaaggcctgggaccccgacgccggcagcaacggccaggtggtgttcagcctggccagcggcaacatcgccggcgccttcgagatcgtgaccaccaacgacagcatcggcgaggtgttcgtggccagacccctggacagagaggagctggaccactacatcctgcaggtggtggccagcgacagaggcaccccccccagaaagaaggaccacatcctgcaggtgaccatcctggacatcaacgacaacccccccgtgatcgagagccccttcggctacaacgtgagcgtgaacgagaacgtgggcggcggcaccgccgtggtgcaggtgagagccaccgacagagacatcggcatcaacagcgtgctgagctactacatcaccgagggcaacaaggacatggccttcagaatggacagaatcagcggcgagatcgccaccagacccgccccccccgacagagagagacagagcttctaccacctggtggccaccgtggaggacgagggcacccccaccctgagcgccaccacccacgtgtacgtgaccatcgtggacgagaacgacaacgcccccatgttccagcagccccactacgaggtgctgctggacgagggccccgacaccctgaacaccagcctgatcaccatccaggccctggacctggacgagggccccaacggcaccgtgacctacgccatcgtggccggcaacatcgtgaacaccttcagaatcgacagacacatgggcgtgatcaccgccgccaaggagctggactacgagatcagccacggcagatacaccctgatcgtgaccgccaccgaccagtgccccatcctgagccacagactgaccagcaccaccaccgtgctggtgaacgtgaacgacatcaacgacaacgtgcccaccttccccagagactacgagggccccttcgaggtgaccgagggccagcccggccccagagtgtggaccttcctggcccacgacagagacagcggccccaacggccaggtggagtacagcatcatggacggcgaccccctgggcgagttcgtgatcagccccgtggagggcgtgctgagagtgagaaaggacgtggagctggacagagagaccatcgccttctacaacctgaccatctgcgccagagacagaggcatgccccccctgagcagcaccatgctggtgggcatcagagtgctggacatcaacgacaacgaccccgtgctgctgaacctgcccatgaacatcaccatcagcgagaacagccccgtgagcagcttcgtggcccacgtgctggccagcgacgccgacagcggctgcaacgccagactgaccttcaacatcaccgccggcaacagagagagagccttcttcatcaacgccaccaccggcatcgtgaccgtgaacagacccctggacagagagagaatccccgagtacaagctgaccatcagcgtgaaggacaaccccgagaaccccagaatcgccagaagagactacgacctgctgctgatcttcctgagcgacgagaacgacaaccaccccctgttcaccaagagcacctaccaggccgaggtgatggagaacagccccgccggcacccccctgaccgtgctgaacggccccatcctggccctggacgccgaccaggacatctacgccgtggtgacctaccagctgctgggcgcccagagcggcctgttcgacatcaacagcagcaccggcgtggtgaccgtgagaagcggcgtgatcatcgacagagaggccttcagcccccccatcctggagctgctgctgctggccgaggacatcggcctgctgaacagcaccgcccacctgctgatcaccatcctggacgacaacgacaacagacccaccttcagccccgccaccctgaccgtgcacctgctggagaactgcccccccggcttcagcgtgctgcaggtgaccgccaccgacgaggacagcggcctgaacggcgagctggtgtacagaatcgaggccggcgcccaggacagattcctgatccacctggtgaccggcgtgatcagagtgggcaacgccaccatcgacagagaggagcaggagagctacagactgaccgtggtggccaccgacagaggcaccgtgcccctgagcggcaccgccatcgtgaccatcctgatcgacgacatcaacgacagcagacccgagttcctgaaccccatccagaccgtgagcgtgctggagagcgccgagcccggcaccgtgatcgccaacatcaccgccatcgaccacgacctgaaccccaagctggagtaccacatcgtgggcatcgtggccaaggacgacaccgacagactggtgcccaaccaggaggacgccttcgccgtgaacatcaacaccggcagcgtgatggtgaagagccccatgaacagagagctggtggccacctacgaggtgaccctgagcgtgatcgacaacgccagcgacctgcccgagagaagcgtgagcgtgcccaacgccaagctgaccgtgaacgtgctggacgtgaacgacaacaccccccagttcaagcccttcggcatcacctactacatggagagaatcctggagggcgccacccccggcaccaccctgatcgccgtggccgccgtggaccccgacaagggcctgaacggcctggtgacctacaccctgctggacctggtgccccccggctacgtgcagctggaggacagcagcgccggcaaggtgatcgccaacagaaccgtggactacgaggaggtgcactggctgaacttcaccgtgagagccagcgacaacggcagcccccccagagccgccgagatccccgtgtacctggagatcgtggacatcaacgacaacaaccccatcttcgaccagcccagctaccaggaggccgtgttcgaggacgtgcccgtgggcaccatcatcctgaccgtgaccgccaccgacgccgacagcggcaacttcgccctgatcgagtacagcctgggcgacggcgagagcaagttcgccatcaaccccaccaccggcgacatctacgtgctgagcagcctggacagagagaagaaggaccactacatcctgaccgccctggccaaggacaaccccggcgacgtggccagcaacagaagagagaacagcgtgcaggtggtgatccaggtgctggacgtgaacgactgcagaccccagttcagcaagccccagttcagcaccagcgtgtacgagaacgagcccgccggcaccagcgtgatcaccatgatggccaccgaccaggacgagggccccaacggcgagctgacctacagcctggagggccccggcgtggaggccttccacgtggacatggacagcggcctggtgaccacccagagacccctgcagagctacgagaagttcagcctgaccgtggtggccaccgacggcggcgagccccccctgtggggcaccaccatgctgctggtggaggtgatcgacgtgaacgacaacagacccgtgttcgtgagaccccccaacggcaccatcctgcacatcagagaggagatccccctgagaagcaacgtgtacgaggtgtacgccaccgacaaggacgagggcctgaacggcgccgtgagatacagcttcctgaagaccgccggcaacagagactgggagttcttcatcatcgaccccatcagcggcctgatccagaccgcccagagactggacagagagagccaggccgtgtacagcctgatcctggtggccagcgacctgggccagcccgtgccctacgagaccatgcagcccctgcaggtggccctggaggacatcgacgacaacgagcccctgttcgtgagaccccccaagggcagcccccagtaccagctgctgaccgtgcccgagcacagccccagaggcaccctggtgggcaacgtgaccggcgccgtggacgccgacgagggccccaacgccatcgtgtactacttcatcgccgccggcaacgaggagaagaacttccacctgcagcccgacggctgcctgctggtgctgagagacctggacagagagagagaggccatcttcagcttcatcgtgaaggccagcagcaacagaagctggaccccccccagaggccccagccccaccctggacctggtggccgacctgaccctgcaggaggtgagagtggtgctggaggacatcaacgaccagccccccagattcaccaaggccgagtacaccgccggcgtggccaccgacgccaaggtgggcagcgagctgatccaggtgctggccctggacgccgacatcggcaacaacagcctggtgttctacagcatcctggccatccactacttcagagccctggccaacgacagcgaggacgtgggccaggtgttcaccatgggcagcatggacggcatcctgagaaccttcgacctgttcatggcctacagccccggctacttcgtggtggacatcgtggccagagacctggccggccacaacgacaccgccatcatcggcatctacatcctgagagacgaccagagagtgaagatcgtgatcaacgagatccccgacagagtgagaggcttcgaggaggagttcatccacctgctgagcaacatcaccggcgccatcgtgaacaccgacaacgtgcagttccacgtggacaagaagggcagagtgaacttcgcccagaccgagctgctgatccacgtggtgaacagagacaccaacagaatcctggacgtggacagagtgatccagatgatcgacgagaacaaggagcagctgagaaacctgttcagaaactacaacgtgctggacgtgcagcccgccatcagcgtgagactgcccgacgacatgagcgccctgcagatggccatcatcgtgctggccatcctgctgttcctggccgccatgctgttcgtgctgatgaactggtactacagaaccgtgcacaagagaaagctgaaggccatcgtggccggcagcgccggcaacagaggcttcatcgacatcatggacatgcccaacaccaacaagtacagcttcgacggcgccaaccccgtgtggctggaccccttctgcagaaacctggagctggccgcccaggccgagcacgaggacgacctgcccgagaacctgagcgagatcgccgacctgtggaacagccccaccagaacccacggcaccttcggcagagagcccgccgccgtgaagcccgacgacgacagatacctgagagccgccatccaggagtacgacaacatcgccaagctgggccagatcatcagagagggccccatcaagggcagcctgctgaaggtggtgctggaggactacctgagactgaagaagctgttcgcccagagaatggtgcagaaggccagcagctgccacagcagcatcagcgagctgatccagaccgagctggacgaggagcccggcgaccacagccccggccagggcagcctgagattcagacacaagccccccgtggagctgaagggccccgacggcatccacgtggtgcacggcagcaccggcaccctgctggccaccgacctgaacagcctgcccgaggaggaccagaagggcctgggcagaagcctggagaccctgaccgccgccgaggccaccgccttcgagagaaacgccagaaccgagagcgccaagagcacccccctgcacaagctgagagacgtgatcatggagacccccctggagatcaccgagctgtag

SEQ ID NO: 74896 - DNA, 1338 bp, Artificial Sequence
  Description of Artificial Sequence: Synthetic coding sequence
atggacaacgaccccctggtgttcggcgtgagcggcgaggaggccagcagattcttcgccgtggagcccgacaccggcgtggtgtggctgagacagcccctggacagagagaccaagagcgagttcaccgtggagttcagcgtgagcgaccaccagggcgtgatcaccagaaaggtgaacatccaggtgggcgacgtgaacgacaacgcccccaccttccacaaccagccctacagcgtgagaatccccgagaacacccccgtgggcacccccatcttcatcgtgaacgccaccgaccccgacctgggcgccggcggcagcgtgctgtacagcttccagccccccagccagttcttcgccatcgacagcgccagaggcatcgtgaccgtgatcagagagctggactacgagaccacccaggcctaccagctgaccgtgaacgccctggccatcatcatcaccaacctgccctacagcaccaacatctacgagcacagcccccccggcaccaccgtgagaatcatcaccgccatcgaccaggacaagggcagacccagaggcatcggctacaccatcgtgagcggcaacaccaacagcatcttcgccctggactacatcagcggcgtgctgaccctgaacggcctgctggacagagagaaccccctgtacagccacggcttcatcctgaccgtgaagggcaccgagctgaacgacgacagaacccccagcgacgccaccgtgaccaccaccttcaacatcctggtgatcgacatcaacgacaacgcccccgagttcaacagcagcgagtacagcgtggccatcaccgagctggcccaggtgggcttcgccctgcccctgttcatccaggtggtggacaaggacgagggcctgaacagcatgttcgaggtgtacctggtgggcaacaacagccaccacttcatcatcagccccaccagcgtgcagggcaaggccgacatcagaatcagagtggccatccccctggactacgagaccgtggacagatacgacttcgacctgttcgccaacgagagcgtgcccgaccacgtgggctacgccaaggtgaagatcaccctgatcaacgagaacgacaacagacccatcttcagccagcccctgtacaacatcagcctgtacgagaacgtgaccgtgggcaccagcgtgctgaccgtgctggtgagccccagattcaccgccggccccctgagcagccccggccccaccgtggtgagacaccccgagggcttctgccccagagacctgagcaaccagggcagaagacacccccagatccccgagctgtgcctgctggtgtactag

SEQ ID NO: 74897 - DNA, 2187 bp, Artificial Sequence
  Description of Artificial Sequence: Synthetic coding sequence
gccaccgacaacgacgccggcaccttcggcgaggtgagctacttcttcagcgacgaccccgacagattcagcctggacaaggacaccggcctgatcatgctgatcgccagactggactacgagctgatccagagattcaccctgaccatcatcgccagagacggcggcggcgaggagaccaccggcagagtgagaatcaacgtgctggacgtgaacgacaacgtgcccaccttccagaaggacgcctacgtgggcgccctgagagagaacgagcccagcgtgacccagctggtgagactgagagccaccgacgaggacagcccccccaacaaccagatcacctacagcatcgtgagcgccagcgccttcggcagctacttcgacatcagcctgtacgagggctacggcgtgatcagcgtgagcagacccctggactacgagcagatcagcaacggcctgatctacctgaccgtgatggccatggacgccggcaacccccccctgaacagcaccgtgcccgtgaccatcgaggtgttcgacgagaacgacaacccccccaccttcagcaagcccgcctacttcgtgagcgtggtggagaacatcatggccggcgccaccgtgctgttcctgaacgccaccgacctggacagaagcagagagtacggccaggagagcatcatctacagcctggagggcagcacccagttcagaatcaacgccagaagcggcgagatcaccaccaccagcctgctggacagagagaccaagagcgagtacatcctgatcgtgagagccgtggacggcggcgtgggccacaaccagaagaccggcatcgccaccgtgaacatcaccctgctggacatcaacgacaaccaccccacctggaaggacgccccctactacatcaacctggtggagatgaccccccccgacagcgacgtgaccaccgtggtggccgtggaccccgacctgggcgagaacggcaccctggtgtacagcatccagccccccaacaagttctacagcctgaacagcaccaccggcaagatcagaaccacccacgccatgctggacagagagaaccccgacccccacgaggccgagctgatgagaaagatcgtggtgagcgtgaccgactgcggcagaccccccctgaaggccaccagcagcgccaccgtgttcgtgaacctgctggacctgaacgacaacgaccccaccttccagaacctgcccttcgtggccgaggtgctggagggcatccccgccggcgtgagcatctaccaggtggtggccatcgacctggacgagggcctgaacggcctggtgagctacagaatgcccgtgggcatgcccagaatggacttcctgatcaacagcagcagcggcgtggtggtgaccaccaccgagctggacagagagagaatcgccgagtaccagctgagagtggtggccagcgacgccggcacccccaccaagagcagcaccagcaccctgaccatccacgtgctggacgtgaacgacgagacccccaccttcttccccgccgtgtacaacgtgagcgtgagcgaggacgtgcccagagagttcagagtggtgtggctgaactgcaccgacaacgacgtgggcctgaacgccgagctgagctacttcatcaccggcggcaacgtggacggcaagttcagcgtgggctacagagacgccgtggtgagaaccgtggtgggcctggacagagagaccaccgccgcctacatgctgatcctggaggccatcgacaacggccccgtgggcaagagacacaccggcaccgccaccgtgttcgtgaccgtgctggacgtgaacgacaacagacccatcttcctgcagagcagctacgaggccagcgtgcccgaggacatccccgagggccacagcatcctgcaggaggacctggccagcccctgcatcagccccgccccccccagaagagccttccagagcagcggcgagaaggagaccagccagttccccggcaaggagctgagaagagagcccggccccagcaaggcccagaacagagccgccttcaccgagcccctggccgaggcccccctgctgggcagcaagcaggcccaggaggagagagcccccctgcccagagagcaggcccagcagctgcagggcagcgagggcgagaagggcggcccctag

SEQ ID NO: 74898 - DNA, 2238 bp, Artificial Sequence
  Description of Artificial Sequence: Synthetic coding sequence
atgagaagatgcagatgggccgccctggccctgggcctgctgagactgtgcctggcccaggccaacttcgccccccacttcttcgacaacggcgtgggcagcaccaacggcaacatggccctgttcagcctgcccgaggacacccccgtgggcagccacgtgtacaccctgaacggcaccgaccccgagggcgaccccatcagctaccacatcagcttcgaccccagcaccagaagcgtgttcagcgtggaccccaccttcggcaacatcaccctggtggaggagctggacagagagagagaggacgagatcgaggccatcatcagcatcagcgacggcctgaacctggtggccgagaaggtggtgatcctggtgaccgacgccaacgacgaggcccccagattcatccaggagccctacgtggccctggtgcccgaggacatccccgccggcagcatcatcttcaaggtgcacgccgtggacagagacaccggcagcggcggcagcgtgacctacttcctgcagaacctgcacagccccttcgccgtggacagacacagcggcgtgctgagactgcaggccggcgccaccctggactacgagagaagcagaacccactacatcaccgtggtggccaaggacggcggcggcagactgcacggcgccgacgtggtgttcagcgccaccaccaccgtgaccgtgaacgtggaggacgtgcaggacatggcccccgtgttcgtgggcaccccctactacggctacgtgtacgaggacaccctgcccggcagcgaggtgctgaaggtggtggccatggacggcgacagaggcaagcccaacagaatcctgtacagcctggtgaacggcaacgacggcgccttcgagatcaacgagaccagcggcgccatcagcatcacccagagccccgcccagctgcagagagaggtgtacgagctgcacgtgcaggtgaccgagatgagccccgccggcagccccgccgcccaggccaccgtgcccgtgaccatcagaatcgtggacctgaacaaccacccccccaccttctacggcgagagcggcccccagaacagattcgagctgagcatgaacgagcaccccccccagggcgagatcctgagaggcctgaagatcaccgtgaacgacagcgaccagggcgccaacgccaagttcaacctgcagctggtgggccccagaggcatcttcagagtggtgccccagaccgtgctgaacgaggcccaggtgaccatcatcgtggagaacagcgccgccatcgacttcgagaagagcaaggtgctgaccttcaagctgctggccgtggaggtgaacacccccgagaagttcagcagcaccgccgacgtggtgatccagctgctggacaccaacgacaacgtgcccaagttcgacagcctgtactacgtggccagaatccccgagaacgcccccggcggcagcagcgtggtggccgtgaccgccgtggaccccgacaccggcccctggggcgaggtgaagtacagcacctacggcaccggcgccgacctgttcctgatccaccccagcaccggcctgatctacacccagccctgggccagcctggacgccgaggccaccgccagatacaacttctacgtgaaggccgaggacatggagggcaagtacagcgtggccgaggtgttcatcaccctgctggacgtgaacgaccaccccccccagttcggcaagagcgtgcagaagaagaccatggtgctgggcacccccgtgaagatcgaggccatcgacgaggacgccgaggagcccaacaacctggtggactacagcatcacccacgccgagcccgccaacgtgttcgacatcaacagccacaccggcgagatctggctgaagaacagcatcagaagcctggacgccctgcacaacatcacccccggcagagactgcctgtggagcctggaggtgcaggccaaggacagaggcagccccagcttcagcaccaccgccctgctgaagatcgacatcaccgacgccgaggtgagaagactgagatacatgaagaacagcaacttccccggcaccaccaagagcgtgagaaagcccaagttcaagcccaagaagccccacagcagccagggcctgttcctgcacccccactgcgagatcgccctgttcaacctgagcaacgtgaacctgtacagcagagtgttccagggcgccgcccaggccagctag

SEQ ID NO: 74899 - DNA, 2580 bp, Artificial Sequence
  Description of Artificial Sequence: Synthetic coding sequence
atgagaagatgcagatgggccgccctggccctgggcctgctgagactgtgcctggcccaggccaacttcgccccccacttcttcgacaacggcgtgggcagcaccaacggcaacatggccctgttcagcctgcccgaggacacccccgtgggcagccacgtgtacaccctgaacggcaccgaccccgagggcgaccccatcagctaccacatcagcttcgaccccagcaccagaagcgtgttcagcgtggaccccaccttcggcaacatcaccctggtggaggagctggacagagagagagaggacgagatcgaggccatcatcagcatcagcgacggcctgaacctggtggccgagaaggtggtgatcctggtgaccgacgccaacgacgaggcccccagattcatccaggagccctacgtggccctggtgcccgaggacatccccgccggcagcatcatcttcaaggtgcacgccgtggacagagacaccggcagcggcggcagcgtgacctacttcctgcagaacctgcacagccccttcgccgtggacagacacagcggcgtgctgagactgcaggccggcgccaccctggactacgagagaagcagaacccactacatcaccgtggtggccaaggacggcggcggcagactgcacggcgccgacgtggtgttcagcgccaccaccaccgtgaccgtgaacgtggaggacgtgcaggacatggcccccgtgttcgtgggcaccccctactacggctacgtgtacgaggacaccctgcccggcagcgaggtgctgaaggtggtggccatggacggcgacagaggcaagcccaacagaatcctgtacagcctggtgaacggcaacgacggcgccttcgagatcaacgagaccagcggcgccatcagcatcacccagagccccgcccagctgcagagagaggtgtacgagctgcacgtgcaggtgaccgagatgagccccgccggcagccccgccgcccaggccaccgtgcccgtgaccatcagaatcgtggacctgaacaaccacccccccaccttctacggcgagagcggcccccagaacagattcgagctgagcatgaacgagcaccccccccagggcgagatcctgagaggcctgaagatcaccgtgaacgacagcgaccagggcgccaacgccaagttcaacctgcagctggtgggccccagaggcatcttcagagtggtgccccagaccgtgctgaacgaggcccaggtgaccatcatcgtggagaacagcgccgccatcgacttcgagaagagcaaggtgctgaccttcaagctgctggccgtggaggtgaacacccccgagaagttcagcagcaccgccgacgtggtgatccagctgctggacaccaacgacaacgtgcccaagttcgacagcctgtactacgtggccagaatccccgagaacgcccccggcggcagcagcgtggtggccgtgaccgccgtggaccccgacaccggcccctggggcgaggtgaagtacagcacctacggcaccggcgccgacctgttcctgatccaccccagcaccggcctgatctacacccagccctgggccagcctggacgccgaggccaccgccagatacaacttctacgtgaaggccgaggacatggagggcaagtacagcgtggccgaggtgttcatcaccctgctggacgtgaacgaccaccccccccagttcggcaagagcgtgcagaagaagaccatggtgctgggcacccccgtgaagatcgaggccatcgacgaggacgccgaggagcccaacaacctggtggactacagcatcacccacgccgagcccgccaacgtgttcgacatcaacagccacaccggcgagatctggctgaagaacagcatcagaagcctggacgccctgcacaacatcacccccggcagagactgcctgtggagcctggaggtgcaggccaaggacagaggcagccccagcttcagcaccaccgccctgctgaagatcgacatcaccgacgccgagaccctgagcagaagccccatggccgccttcctgatccagaccaaggacaaccccatgaaggccgtgggcgtgctggccggcaccatggccaccgtggtggccatcaccgtgctgatcagcaccgccaccttctggagaaacaagaagagcaacaaggtgctgcccatgagaagagtgctgagaaagagacccagccccgcccccagaaccatcagaatcgagtggctgaagagcaagagcaccaaggccgccaccaagttcatgctgaaggagaagccccccaacgagaactgcaacaacaacagccccgagagcagcctgctgcccagagcccccgccctgccccccccccccagcgtggcccccagcaccggcgccgcccagtggaccgtgcccaccgtgagcggcagcctgaccccccagcccacccagcccccccccaagcccaagaccatgggcagccccgtgcagagcaccctgatcagcgagctgaagcagaagttcgagaagaagagcgtgcacaacaaggcctacttctag

SEQ ID NO: 74900 - DNA, 1692 bp, Artificial Sequence
  Description of Artificial Sequence: Synthetic coding sequence
atggcccccgtgttcgtgggcaccccctactacggctacgtgtacgaggacaccctgcccggcagcgaggtgctgaaggtggtggccatggacggcgacagaggcaagcccaacagaatcctgtacagcctggtgaacggcaacgacggcgccttcgagatcaacgagaccagcggcgccatcagcatcacccagagccccgcccagctgcagagagaggtgtacgagctgcacgtgcaggtgaccgagatgagccccgccggcagccccgccgcccaggccaccgtgcccgtgaccatcagaatcgtggacctgaacaaccacccccccaccttctacggcgagagcggcccccagaacagattcgagctgagcatgaacgagcaccccccccagggcgagatcctgagaggcctgaagatcaccgtgaacgacagcgaccagggcgccaacgccaagttcaacctgcagctggtgggccccagaggcatcttcagagtggtgccccagaccgtgctgaacgaggcccaggtgaccatcatcgtggagaacagcgccgccatcgacttcgagaagagcaaggtgctgaccttcaaggccgtggaccccgacaccggcccctggggcgaggtgaagtacagcacctacggcaccggcgccgacctgttcctgatccaccccagcaccggcctgatctacacccagccctgggccagcctggacgccgaggccaccgccagatacaacttctacgtgaaggccgaggacatggagggcaagtacagcgtggccgaggtgttcatcaccctgctggacgtgaacgaccaccccccccagttcggcaagagcgtgcagaagaagaccatggtgctgggcacccccgtgaagatcgaggccatcgacgaggacgccgaggagcccaacaacctggtggactacagcatcacccacgccgagcccgccaacgtgttcgacatcaacagccacaccggcgagatctggctgaagaacagcatcagaagcctggacgccctgcacaacatcacccccggcagagactgcctgtggagcctggaggtgcaggccaaggacagaggcagccccagcttcagcaccaccgccctgctgaagatcgacatcaccgacgccgagaccctgagcagaagccccatggccgccttcctgatccagaccaaggacaaccccatgaaggccgtgggcgtgctggccggcaccatggccaccgtggtggccatcaccgtgctgatcagcaccgccaccttctggagaaacaagaagagcaacaaggtgctgcccatgagaagagtgctgagaaagagacccagccccgcccccagaaccatcagaatcgagtggctgaagagcaagagcaccaaggccgccaccaagttcatgctgaaggagaagccccccaacgagaactgcaacaacaacagccccgagagcagcctgctgcccagagcccccgccctgccccccccccccagcgtggcccccagcaccggcgccgcccagtggaccgtgcccaccgtgagcggcagcctgaccccccagcccacccagcccccccccaagcccaagaccatgggcagccccgtgcagagcaccctgatcagcgagctgaagcagaagttcgagaagaagagcgtgcacaacaaggcctacttctag

SEQ ID NO: 74901 - DNA, 1464 bp, Artificial Sequence
  Description of Artificial Sequence: Synthetic coding sequence
atgggcagctgggccctgctgtggccccccctgctgttcaccggcctgctggtgagaccccccggcaccatggcccaggcccagtactgcagcgtgaacaaggacatcttcgaggtggaggagaacaccaacgtgaccgagcccctggtggacatccacgtgcccgagggccaggaggtgaccctgggcgccctgagcacccccttcgccttcagaatccagggcaaccagctgttcctgaacgtgacccccgactacgaggagaagagcctgctggaggcccagctgctgtgccagagcggcggcaccctggtgacccagctgagagtgttcgtgagcgtgctggacgtgaacgacaacgcccccgagttccccttcaagaccaaggagatcagagtggaggaggacaccaaggtgaacagcaccgtgatccccgagacccagctgcaggccgaggacagagacaaggacgacatcctgttctacaccctgcaggagatgaccgccggcgccagcgactacttcagcctggtgagcgtgaacagacccgccctgagactggacagacccctggacttctacgagagacccaacatgaccttctggctgctggtgagagacacccccggcgagaacgtggagcccagccacaccgccaccgccaccctggtgctgaacgtggtgcccgccgacctgagacccccctggttcctgccctgcaccttcagcgacggctacgtgtgcatccaggcccagtaccacggcgccgtgcccaccggccacatcctgcccagccccctggtgctgagacccggccccatctacgccgaggacggcgacagaggcatcaaccagcccatcatctacagcatcttcagaggcaacgtgaacggcaccttcatcatccaccccgacagcggcaacctgaccgtggccagaagcgtgcccagccccatgaccttcctgctgctggtgaagggccagcaggccgacctggccagatacagcgtgacccaggtgaccgtggaggccgtggccgccgccggcagcccccccagattcccccagagactgtacagaggcaccgtggccagaggcgccggcgccggcgtggtggtgaaggacgccgccgcccccagccagcccctgagaatccaggcccaggaccccgagttcagcgacctgaacagcgccatcacctacagaatcaccaaccacagccacttcagaatggagggcgaggtggtgctgaccaccaccaccctggcccaggccggcgccttctacgccgagccccccacctgcaccggcgacctgagacaccccgcccacctgagaccccccgcccccgaccccacccagagactgcccggcgaggccgaggagcccatgcagacccccaaggccacccacctgggcgccggcggcctgaagcacctgcccggcgtgctggtgcccttctag

SEQ ID NO: 74902 - DNA, 1956 bp, Artificial Sequence
  Description of Artificial Sequence: Synthetic coding sequence
atgggcagctgggccctgctgtggccccccctgctgttcaccggcctgctggtgagaccccccggcaccatggcccaggcccagtactgcagcgtgaacaaggacatcttcgaggtggaggagaacaccaacgtgaccgagcccctggtggacatccacgtgcccgagggccaggaggtgaccctgggcgccctgagcacccccttcgccttcagaatccagggcaaccagctgttcctgaacgtgacccccgactacgaggagaagagcctgctggaggcccagctgctgtgccagagcggcggcaccctggtgacccagctgagagtgttcgtgagcgtgctggacgtgaacgacaacgcccccgagttccccttcaagaccaaggagatcagagtggaggaggacaccaaggtgaacagcaccgtgatccccgagacccagctgcaggccgaggacagagacaaggacgacatcctgttctacaccctgcaggagatgaccgccggcgccagcgactacttcagcctggtgagcgtgaacagacccgccctgagactggacagacccctggacttctacgagagacccaacatgaccttctggctgctggtgagagacacccccggcgagaacgtggagcccagccacaccgccaccgccaccctggtgctgaacgtggtgcccgccgacctgagacccccctggttcctgccctgcaccttcagcgacggctacgtgtgcatccaggcccagtaccacggcgccgtgcccaccggccacatcctgcccagccccctggtgctgagacccggccccatctacgccgaggacggcgacagaggcatcaaccagcccatcatctacagcatcttcagaggcaacgtgaacggcaccttcatcatccaccccgacagcggcaacctgaccgtggccagaagcgtgcccagccccatgaccttcctgctgctggtgaagggccagcaggccgacctggccagatacagcgtgacccaggtgaccgtggaggccgtggccgccgccggcagcccccccagattcccccagagactgtacagaggcaccgtggccagaggcgccggcgccggcgtggtggtgaaggacgccgccgcccccagccagcccctgagaatccaggcccaggaccccgagttcagcgacctgaacagcgccatcacctacagaatcaccaaccacagccacttcagaatggagggcgaggtggtgctgaccaccaccaccctggcccaggccggcgccttctacgccgaggtggaggcccacaacaccgtgaccagcggcaccgccaccaccgtgatcgagatccaggtgagcgagcaggagccccccagcaccggcggcggccccagcgaggacaagagattcagcgtggtggacatggccgccctgggcggcgtgctgggcgccctgctgctgctggccctgctgggcctggccgtgctggtgcacaagcactacggccccagactgaagtgctgctgcggcaaggcccccgagccccagccccagggcttcgacaaccaggccttcctgcccgaccacaaggccaactgggcccccgtgcccagccccacccacgaccccaagcccgccgaggcccccatgcccgccgagcccgccccccccggccccgccagccccggcggcgcccccgagccccccgccgccgccagagccggcggcagccccaccgccgtgagaagcatcctgaccaaggagagaagacccgagggcggctacaaggccgtgtggttcggcgaggacatcggcaccgaggccgacgtggtggtgctgaacgcccccaccctggacgtggacggcgccagcgacagcggcagcggcgacgagggcgagggcgccggcagaggcggcggcccctacgacgcccccggcggcgacgacagctacatctag

SEQ ID NO: 74903 - DNA, 2538 bp, Artificial Sequence
  Description of Artificial Sequence: Synthetic coding sequence
atgggcagctgggccctgctgtggccccccctgctgttcaccggcctgctggtgagaccccccggcaccatggcccaggcccagtactgcagcgtgaacaaggacatcttcgaggtggaggagaacaccaacgtgaccgagcccctggtggacatccacgtgcccgagggccaggaggtgaccctgggcgccctgagcacccccttcgccttcagaatccagggcaaccagctgttcctgaacgtgacccccgactacgaggagaagagcctgctggaggcccagctgctgtgccagagcggcggcaccctggtgacccagctgagagtgttcgtgagcgtgctggacgtgaacgacaacgcccccgagttccccttcaagaccaaggagatcagagtggaggaggacaccaaggtgaacagcaccgtgatccccgagacccagctgcaggccgaggacagagacaaggacgacatcctgttctacaccctgcaggagatgaccgccggcgccagcgactacttcagcctggtgagcgtgaacagacccgccctgagactggacagacccctggacttctacgagagacccaacatgaccttctggctgctggtgagagacacccccggcgagaacgtggagcccagccacaccgccaccgccaccctggtgctgaacgtggtgcccgccgacctgagacccccctggttcctgccctgcaccttcagcgacggctacgtgtgcatccaggcccagtaccacggcgccgtgcccaccggccacatcctgcccagccccctggtgctgagacccggccccatctacgccgaggacggcgacagaggcatcaaccagcccatcatctacagcatcttcagaggcaacgtgaacggcaccttcatcatccaccccgacagcggcaacctgaccgtggccagaagcgtgcccagccccatgaccttcctgctgctggtgaagggccagcaggccgacctggccagatacagcgtgacccaggtgaccgtggaggccgtggccgccgccggcagcccccccagattcccccagagactgtacagaggcaccgtggccagaggcgccggcgccggcgtggtggtgaaggacgccgccgcccccagccagcccctgagaatccaggcccaggaccccgagttcagcgacctgaacagcgccatcacctacagaatcaccaaccacagccacttcagaatggagggcgaggtggtgctgaccaccaccaccctggcccaggccggcgccttctacgccgaggtggaggcccacaacaccgtgaccagcggcaccgccaccaccgtgatcgagatccaggtgagcgagcaggagccccccagcaccgacgtgccccccagccccgaggccggcggcaccaccggcccctggaccagcaccaccagcgaggtgcccagaccccccgagcccagccagggccccagcaccaccagcagcggcggcggcaccggcccccacccccccagcggcaccaccctgagaccccccaccagcagcacccccggcggcccccccggcgccgagaacagcaccagccaccagcccgccacccccggcggcgacaccgcccagacccccaagcccggcaccagccagcccatgccccccggcgtgggcaccagcaccagccaccagcccgccacccccagcggcggcaccgcccagacccccgagcccggcaccagccagcccatgccccccagcatgggcaccagcaccagccaccagcccgccacccccggcggcggcaccgcccagacccccgaggccggcaccagccagcccatgccccccggcatgggcaccagcaccagccaccagcccaccacccccggcggcggcaccgcccagacccccgagcccggcaccagccagcccatgcccctgagcaagagcacccccagcagcggcggcggccccagcgaggacaagagattcagcgtggtggacatggccgccctgggcggcgtgctgggcgccctgctgctgctggccctgctgggcctggccgtgctggtgcacaagcactacggccccagactgaagtgctgctgcggcaaggcccccgagccccagccccagggcttcgacaaccaggccttcctgcccgaccacaaggccaactgggcccccgtgcccagccccacccacgaccccaagcccgccgaggcccccatgcccgccgagcccgccccccccggccccgccagccccggcggcgcccccgagccccccgccgccgccagagccggcggcagccccaccgccgtgagaagcatcctgaccaaggagagaagacccgagggcggctacaaggccgtgtggttcggcgaggacatcggcaccgaggccgacgtggtggtgctgaacgcccccaccctggacgtggacggcgccagcgacagcggcagcggcgacgagggcgagggcgccggcagaggcggcggcccctacgacgcccccggcggcgacgacagctacatctag

SEQ ID NO: 74904 - DNA, 2538 bp, Artificial Sequence; identical to SEQ ID NO: 74903
  Description of Artificial Sequence: Synthetic coding sequence

SEQ ID NO: 74905 - DNA, 786 bp, Artificial Sequence
  Description of Artificial Sequence: Synthetic coding sequence
atggccgagagccacctgcagagcagcctgatcaccgccagccagttcttcgagatctggctgcacttcgacgccgacggcagcggctacctggagggcaaggagctgcagaacctgatccaggagctgcagcaggccagaaagaaggccggcctggagctgagccccgagatgaagaccttcgtggaccagtacggccagagagacgacggcaagatcggcatcgtggagctggcccacgtgctgcccaccgaggagaacttcctgctgctgttcagatgccagcagctgaagagctgcgaggagttcatgaagacctggagaaagtacgacaccgaccacagcggcttcatcgagaccgaggagctgaagaacttcctgaaggacctgctggagaaggccaacaagaccgtggacgacaccaagctggccgagtacaccgacctgatgctgaagctgttcgacagcaacaacgacggcaagctggagctgaccgagatggccagactgctgcccgtgcaggagaacttcctgctgaagttccagggcatcaagatgtgcggcaaggagttcaacaaggccttcgagctgtacgaccaggacggcaacggctacatcgacgagaacgagctggacgccctgctgaaggacctgtgcgagaagaacaagcaggacctggacatcaacaacatcaccacctacaagaagaacatcatggccctgagcgacggcggcaagctgtacagaaccgacctggccctgatcctgtgcgccggcgacaactag

SEQ ID NO: 74906 - DNA, 615 bp, Artificial Sequence
  Description of Artificial Sequence: Synthetic coding sequence
atgaagaccttcgtggaccagtacggccagagagacgacggcaagatcggcatcgtggagctggcccacgtgctgcccaccgaggagaacttcctgctgctgttcagatgccagcagctgaagagctgcgaggagttcatgaagacctggagaaagtacgacaccgaccacagcggcttcatcgagaccgaggagctgaagaacttcctgaaggacctgctggagaaggccaacaagaccgtggacgacaccaagctggccgagtacaccgacctgatgctgaagctgttcgacagcaacaacgacggcaagctggagctgaccgagatggccagactgctgcccgtgcaggagaacttcctgctgaagttccagggcatcaagatgtgcggcaaggagttcaacaaggccttcgagctgtacgaccaggacggcaacggctacatcgacgagaacgagctggacgccctgctgaaggacctgtgcgagaagaacaagcaggacctggacatcaacaacatcaccacctacaagaagaacatcatggccctgagcgacggcggcaagctgtacagaaccgacctggccctgatcctgtgcgccggcgacaactag

SEQ ID NO: 74907 - DNA, 816 bp, Artificial Sequence
  Description of Artificial Sequence: Synthetic coding sequence
atggccggcccccagcagcagcccccctacctgcacctggccgagctgaccgccagccagttcctggagatctggaagcacttcgacgccgacggcaacggctacatcgagggcaaggagctggagaacttcttccaggagctggagaaggccagaaagggcagcggcatgatgagcaagagcgacaacttcggcgagaagatgaaggagttcatgcagaagtacgacaagaacagcgacggcaagatcgagatggccgagctggcccagatcctgcccaccgaggagaacttcctgctgtgcttcagacagcacgtgggcagcagcgccgagttcatggaggcctggagaaagtacgacaccgacagaagcggctacatcgaggccaacgagctgaagggcttcctgagcgacctgctgaagaaggccaacagaccctacgacgagcccaagctgcaggagtacacccagaccatcctgagaatgttcgacctgaacggcgacggcaagctgggcctgagcgagatgagcagactgctgcccgtgcaggagaacttcctgctgaagttccagggcatgaagctgaccagcgaggagttcaacgccatcttcaccttctacgacaaggacagaagcggctacatcgacgagcacgagctggacgccctgctgaaggacctgtacgagaagaacaagaaggagatgaacatccagcagctgaccaactacagaaagagcgtgatgagcctggccgaggccggcaagctgtacagaaaggacctggagatcgtgctgtgcagcgagccccccatgtag

SEQ ID NO: 74908 - DNA, 579 bp, Artificial Sequence
  Description of Artificial Sequence: Synthetic coding sequence
atggccggcccccagcagcagcccccctacctgcacctggccgagctgaccgccagccagttcctggagatctggaagcacttcgacgccgacggcaacggctacatcgagggcaaggagctggagaacttcttccaggagctggagaaggccagaaagggcagcggcatgatgagcaagagcgacaacttcggcgagaagatgaaggagttcatgcagaagtacgacaagaacagcgacggcaagatcgagatggccgagctggcccagatcctgcccaccgaggagaacttcctgctgtgcttcagacagcacgtgggcagcagcgccgagttcatggaggcctggagaaagtacgacaccgacagaagcggctacatcgaggccaacgagctgaagggcttcctgagcgacctgctgaagaaggccaacagaccctacgacgagcccaagctgcaggagtacacccagaccatcctgagaatgttcgacctgaacggcgacggcaagctgggcctgagcgagatgagcagaatcgaggccgccaccctgaccagcatgagctggatgcccttctag

SEQ ID NO: 74909 - DNA, 6663 bp, Artificial Sequence
  Description of Artificial Sequence: Synthetic coding sequence
atgatcagaatcgccgccctgaacgccagcagcaccatcgaggacgaccacgagggcagcttcaagagccacaagacccagaccaaggaggcccaggaggccgaggccttcgccctgtaccacaaggccctggacctgcagaagcacgacagattcgaggagagcgccaaggcctaccacgagctgctggaggccagcctgctgagagaggccgtgagcagcggcgacgagaaggagggcctgaagcaccccggcctgatcctgaagtacagcacctacaagaacctggcccagctggccgcccagagagaggacctggagaccgccatggagttctacctggaggccgtgatgctggacagcaccgacgtgaacctgtggtacaagatcggccacgtggccctgagactgatcagaatccccctggccagacacgccttcgaggagggcctgagatgcaaccccgaccactggccctgcctggacaacctgatcaccgtgctgtacaccctgagcgactacaccacctgcctgtacttcatctgcaaggccctggagaaggactgcagatacagcaagggcctggtgctgaaggagaagatcttcgaggagcagccctgcctgagaaaggacagcctgagaatgttcctgaagtgcgacatgagcatccacgacgtgagcgtgagcgccgccgagacccaggccatcgtggacgaggccctgggcctgagaaagaagagacaggccctgatcgtgagagagaaggagcccgacctgaagctggtgcagcccatccccttcttcacctggaagtgcctgggcgagagcctgctggccatgtacaaccacctgaccacctgcgagccccccagacccagcctgggcaagagaatcgacctgagcgactaccaggaccccagccagcccctggagagcagcatggtggtgacccccgtgaacgtgatccagcccagcaccgtgagcaccaaccccgccgtggccgtggccgagcccgtggtgagctacaccagcgtggccaccaccagcttccccctgcacagccccggcctgctggagaccggcgcccccgtgggcgacatcagcggcggcgacaagagcaagaagggcgtgaagagaaagaagatcagcgaggagagcggcgagaccgccaagagaagaagcgccagagtgagaaacaccaagtgcaagaaggaggagaaggtggacttccaggagctgctgatgaagttcctgcccagcagactgagaaagctggaccccgaggaggaggacgacagcttcaacaactacgaggtgcagagcgaggccaagctggagagcttccccagcatcggcccccagagactgagcttcgacagcgccaccttcatggagagcgagaagcaggacgtgcacgagttcctgctggagaacctgaccaacggcggcatcctggagctgatgatgagatacctgaaggccatgggccacaagttcctggtgagatggccccccggcctggccgaggtggtgctgagcgtgtaccacagctggagaagacacagcaccagcctgcccaaccccctgctgagagactgcagcaacaagcacatcaaggacatgatgctgatgagcctgagctgcatggagctgcagctggaccagtggctgctgaccaagggcagaagcagcgccgtgagccccagaaactgccccgccggcatggtgaacggcagattcggccccgacttccccggcacccactgcctgggcgacctgctgcagctgagcttcgccagcagccagagagacctgttcgaggacggctggctggagttcgtggtgagagtgtactggctgaaggccagattcctggccctgcagggcgacatggagcaggccctggagaactacgacatctgcaccgagatgctgcagagcagcaccgccatccaggtggaggccggcgccgagagaagagacatcgtgatcagactgcccaacctgcacaacgacagcgtggtgagcctggaggagatcgacaagaacctgaagagcctggagagatgccagagcctggaggagatccagagactgtacgaggccggcgactacaaggccgtggtgcacctgctgagacccaccctgtgcaccagcggcttcgacagagccaagcacctggagttcatgaccagcatccccgagagacccgcccagctgctgctgctgcaggacagcctgctgagactgaaggactacagacagtgcttcgagtgcagcgacgtggccctgaacgaggccgtgcagcagatggtgaacagcggcgaggccgccgccaaggaggagtgggtggccaccgtgacccagctgctgatgggcatcgagcaggccctgagcgccgacagcagcggcagcatcctgaaggtgagcagcagcaccaccggcctggtgagactgaccaacaacctgatccaggtgatcgactgcagcatggccgtgcaggaggaggccaaggagccccacgtgagcagcgtgctgccctggatcatcctgcacagaatcatctggcaggaggaggacaccttccacagcctgtgccaccagcagcagctgcagaaccccgccgaggagggcatgagcgagacccccatgctgcccagcagcctgatgctgctgaacaccgcccacgagtacctgggcagaagaagctggtgctgcaacagcgacggcgccctgctgagattctacgtgagagtgctgcagaaggagctggccgccagcaccagcgaggacacccacccctacaaggaggagctggagaccgccctggagcagtgcttctactgcctgtacagcttccccagcaagaagagcaaggccagatacctggaggagcacagcgcccagcaggtggacctgatctgggaggacgccctgttcatgttcgagtacttcaagcccaagaccctgcccgagttcgacagctacaagaccagcaccgtgagcgccgacctggccaacctgctgaagagaatcgccaccatcgtgcccagaaccgagagacccgccctgagcctggacaaggtgagcgcctacatcgagggcaccagcaccgaggtgccctgcctgcccgagggcgccgaccccagcccccccgtggtgaacgagctgtactacctgctggccgactaccacttcaagaacaaggagcagagcaaggccatcaagttctacatgcacgacatctgcatctgccccaacagattcgacagctgggccggcatggccctggccagagccagcagaatccaggacaagctgaacagcaacgagctgaagagcgacggccccatctggaagcacgccacccccgtgctgaactgcttcagaagagccctggagatcgacagcagcaacctgagcctgtggatcgagtacggcaccatgagctacgccctgcacagcttcgccagcagacagctgaagcagtggagaggcgagctgccccccgagctggtgcagcagatggagggcagaagagacagcatgctggagaccgccaagcactgcttcaccagcgccgccagatgcgagggcgacggcgacgaggaggagtggctgatccactacatgctgggcaaggtggccgagaagcagcagcagccccccaccgtgtacctgctgcactacagacaggccggccactacctgcacgaggaggccgccagataccccaagaagatccactaccacaacccccccgagctggccatggaggccctggaggtgtacttcagactgcacgccagcatcctgaagctgctgggcaagcccgacagcggcgtgggcgccgaggtgctggtgaacttcatgaaggaggccgccgagggccccttcgccagaggcgaggagaagaacacccccaaggccagcgagaaggagaaggcctgcctggtggacgaggacagccacagcagcgccggcaccctgcccggccccggcgccagcctgcccagcagcagcggccccggcctgaccagccccccctacaccgccacccccatcgaccacgactacgtgaagtgcaagaagccccaccagcaggccacccccgacgacagaagccaggacagcaccgccgtggccctgagcgacagcagcagcacccaggacttcttcaacgagcccaccagcctgctggagggcagcagaaagagctacaccgagaagagactgcccatcctgagcagccaggccggcgccaccggcaaggacctgcagggcgccaccgaggagagaggcaagaacgaggagagcctggagagcaccgagggcttcagagccgccgagcagggcgtgcagaagcccgccgccgagacccccgccagcgcctgcatccccggcaagcccagcgccagcacccccaccctgtgggacggcaagaagagaggcgacctgcccggcgagcccgtggccttcccccagggcctgcccgccggcgccgaggagcagagacagttcctgaccgagcagtgcatcgccagcttcagactgtgcctgagcagattcccccagcactacaagagcctgtacagactggccttcctgtacacctacagcaagacccacagaaacctgcagtgggccagagacgtgctgctgggcagcagcatcccctggcagcagctgcagcacatgcccgcccagggcctgttctgcgagagaaacaagaccaacttcttcaacggcatctggagaatccccgtggacgagatcgacagacccggcagcttcgcctggcacatgaacagaagcatcgtgctgctgctgaaggtgctggcccagctgagagaccacagcaccctgctgaaggtgagcagcatgctgcagagaacccccgaccagggcaagaagtacctgagagacgccgacagacaggtgctggcccagagagccttcatcctgaccgtgaaggtgctggaggacaccctgagcgagctggccgagggcagcgagagacccggccccaaggtgtgcggcctgcccggcgccagaatgaccaccgacgtgagccacaaggccagccccgaggacggccaggagggcctgccccagcccaagaagccccccctggccgacggcagcggccccggccccgagcccggcggcaaggtgggcctgctgaaccacagacccgtggccatggacgccggcgacagcgccgaccagagcggcgagagaaaggacaaggagagccccagagccggccccaccgagcccatggacaccagcgaggccaccgtgtgccacagcgacctggagagaaccccccccctgctgcccggcagacccgccagagacagaggccccgagagcagacccaccgagctgagcctggaggagctgagcatcagcgccagacagcagcccacccccctgacccccgcccagcccgcccccgcccccgcccccgccaccaccaccggcaccagagccggcggccaccccgaggagcccctgagcagactgagcagaaagagaaagctgctggaggacaccgagagcggcaagaccctgctgctggacgcctacagagtgtggcagcagggccagaagggcgtggcctacgacctgggcagagtggagagaatcatgagcgagacctacatgctgatcaagcaggtggacgaggaggccgccctggagcaggccgtgaagttctgccaggtgcacctgggcgccgccgcccagagacaggccagcggcgacacccccaccacccccaagcaccccaaggacagcagagagaacttcttccccgtgaccgtggtgcccaccgcccccgaccccgtgcccgccgacagcgtgcagagacccagcgacgcccacaccaagcccagacccgccctggccgccgccaccaccatcatcacctgcccccccagcgccagcgccagcaccctggaccagagcaaggaccccggcccccccagaccccacagacccgaggccacccccagcatggccagcctgggccccgagggcgaggagctggccagagtggccgagggcaccagcttccccccccaggagcccagacacagcccccaggtgaagatggcccccaccagcagccccgccgagccccactgctggcccgccgaggccgccctgggcaccggcgccgagcccacctgcagccaggagggcaagctgagacccgagcccagaagagacggcgaggcccaggaggccgccagcgagacccagcccctgagcagcccccccaccgccgccagcagcaaggcccccagcagcggcagcgcccagccccccgagggccaccccggcaagcccgagcccagcagagccaagagcagacccctgcccaacatgcccaagctggtgatccccagcgccgccaccaagttcccccccgagatcaccgtgaccccccccacccccaccctgctgagccccaagggcagcatcagcgaggagaccaagcagaagctgaagagcgccatcctgagcgcccagagcgccgccaacgtgagaaaggagagcctgtgccagcccgccctggaggtgctggagaccagcagccaggagagcagcctggagagcgagaccgacgaggacgacgactacatggacatctag

SEQ ID NO: 74910 - DNA, 6663 bp, Artificial Sequence; identical to SEQ ID NO: 74909
  Description of Artificial Sequence: Synthetic coding sequence

SEQ ID NO: 74911 - DNA, 1770 bp, Artificial Sequence
  Description of Artificial Sequence: Synthetic coding sequence
atgcccagaagaagcagaagaggcatctggagaatccccgtggacgagatcgacagacccggcagcttcgcctggcacatgaacagaagcatcgtgctgctgctgaaggtgctggcccagctgagagaccacagcaccctgctgaaggtgagcagcatgctgcagagaacccccgaccagggcaagaagtacctgagagacgccgacagacaggtgctggcccagagagccttcatcctgaccgtgaaggtgctggaggacaccctgagcgagctggccgagggcagcgagagacccggccccaaggtgtgcggcctgcccggcgccagaatgaccaccgacgtgagccacaaggccagccccgaggacggccaggagggcctgccccagcccaagaagccccccctggccgacggcagcggccccggccccgagcccggcggcaaggtgggcctgctgaaccacagacccgtggccatggacgccggcgacagcgccgaccagagcggcgagagaaaggacaaggagagccccagagccggccccaccgagcccatggacaccagcgaggccaccgtgtgccacagcgacctggagagaaccccccccctgctgcccggcagacccgccagagacagaggccccgagagcagacccaccgagctgagcctggaggagctgagcatcagcgccagacagcagcccacccccctgacccccgcccagcccgcccccgcccccgcccccgccaccaccaccggcaccagagccggcggccaccccgaggagcccctgagcagactgagcagaaagagaaagctgctggaggacaccgagagcggcaagaccctgctgctggacgcctacagagtgtggcagcagggccagaagggcgtggcctacgacctgggcagagtggagagaatcatgagcgagacctacatgctgatcaagcaggtggacgaggaggccgccctggagcaggccgtgaagttctgccaggtgcacctgggcctgccccccagagacagacccagagacacccccaccacccccaagcaccccaaggacagcagagagaacttcttccccgtgaccgtggtgcccaccgcccccgaccccgtgcccgccgacagcgtgcagagacccagcgacgcccacaccaagcccagacccgccctggccgccgccaccaccatcatcacctgcccccccagcgccagcgccagcaccctggaccagagcaaggaccccggcccccccagaccccacagacccgaggccacccccagcatggccagcctgggccccgagggcaagctgagacccgagcccagaagagacggcgaggcccaggaggccgccagcgagacccagcccctgagcagcccccccaccgccgccagcagcaaggcccccagcagcggcagcgcccagccccccgagggccaccccggcaagcccgagcccagcagagccaagagcagacccctgcccaacatgcccaagctggtgatccccagcgccgccaccaagttcccccccgagatcaccgtgaccccccccacccccaccctgctgagccccaagggcagcatcagcgaggagaccaagcagaagctgaagagcgccatcctgagcgcccagagcgccgccaacgtgagaaaggagagcctgtgccagcccgccctggaggtgctggagaccagcagccaggagagcagcctggagagcgagaccgacgaggacgacgactacatggacatctag

SEQ ID NO: 74912 - DNA, 1224 bp, Artificial Sequence
  Description of Artificial Sequence: Synthetic coding sequence
atgatcagaatcgccgccctgaacgccagcagcaccatcgaggacgaccacgagggcagcttcaagagccacaagacccagaccaaggaggcccaggaggccgaggccttcgccctgtaccacaaggccctggacctgcagaagcacgacagattcgaggagagcgccaaggcctaccacgagctgctggaggccagcctgctgagagaggccgtgagcagcggcgacgagaaggagggcctgaagcaccccggcctgatcctgaagtacagcacctacaagaacctggcccagctggccgcccagagagaggacctggagaccgccatggagttctacctggaggccgtgatgctggacagcaccgacgtgaacctgtggtacaagatcggccacgtggccctgagactgatcagaatccccctggccagacacgccttcgaggagggcctgagatgcaaccccgaccactggccctgcctggacaacctgatcaccgtgctgtacaccctgagcgactacaccacctgcctgtacttcatctgcaaggccctggagaaggactgcagatacagcaagggcctggtgctgaaggagaagatcttcgaggagcagccctgcctgagaaaggacagcctgagaatgttcctgaagtgcgacatgagcatccacgacgtgagcgtgagcgccgccgagacccaggccatcgtggacgaggccctgggcctgagaaagaagagacaggccctgatcgtgagagagaaggagcccgacctgaagctggtgcagcccatccccttcttcacctggaagtgcctgggcgagagcctgctggccatgtacaaccacctgaccacctgcgagccccccagacccagcctgggcaagagaatcgacctgagcgactaccaggaccccagccagcccctggagagcagcatggtggtgacccccgtgaacgtgatccagcccagcaccgtgagcaccaaccccgccgtggccgtggccgagcccgtggtgagctacaccagcgtggccaccaccagcttccccctgcacagccccggcctgctggagaccggcgcccccgtgggcgacatcagcggcggcgacaagagcaagaagggcgtgaagagaaagaagatcagcgaggagagcggcgagaccgccaagagaagaagcgccagagtgagaaacaccaagtgcaagaaggaggagaagtag

SEQ ID NO: 74913 - DNA, 1527 bp, Artificial Sequence
  Description of Artificial Sequence: Synthetic coding sequence
atgcagttcagcggcgagaagatcagcggccagagagacctgcagaagagcaagatgagattcaccttcaccagcagatgcctggccctgttcctgctgctgaaccaccccacccccatcctgcccgccttcagcaaccagacctaccccaccatcgagcccaagcccttcctgtacgtggtgggcagaaagaagatgatggacgcccagtacaagtgctacgacagaatgcagcagctgcccgcctaccagggcgagggcccctactgcaacagaacctgggacggctggctgtgctgggacgacacccccgccggcgtgctgagctaccagttctgccccgactacttccccgacttcgaccccagcgagaaggtgaccaagtactgcgacgagaagggcgtgtggttcaagcaccccgagaacaacagaacctggagcaactacaccatgtgcaacgccttcacccccgagaagctgaagaacgcctacgtgctgtactacctggccatcgtgggccacagcctgagcatcttcaccctggtgatcagcctgggcatcttcgtgttcttcagaaagctgaccaccatcttccccctgaactggaagtacagaaaggccctgagcctgggctgccagagagtgaccctgcacaagaacatgttcctgacctacatcctgaacagcatgatcatcatcatccacctggtggaggtggtgcccaacggcgagctggtgagaagagaccccgtgagctgcaagatcctgcacttcttccaccagtacatgatggcctgcaactacttctggatgctgtgcgagggcatctacctgcacaccctgatcgtggtggccgtgttcaccgagaagcagagactgagatggtactacctgctgggctggggcttccccctggtgcccaccaccatccacgccatcaccagagccgtgtacttcaacgacaactgctggctgagcgtggagacccacctgctgtacatcatccacggccccgtgatggccgccctggtggtgaacttcttcttcctgctgaacatcgtgagagtgctggtgaccaagatgagagagacccacgaggccgagagccacatgtacctgaaggccgtgaaggccaccatgatcctggtgcccctgctgggcatccagttcgtggtgttcccctggagacccagcaacaagatgctgggcaagatctacgactacgtgatgcacagcctgatccacttccagggcttcttcgtggccaccatctactgcttctgcaacaacgaggtgcagaccaccgtgaagagacagtgggcccagttcaagatccagtggaaccagagatggggcagaagacccagcaacagaagcgccagagccgccgccgccgccgccgaggccggcgacatccccatctacatctgccaccaggagctgagaaacgagcccgccaacaaccagggcgaggagagcgccgagatcatccccctgaacatcatcgagcaggagagcagcgcctag

SEQ ID NO: 74914 - DNA, 1473 bp, Artificial Sequence
  Description of Artificial Sequence: Synthetic coding sequence
atgagattcaccttcaccagcagatgcctggccctgttcctgctgctgaaccaccccacccccatcctgcccgccttcagcaaccagacctaccccaccatcgagcccaagcccttcctgtacgtggtgggcagaaagaagatgatggacgcccagtacaagtgctacgacagaatgcagcagctgcccgcctaccagggcgagggcccctactgcaacagaacctgggacggctggctgtgctgggacgacacccccgccggcgtgctgagctaccagttctgccccgactacttccccgacttcgaccccagcgagaaggtgaccaagtactgcgacgagaagggcgtgtggttcaagcaccccgagaacaacagaacctggagcaactacaccatgtgcaacgccttcacccccgagaagctgaagaacgcctacgtgctgtactacctggccatcgtgggccacagcctgagcatcttcaccctggtgatcagcctgggcatcttcgtgttcttcagaaagctgaccaccatcttccccctgaactggaagtacagaaaggccctgagcctgggctgccagagagtgaccctgcacaagaacatgttcctgacctacatcctgaacagcatgatcatcatcatccacctggtggaggtggtgcccaacggcgagctggtgagaagagaccccgtgagctgcaagatcctgcacttcttccaccagtacatgatggcctgcaactacttctggatgctgtgcgagggcatctacctgcacaccctgatcgtggtggccgtgttcaccgagaagcagagactgagatggtactacctgctgggctggggcttccccctggtgcccaccaccatccacgccatcaccagagccgtgtacttcaacgacaactgctggctgagcgtggagacccacctgctgtacatcatccacggccccgtgatggccgccctggtggtgaacttcttcttcctgctgaacatcgtgagagtgctggtgaccaagatgagagagacccacgaggccgagagccacatgtacctgaaggccgtgaaggccaccatgatcctggtgcccctgctgggcatccagttcgtggtgttcccctggagacccagcaacaagatgctgggcaagatctacgactacgtgatgcacagcctgatccacttccagggcttcttcgtggccaccatctactgcttctgcaacaacgaggtgcagaccaccgtgaagagacagtgggcccagttcaagatccagtggaaccagagatggggcagaagacccagcaacagaagcgccagagccgccgccgccgccgccgaggccggcgacatccccatctacatctgccaccaggagctgagaaacgagcccgccaacaaccagggcgaggagagcgccgagatcatccccctgaacatcatcgagcaggagagcagcgcctag

SEQ ID NO: 74915 - DNA, 1425 bp, Artificial Sequence
  Description of Artificial Sequence: Synthetic coding sequence
atgagattcaccttcaccagcagatgcctggccctgttcctgctgctgaaccaccccacccccatcctgcccgccttcagcaaccagacctaccccaccatcgagcccaagcccttcctgtacgtggtgggcagaaagaagatgatggacgcccagtacaagtgctacgacagaatgcagcagctgcccgcctaccagggcgagggcccctactgcaacagaacctgggacggctggctgtgctgggacgacacccccgccggcgtgctgagctaccagttctgccccgactacttccccgacttcgaccccagcgagaaggtgaccaagtactgcgacgagaagggcgtgtggttcaagcaccccgagaacaacagaacctggagcaactacaccatgtgcaacgccttcacccccgagaagctgaagaacgcctacgtgctgtactacctggccatcgtgggccacagcctgagcatcttcaccctggtgatcagcctgggcatcttcgtgttcttcagaagcctgggctgccagagagtgaccctgcacaagaacatgttcctgacctacatcctgaacagcatgatcatcatcatccacctggtggaggtggtgcccaacggcgagctggtgagaagagaccccgtgagctgcaagatcctgcacttcttccaccagtacatgatggcctgcaactacttctggatgctgtgcgagggcatctacctgcacaccctgatcgtggtggccgtgttcaccgagaagcagagactgagatggtactacctgctgggctggggcttccccctggtgcccaccaccatccacgccatcaccagagccgtgtacttcaacgacaactgctggctgagcgtggagacccacctgctgtacatcatccacggccccgtgatggccgccctggtggtgaacttcttcttcctgctgaacatcgtgagagtgctggtgaccaagatgagagagacccacgaggccgagagccacatgtacctgaaggccgtgaaggccaccatgatcctggtgcccctgctgggcatccagttcgtggtgttcccctggagacccagcaacaagatgctgggcaagatctacgactacgtgatgcacagcctgatccacttccagggcttcttcgtggccaccatctactgcttctgcaacaacgaggtgcagaccaccgtgaagagacagtgggcccagttcaagatccagtggaaccagagatggggcagaagacccagcaacagaagcgccagagccgccgccgccgccgccgaggccggcgacatccccatctacatctgccaccaggagctgagaaacgagcccgccaacaaccagggcgaggagagcgccgagatcatccccctgaacatcatcgagcaggagagcagcgcctag

SEQ ID NO: 74916 - DNA, 825 bp, Artificial Sequence
  Description of Artificial Sequence: Synthetic coding sequence
atgagattcaccttcaccagcagatgcctggccctgttcctgctgctgaaccaccccacccccatcctgcccgccttcagcaaccagacctaccccaccatcgagcccaagcccttcctgtacgtggtgggcagaaagaagatgatggacgcccagtacaagtgctacgacagaatgcagcagctgcccgcctaccagggcgagggcccctactgcaacagaacctgggacggctggctgtgctgggacgacacccccgccggcgtgctgagctaccagttctgccccgactacttccccgacttcgaccccagcgagaaggtgaccaagtactgcgacgagaagggcgtgtggttcaagcaccccgagaacaacagaacctggagcaactacaccatgtgcaacgccttcacccccgagaagctgaagaacgcctacgtgctgtactacctggccatcgtgggccacagcctgagcatcttcaccctggtgatcagcctgggcatcttcgtgttcttcagaagcctgggctgccagagagtgaccctgcacaagaacatgttcctgacctacatcctgaacagcatgatcatcatcatccacctggtggaggtggtgcccaacggcgagctggtgagaagagaccccgtgagctgcaagatcctgcacttcttccaccagtacatgatggcctgcaactacttctggatgctgtgcgagggcatctacctgcacaccctgatcgtggtggccgtgttcaccgagaagcagagactgagatggtactacctgctgggctgggcccccgccttccacagagactag

SEQ ID NO: 74917 - DNA, 1473 bp, Artificial Sequence; identical to SEQ ID NO: 74914
  Description of Artificial Sequence: Synthetic coding sequence

SEQ ID NO: 74918 - DNA, 873 bp, Artificial Sequence
  Description of Artificial Sequence: Synthetic coding sequence
atgagattcaccttcaccagcagatgcctggccctgttcctgctgctgaaccaccccacccccatcctgcccgccttcagcaaccagacctaccccaccatcgagcccaagcccttcctgtacgtggtgggcagaaagaagatgatggacgcccagtacaagtgctacgacagaatgcagcagctgcccgcctaccagggcgagggcccctactgcaacagaacctgggacggctggctgtgctgggacgacacccccgccggcgtgctgagctaccagttctgccccgactacttccccgacttcgaccccagcgagaaggtgaccaagtactgcgacgagaagggcgtgtggttcaagcaccccgagaacaacagaacctggagcaactacaccatgtgcaacgccttcacccccgagaagctgaagaacgcctacgtgctgtactacctggccatcgtgggccacagcctgagcatcttcaccctggtgatcagcctgggcatcttcgtgttcttcagaaagctgaccaccatcttccccctgaactggaagtacagaaaggccctgagcctgggctgccagagagtgaccctgcacaagaacatgttcctgacctacatcctgaacagcatgatcatcatcatccacctggtggaggtggtgcccaacggcgagctggtgagaagagaccccgtgagctgcaagatcctgcacttcttccaccagtacatgatggcctgcaactacttctggatgctgtgcgagggcatctacctgcacaccctgatcgtggtggccgtgttcaccgagaagcagagactgagatggtactacctgctgggctgggcccccgccttccacagagactag

SEQ ID NO: 74919 - DNA, 1425 bp, Artificial Sequence; identical to SEQ ID NO: 74915
  Description of Artificial Sequence: Synthetic coding sequence

SEQ ID NO: 74920 - DNA, 489 bp, Artificial Sequence
  Description of Artificial Sequence: Synthetic coding sequence
atgagattcaccttcaccagcagatgcctggccctgttcctgctgctgaaccaccccacccccatcctgcccgccttcagcaaccagacctaccccaccatcgagcccaagcccttcctgtacgtggtgggcagaaagaagatgatggacgcccagtacaagtgctacgacagaatgcagcagctgcccgcctaccagggcgagggcccctactgcaacagaacctgggacggctggctgtgctgggacgacacccccgccggcgtgctgagctaccagttctgccccgactacttccccgacttcgaccccagcgagaaggtgaccaagtactgcgacgagaagggcgtgtggttcaagcaccccgagaacaacagaacctggagcaactacaccatgtgcaacgccttcacccccgagaagctgaagaacgcctacgtgctgtactacctggccatcgtgggccacagctgccagttcagcccctag

SEQ ID NO: 74921 - DNA, 1386 bp, Artificial Sequence
  Description of Artificial Sequence: Synthetic coding sequence
atggagaagaagtgcaccctgaacttcctggtgctgctgcccttcttcatgatcctggtgaccgccgagctggaggagagccccgaggacagcatccagctgggcgtgaccagaaacaagatcatgaccgcccagtacgagtgctaccagaagatcatgcaggaccccatccagcaggccgagggcgtgtactgcaacagaacctgggacggctggctgtgctggaacgacgtggccgccggcaccgagagcatgcagctgtgccccgactacttccaggacttcgaccccagcgagaaggtgaccaagatctgcgaccaggacggcaactggttcagacaccccgccagcaacagaacctggaccaactacacccagtgcaacgtgaacacccacgagaaggtgaagaccgccctgaacctgttctacctgaccatcatcggccacggcctgagcatcgccagcctgctgatcagcctgggcatcttcttctacttcaagagcctgagctgccagagaatcaccctgcacaagaacctgttcttcagcttcgtgtgcaacagcgtggtgaccatcatccacctgaccgccgtggccaacaaccaggccctggtggccaccaaccccgtgagctgcaaggtgagccagttcatccacctgtacctgatgggctgcaactacttctggatgctgtgcgagggcatctacctgcacaccctgatcgtggtggccgtgttcgccgagaagcagcacctgatgtggtactacttcctgggctggggcttccccctgatccccgcctgcatccacgccatcgccagaagcctgtactacaacgacaactgctggatcagcagcgacacccacctgctgtacatcatccacggccccatctgcgccgccctgctggtgaacctgttcttcctgctgaacatcgtgagagtgctgatcaccaagctgaaggtgacccaccaggccgagagcaacctgtacatgaaggccgtgagagccaccctgatcctggtgcccctgctgggcatcgagttcgtgctgatcccctggagacccgagggcaagatcgccgaggaggtgtacgactacatcatgcacatcctgatgcacttccagggcctgctggtgagcaccatcttctgcttcttcaacggcgaggtgcaggccatcctgagaagaaactggaaccagtacaagatccagttcggcaacagcttcagcaacagcgaggccctgagaagcgccagctacaccgtgagcaccatcagcgacggccccggctacagccacgactgccccagcgagcacctgaacggcaagagcatccacgacatcgagaacgtgctgctgaagcccgagaacctgtacaactag

SEQ ID NO: 74922 - DNA, 1386 bp, Artificial Sequence; identical to SEQ ID NO: 74921
  Description of Artificial Sequence: Synthetic coding sequence

SEQ ID NO: 74923 - DNA, 1386 bp, Artificial Sequence; identical to SEQ ID NO: 74921
  Description of Artificial Sequence: Synthetic coding sequence

SEQ ID NO: 74924 - DNA, 114 bp, Artificial Sequence
  Description of Artificial Sequence: Synthetic coding sequence
atggagaagaagtgcaccctgaacttcctggtgctgctgcccttcttcatgatcctggtgaccgccgagctggaggagagccccgaggacagcatccagctgggcgtgacctag

SEQ ID NO: 74925 - DNA, 237 bp, Artificial Sequence
  Description of Artificial Sequence: Synthetic coding sequence
atggagaagaagtgcaccctgaacttcctggtgctgctgcccttcttcatgatcctggtgaccgccgagctggaggagagccccgaggacagcatccagctgggcgtgaccagaaacaagatcatgaccgcccagtacgagtgctaccagaagatcatgcaggaccccatccagcaggccgagggcgtgtactgcaacagaacctgggacggctggctgtgctggaacgacgtgtag

SEQ ID NO: 74926 - DNA, 426 bp, Artificial Sequence
  Description of Artificial Sequence: Synthetic coding sequence
atgggcttccagaagttcagccccttcctggccctgagcatcctggtgctgctgcaggccggcagcctgcacgccgcccccttcagaagcgccctggagagcagccccgccgaccccgccaccctgagcgaggacgaggccagactgctgctggccgccctggtgcagaactacgtgcagatgaaggccagcgagctggagcaggagcaggagagagagggcagcagcctggacagccccagaagcaagagatgcggcaacctgagcacctgcatgctgggcacctacacccaggacttcaacaagttccacaccttcccccagaccgccatcggcgtgggcgcccccggcaagaagagagacatgagcagcgacctggagagagaccacagaccccacgtgagcatgccccagaacgccaactag

SEQ ID NO: 74927 - DNA, 426 bp, Artificial Sequence
  Description of Artificial Sequence: Synthetic coding sequence
atgggcttccagaagttcagccccttcctggccctgagcatcctggtgctgctgcaggccggcagcctgcacgccgcccccttcagaagcgccctggagagcagccccgccgaccccgccaccctgagcgaggacgaggccagactgctgctggccgccctggtgcagaactacgtgcagatgaaggccagcgagctggagcaggagcaggagagagagggcagcagcctggacagccccagaagcaagagatgcggcaacctgagcacctgcatgctgggcacctacacccaggacttcaacaagttccacaccttcccccagaccgccatcggcgtgggcgcccccggcaagaagagagacatgagcagcgacctggagagagaccacagaccccacaaccactgccccgaggagagcctgtag

SEQ ID NO: 74928 - DNA, 387 bp, Artificial Sequence
  Description of Artificial Sequence: Synthetic coding sequence
atgggcttccagaagttcagccccttcctggccctgagcatcctggtgctgctgcaggccggcagcctgcacgccgcccccttcagaagcgccctggagagcagccccgccgaccccgccaccctgagcgaggacgaggccagactgctgctggccgccctggtgcagaactacgtgcagatgaaggccagcgagctggagcaggagcaggagagagagggcagcagaatcatcgcccagaagagagcctgcgacaccgccacctgcgtgacccacagactggccggcctgctgagcagaagcggcggcgtggtgaagaacaacttcgtgcccaccaacgtgggcagcaaggccttcggcagaagaagaagagacctgcaggcctag

SEQ ID NO: 74929 - DNA, 426 bp, Artificial Sequence; identical to SEQ ID NO: 74926
  Description of Artificial Sequence: Synthetic coding sequence

SEQ ID NO: 74930 - DNA, 387 bp, Artificial Sequence; identical to SEQ ID NO: 74928
  Description of Artificial Sequence: Synthetic coding sequence

SEQ ID NO: 74931 - DNA, 384 bp, Artificial Sequence
  Description of Artificial Sequence: Synthetic coding sequence
atgggcttcagaaagttcagccccttcctggccctgagcatcctggtgctgtaccaggccggcagcctgcaggccgcccccttcagaagcgccctggagagcagccccgaccccgccaccctgagcaaggaggacgccagactgctgctggccgccctggtgcaggactacgtgcagatgaaggccagcgagctgaagcaggagcaggagacccagggcagcagcagcgccgcccagaagagagcctgcaacaccgccacctgcgtgacccacagactggccggcctgctgagcagaagcggcggcatggtgaagagcaacttcgtgcccaccaacgtgggcagcaaggccttcggcagaagaagaagagacctgcaggcctag

SEQ ID NO: 74932 - DNA, 417 bp, Artificial Sequence
  Description of Artificial Sequence: Synthetic coding sequence
atgaagaaggaggccaacctgcagagaggcggcatgggcttcagaaagttcagccccttcctggccctgagcatcctggtgctgtaccaggccggcagcctgcaggccgcccccttcagaagcgccctggagagcagccccgaccccgccaccctgagcaaggaggacgccagactgctgctggccgccctggtgcaggactacgtgcagatgaaggccagcgagctgaagcaggagcaggagacccagggcagcagcagcgccgcccagaagagagcctgcaacaccgccacctgcgtgacccacagactggccggcctgctgagcagaagcggcggcatggtgaagagcaacttcgtgcccaccaacgtgggcagcaaggccttcggcagaagaagaagagacctgcaggcctag

SEQ ID NO: 74933 - DNA, 384 bp, Artificial Sequence; identical to SEQ ID NO: 74931
  Description of Artificial Sequence: Synthetic coding sequence

SEQ ID NO: 74934 - DNA, 1206 bp, Artificial Sequence
  Description of Artificial Sequence: Synthetic coding sequence
atgcccgtgcagctgagcgagcaccccgagtggaacgagagcatgcacagcctgagaatcagcgtgggcggcctgcccgtgctggccagcatgaccaaggccgccgaccccagattcagacccagatggaaggtgatcctgaccttcttcgtgggcgccgccatcctgtggctgctgtgcagccacagacccgcccccggcagaccccccacccacaacgcccacaactggagactgggccaggcccccgccaactggtacaacgacacctaccccctgagccccccccagagaacccccgccggcatcagatacagaatcgccgtgatcgccgacctggacaccgagagcagagcccaggaggagaacacctggttcagctacctgaagaagggctacctgaccctgagcgacagcggcgacaaggtggccgtggagtgggacaaggaccacggcgtgctggagagccacctggccgagaagggcagaggcatggagctgagcgacctgatcgtgttcaacggcaagctgtacagcgtggacgacagaaccggcgtggtgtaccagatcgagggcagcaaggccgtgccctgggtgatcctgagcgacggcgacggcaccgtggagaagggcttcaaggccgagtggctggccgtgaaggacgagagactgtacgtgggcggcctgggcaaggagtggaccaccaccaccggcgacgtggtgaacgagaaccccgagtgggtgaaggtggtgggctacaagggcagcgtggaccacgagaactgggtgagcaactacaacgccctgagagccgccgccggcatccagccccccggctacctgatccacgagagcgcctgctggagcgacaccctgcagagatggttcttcctgcccagaagagccagccaggagagatacagcgagaaggacgacgagagaaagggcgccaacctgctgctgagcgccagccccgacttcggcgacatcgccgtgagccacgtgggcgccgtggtgcccacccacggcttcagcagcttcaagttcatccccaacaccgacgaccagatcatcgtggccctgaagagcgaggaggacagcggcagagtggccagctacatcatggccttcaccctggacggcagattcctgctgcccgagaccaagatcggcagcgtgaagtacgagggcatcgagttcatctag

SEQ ID NO: 74935 - DNA, 1053 bp, Artificial Sequence
  Description of Artificial Sequence: Synthetic coding sequence
atgcccgtgcagctgagcgagcaccccgagtggaacgagagcatgcacagcctgagaatcagcgtgggcggcctgcccgtgctggccagcatgaccaaggccgccgaccccagattcagacccagaagccccccccagagaacccccgccggcatcagatacagaatcgccgtgatcgccgacctggacaccgagagcagagcccaggaggagaacacctggttcagctacctgaagaagggctacctgaccctgagcgacagcggcgacaaggtggccgtggagtgggacaaggaccacggcgtgctggagagccacctggccgagaagggcagaggcatggagctgagcgacctgatcgtgttcaacggcaagctgtacagcgtggacgacagaaccggcgtggtgtaccagatcgagggcagcaaggccgtgccctgggtgatcctgagcgacggcgacggcaccgtggagaagggcttcaaggccgagtggctggccgtgaaggacgagagactgtacgtgggcggcctgggcaaggagtggaccaccaccaccggcgacgtggtgaacgagaaccccgagtgggtgaaggtggtgggctacaagggcagcgtggaccacgagaactgggtgagcaactacaacgccctgagagccgccgccggcatccagccccccggctacctgatccacgagagcgcctgctggagcgacaccctgcagagatggttcttcctgcccagaagagccagccaggagagatacagcgagaaggacgacgagagaaagggcgccaacctgctgctgagcgccagccccgacttcggcgacatcgccgtgagccacgtgggcgccgtggtgcccacccacggcttcagcagcttcaagttcatccccaacaccgacgaccagatcatcgtggccctgaagagcgaggaggacagcggcagagtggccagctacatcatggccttcaccctggacggcagattcctgctgcccgagaccaagatcggcagcgtgaagtacgagggcatcgagttcatctag

SEQ ID NO: 74936 - DNA, 1206 bp, Artificial Sequence; identical to SEQ ID NO: 74934
  Description of Artificial Sequence: Synthetic coding sequence

SEQ ID NO: 74937 - DNA, 738 bp, Artificial Sequence
  Description of Artificial Sequence: Synthetic coding sequence
atgcccgtgcagctgagcgagcaccccgagtggaacgagagcatgcacagcctgagaatcagcgtgggcggcctgcccgtgctggccagcatgaccaaggccgccgaccccagattcagacccagatggaaggtgatcctgaccttcttcgtgggcgccgccatcctgtggctgctgtgcagccacagacccgcccccggcagaccccccacccacaacgcccacaactggagactgggccaggcccccgccaactggtacaacgacacctaccccctgagccccccccagagaacccccgccggcatcagatacagaatcgccgtgatcgccgacctggacaccgagagcagagcccaggaggagaacacctggttcagctacctgaagaagggctacctgaccctgagcgacagcggcgacaaggtggccgtggagtgggacaaggaccacggcgtgctggagagccacctggccgagaagggcagaggcatggagctgagcgacctgatcgtgttcaacggcaagctgtacagcgtggacgacagaaccggcgtggtgtaccagatcgagggcagcaaggccgtgccctgggtgatcctgagcgacggcgacggcaccgtggagaagggcgtgggcggcgagtgggaggccgtgagagagatcgtgagaaagagatggagactggtgaagcaggtgagccacgtgggcgtgctgggccagtggatccagagatag

SEQ ID NO: 74938 - DNA, 663 bp, Artificial Sequence
  Description of Artificial Sequence: Synthetic coding sequence
atgggcaactgcgccaagagaccctggagaagaggccccaaggaccccctgcagtggctgggcagcccccccagaggcagctgccccagccccagcagcagccccaaggagcagggcgaccccgcccccggcgtgcagggctacagcgtgctgaacagcctggtgggccccgcctgcatcttcctgagacccagcatcgccgccacccagctggacagagagctgagacccgaggagatcgaggagctgcaggtggccttccaggagttcgacagagacagagacggctacatcggctgcagagagctgggcgcctgcatgagaaccctgggctacatgcccaccgagatggagctgatcgagatcagccagcagatcagcggcggcaaggtggacttcgaggacttcgtggagctgatgggccccaagctgctggccgagaccgccgacatgatcggcgtgagagagctgagagacgccttcagagagttcgacaccaacggcgacggcagaatcagcgtgggcgagctgagagccgccctgaaggccctgctgggcgagagactgagccagagagaggtggacgagatcctgcaggacgtggacctgaacggcgacggcctggtggacttcgaggagttcgtgagaatgatgagcagatag

SEQ ID NO: 74939 - DNA, 1026 bp, Artificial Sequence
  Description of Artificial Sequence: Synthetic coding sequence
atgcccttccccttcggcaagagccacaagagccccgccgacatcgtgaagaacctgaaggagagcatggccgtgctggagaagcaggacatcagcgacaagaaggccgagaaggccaccgaggaggtgagcaagaacctggtggccatgaaggagatcctgtacggcaccaacgagaaggagccccagaccgaggccgtggcccagctggcccaggagctgtacaacagcggcctgctgagcaccctggtggccgacctgcagctgatcgacttcgagggcaagaaggacgtggcccagatcttcaacaacatcctgagaagacagatcggcaccagaacccccaccgtggagtacatctgcacccagcagaacatcctgttcatgctgctgaagggctacgagagccccgagatcgccctgaactgcggcatcatgctgagagagtgcatcagacacgagcccctggccaagatcatcctgtggagcgagcagttctacgacttcttcagatacgtggagatgagcaccttcgacatcgccagcgacgccttcgccaccttcaaggacctgctgaccagacacaagctgctgagcgccgagttcctggagcagcactacgacagattcttcagcgagtacgagaagctgctgcacagcgagaactacgtgaccaagagacagagcctgaagctgctgggcgagctgctgctggacagacacaacttcaccatcatgaccaagtacatcagcaagcccgagaacctgaagctgatgatgaacctgctgagagacaagagcagaaacatccagttcgaggccttccacgtgttcaaggtgttcgtggccaaccccaacaagacccagcccatcctggacatcctgctgaagaaccaggccaagctgatcgagttcctgagcaagttccagaacgacagaaccgaggacgagcagttcaacgacgagaagacctacctggtgaagcagatcagagacctgaagagacccgcccagcaggaggcctag

SEQ ID NO: 74940 - DNA, 1026 bp, Artificial Sequence; identical to SEQ ID NO: 74939
  Description of Artificial Sequence: Synthetic coding sequence

SEQ ID NO: 74941 - DNA, 1026 bp, Artificial Sequence; identical to SEQ ID NO: 74939
  Description of Artificial Sequence: Synthetic coding sequence

SEQ ID NO: 74942 - DNA, 1014 bp, Artificial Sequence
  Description of Artificial Sequence: Synthetic coding sequence
atgaagaagatgcccctgttcagcaagagccacaagaaccccgccgagatcgtgaagatcctgaaggacaacctggccatcctggagaagcaggacaagaagaccgacaaggccagcgaggaggtgagcaagagcctgcaggccatgaaggagatcctgtgcggcaccaacgagaaggagccccccaccgaggccgtggcccagctggcccaggagctgtacagcagcggcctgctggtgaccctgatcgccgacctgcagctgatcgacttcgagggcaagaaggacgtgacccagatcttcaacaacatcctgagaagacagatcggcaccagaagccccaccgtggagtacatcagcgcccacccccacatcctgttcatgctgctgaagggctacgaggccccccagatcgccctgagatgcggcatcatgctgagagagtgcatcagacacgagcccctggccaagatcatcctgttcagcaaccagttcagagacttcttcaagtacgtggagctgagcaccttcgacatcgccagcgacgccttcgccaccttcaaggacctgctgaccagacacaaggtgctggtggccgacttcctggagcagaactacgacaccatcttcgaggactacgagaagctgctgcagagcgagaactacgtgaccaagagacagagcctgaagctgctgggcgagctgatcctggacagacacaacttcgccatcatgaccaagtacatcagcaagcccgagaacctgaagctgatgatgaacctgctgagagacaagagccccaacatccagttcgaggccttccacgtgttcaaggtgttcgtggccagcccccacaagacccagcccatcgtggagatcctgctgaagaaccagcccaagctgatcgagttcctgagcagcttccagaaggagagaaccgacgacgagcagttcgccgacgagaagaactacctgatcaagcagatcagagacctgaagaagaccgccccctag

SEQ ID NO: 74943 - DNA, 1014 bp, Artificial Sequence; identical to SEQ ID NO: 74942
  Description of Artificial Sequence: Synthetic coding sequence

SEQ ID NO: 74944 - DNA, 945 bp, Artificial Sequence
  Description of Artificial Sequence: Synthetic coding sequence
atgcccctgttcagcaagagccacaagaaccccgccgagatcgtgaagatcctgaaggacaacctggccatcctggagaagcaggacaagaagaccgacaaggccagcgaggaggtgagcaagagcctgcaggccatgaaggagatcctgtgcggcaccaacgagaaggagccccccaccgaggccgtggcccagctggcccaggagctgtacagcagcggcctgctggtgaccctgatcgccgacctgcagctgatcgacttcgagggcaagaaggacgtgacccagatcttcaacaacatcctgagaagacagatcggcaccagaagccccaccgtggagtacatcagcgcccacccccacatcctgttcatgctgctgaagggctacgaggccccccagatcgccctgagatgcggcatcatgctgagagagtgcatcagacacgagcccctggccaagatcatcctgttcagcaaccagttcagagacttcttcaagtacgtggagctgagcaccttcgacatcgccagcgacgccttcgccaccttcaagatcttcgaggactacgagaagctgctgcagagcgagaactacgtgaccaagagacagagcctgaagctgctgggcgagctgatcctggacagacacaacttcgccatcatgaccaagtacatcagcaagcccgagaacctgaagctgatgatgaacctgctgagagacaagagccccaacatccagttcgaggccttccacgtgttcaaggtgttcgtggccagcccccacaagacccagcccatcgtggagatcctgctgaagaaccagcccaagctgatcgagttcctgagcagcttccagaaggagagaaccgacgacgagcagttcgccgacgagaagaactacctgatcaagcagatcagagacctgaagaagaccgccccctag

SEQ ID NO: 74945 - DNA, 282 bp, Artificial Sequence
  Description of Artificial Sequence: Synthetic coding sequence
atgaagaagatgcccctgttcagcaagagccacaagaaccccgccgagatcgtgaagatcctgaaggacaacctggccatcctggagaagcaggacaagaagaccgacaaggccagcgaggaggtgagcaagagcctgcaggccatgaaggagatcctgtgcggcaccaacgagaaggagccccccaccgaggccgtggcccagctggcccaggagctgtacagcagcggcctgctggtgaccctgatcgccgacctgcagctgatcgacttcgaggtgtag

SEQ ID NO: 74946 - DNA, 1014 bp, Artificial Sequence; identical to SEQ ID NO: 74942
  Description of Artificial Sequence: Synthetic coding sequence

SEQ ID NO: 74947 - DNA, 1014 bp, Artificial Sequence; identical to SEQ ID NO: 74942
  Description of Artificial Sequence: Synthetic coding sequence

SEQ ID NO: 74948 - DNA, 387 bp, Artificial Sequence
  Description of Artificial Sequence: Synthetic coding sequence
atgaagaagatgcccctgttcagcaagagccacaagaaccccgccgagatcgtgaagatcctgaaggacaacctggccatcctggagaagcaggacaagaagaccgacaaggccagcgaggaggtgagcaagagcctgcaggccatgaaggagatcctgtgcggcaccaacgagaaggagccccccaccgaggccgtggcccagctggcccaggagctgtacagcagcggcctgctggtgaccctgatcgccgacctgcagctgatcgacttcgagggcaagaaggacgtgacccagatcttcaacaacatcctgagaagacagatcggcaccagaagccccaccgtggagtacatcagcgcccacccccacatcctgttcatgtag

SEQ ID NO: 74949 - DNA, 567 bp, Artificial Sequence
  Description of Artificial Sequence: Synthetic coding sequence
atgaagaagatgcccctgttcagcaagagccacaagaaccccgccgagatcgtgaagatcctgaaggacaacctggccatcctggagaagcaggacaagaagaccgacaaggccagcgaggaggtgagcaagagcctgcaggccatgaaggagatcctgtgcggcaccaacgagaaggagccccccaccgaggccgtggcccagctggcccaggagctgtacagcagcggcctgctggtgaccctgatcgccgacctgcagctgatcgacttcgagggcaagaaggacgtgacccagatcttcaacaacatcctgagaagacagatcggcaccagaagccccaccgtggagtacatcagcgcccacccccacatcctgttcatgctgctgaagggctacgaggccccccagatcgccctgagatgcggcatcatgctgagagagtgcatcagacacgagcccctggccaagatcatcctgttcagcaaccagttcagagacttcttcaagtacgtggagctgagcaccttcgacatcgccagcgacgccttcgccaccttcaagtag

SEQ ID NO: 74950 - DNA, 828 bp, Artificial Sequence
  Description of Artificial Sequence: Synthetic coding sequence
atgaccaccgagcaggccagaggccagcagggccccaacctggccatcggcagacagaagccccccgccggcgtggtgacccccaagagcgacgccgaggagccccccctgaccagaaagagaagcaagaaggagagaggcctgagaggcagcagaaagagaaccggcagcagcggcgagcagaccggccccgaggcccccggcagcagcaacaacccccccagcaccggcgagggccccgccggcgccccccccgccagccccggccccgccagcagcagacagagccacagacacagacccgacagcctgcacgacgccgcccagagaacctacggccccctgctgaacagagtgttcggcaaggacagagagctgggccccgaggagctggacgagctgcaggccgccttcgaggagttcgacaccgacagagacggctacatcagccacagagagctgggcgactgcatgagaaccctgggctacatgcccaccgagatggagctgctggaggtgagccagcacatcaagatgagaatgggcggcagagtggacttcgaggagttcgtggagctgatcggccccaagctgagagaggagaccgcccacatgctgggcgtgagagagctgagaatcgccttcagagagttcgacagagacagagacggcagaatcaccgtggccgagctgagagaggccgtgcccgccctgctgggcgagcccctggccggccccgagctggacgagatgctgagagaggtggacctgaacggcgacggcaccgtggacttcgacgagttcgtgatgatgctgagcagacactag

SEQ ID NO: 74951 - DNA, 513 bp, Artificial Sequence
  Description of Artificial Sequence: Synthetic coding sequence
atgaccgagccctggctggccctgggcaccagctggaccctgcccctgcaggacagagagctgggccccgaggagctggacgagctgcaggccgccttcgaggagttcgacaccgacagagacggctacatcagccacagagagctgggcgactgcatgagaaccctgggctacatgcccaccgagatggagctgctggaggtgagccagcacatcaagatgagaatgggcggcagagtggacttcgaggagttcgtggagctgatcggccccaagctgagagaggagaccgcccacatgctgggcgtgagagagctgagaatcgccttcagagagttcgacagagacagagacggcagaatcaccgtggccgagctgagagaggccgtgcccgccctgctgggcgagcccctggccggccccgagctggacgagatgctgagagaggtggacctgaacggcgacggcaccgtggacttcgacgagttcgtgatgatgctgagcagacactag

SEQ ID NO: 74952 - DNA, 522 bp, Artificial Sequence
  Description of Artificial Sequence: Synthetic coding sequence
atgcagttccccatgggccccgcctgcatcttcctgagaaagggcatcgccgagaagcagagagagagacccctgggccaggacgagatcgaggagctgagagaggccttcctggagttcgacaaggacagagacggcttcatcagctgcaaggacctgggcaacctgatgagaaccatgggctacatgcccaccgagatggagctgatcgagctgggccagcagatcagaatgaacctgggcggcagagtggacttcgacgacttcgtggagctgatgacccccaagctgctggccgagaccgccggcatgatcggcgtgcaggagatgagagacgccttcaaggagttcgacaccaacggcgacggcgagatcaccctggtggagctgcagcaggccatgcagagactgctgggcgagagactgacccccagagagatcagcgaggtggtgagagaggccgacgtgaacggcgacggcaccgtggacttcgaggagttcgtgaagatgatgagcagatag

SEQ ID NO: 74953 - DNA, 846 bp, Artificial Sequence
  Description of Artificial Sequence: Synthetic coding sequence
atggagaagagcaccgacaccgacgaggacaacgtgaccagaaccgagtacagcgacaagaccacccagttccccagcgtgtacgccgtgcccggcaccgagcagaccgaggccgtgggcggcctgagcagcaagcccgccacccccaagaccaccaccccccccagcagccccccccccaccgccgtgagccccgagttcgcctacgtgcccgccgaccccgcccagctggccgcccagatgctggccatggccaccagcgagagaggccagccccccccctgcagcaacatgtggaccctgtactgcctgaccgacaagaaccagcagggccaccccagccccccccccgcccccggccccttcccccaggccaccctgtacctgcccaaccccaaggacccccagttccagcagcacccccccaaggtgaccttccccacctacgtgatgggcgacaccaagaagaccagcgccccccccttcatcctggtgggcagcaacgtgcaggaggcccagggctggaagcccctgcccggccacgccgtggtgagccagagcgacgtgctgagatacgtggccatgcaggtgcccatcgccgtgcccgccgacgagaagtaccagaagcacaccctgagcccccagaacgccaacccccccagcggccaggacgtgcccagacccaagagccccgtgttcctgagcgtggccttccccgtggaggacgtggccaagaagagcagcggcagcggcgacaagtgcgcccccttcggcagctacggcatcgccggcgaggtgaccgtgaccaccgcccacaagagaagaaaggccgagaccgagaactag

SEQ ID NO: 74954 - DNA, 1188 bp, Artificial Sequence
  Description of Artificial Sequence: Synthetic coding sequence
atggagaagagcaccgacaccgacgaggacaacgtgaccagaaccgagtacagcgacaagaccacccagttccccagcgtgtacgccgtgcccggcaccgagcagaccgaggccgtgggcggcctgagcagcaagcccgccacccccaagaccaccaccccccccagcagccccccccccaccgccgtgagccccgagttcgcctacgtgcccgccgaccccgcccagctggccgcccagatgctgggcaaggtgagcagcatccacagcgaccagagcgacgtgctgatggtggacgtggccaccagcatgcccgtggtgatcaaggaggtgcccagcagcgaggccgccgaggacgtgatggtggccgcccccctggtgtgcagcggcaaggtgctggaggtgcaggtggtgaaccagaccagcgtgcacgtggacctgggcagccagcccaaggagaacgaggccgagcccagcaccgccagcagcgtgcccctgcaggacgagcaggagccccccgcctacgaccaggcccccgaggtgaccctgcaggccgacatcgaggtgatgagcaccgtgcacatcagcagcgtgtacaacgacgtgcccgtgaccgagggcgtggtgtacatcgagcagctgcccgagcagatcgtgatccccttcaccgaccaggtggcctgcctgaaggagaacgagcagagcaaggagaacgagcagagccccagagtgagccccaagagcgtggtggagaagaccaccagcggcatgagcaagaagagcgtggagagcgtgaagctggcccagctggaggagaacgccaagtacagcagcgtgtacatggaggccgaggccaccgccctgctgagcgacaccagcctgaagggccagcccgaggtgcccgcccagctgctggacgccgagggcgccatcaagatcggcagcgagaagagcctgcacctggaggtggagatcaccagcatcgtgagcgacaacaccggccaggaggagagcggcgagaacagcgtgccccaggagatggagggcaagcccgtgctgagcggcgaggccgccgaggccgtgcacagcggcaccagcgtgaagagcagcagcggccccttcccccccgcccccgagggcctgaccgcccccgagatcgagcccgagggcgagagcaccgccgagtag

SEQ ID NO: 74955 - DNA, 1140 bp, Artificial Sequence
  Description of Artificial Sequence: Synthetic coding sequence
atgatcagcagcaagcccagactggtggtgccctacggcctgaagaccctgctggagggcatcagcagagccgtgctgaagaccaaccccagcaacatcaaccagttcgccgccgcctacttccaggagctgaccatgtacagaggcaacaccaccatggacatcaaggacctggtgaagcagttccaccagatcaaggtggagaagtggagcgagggcaccaccccccagaagaagctggagtgcctgaaggagcccggcaagaccagcgtggagagcaaggtgcccacccagatggagaagagcaccgacaccgacgaggacaacgtgaccagaaccgagtacagcgacaagaccacccagttccccagcgtgtacgccgtgcccggcaccgagcagaccgaggccgtgggcggcctgagcagcaagcccgccacccccaagaccaccaccccccccagcagccccccccccaccgccgtgagccccgagttcgcctacgtgcccgccgaccccgcccagctggccgcccagatgctggccatggccaccagcgagagaggccagccccccccctgcagcaacatgtggaccctgtactgcctgaccgacaagaaccagcagggccaccccagccccccccccgcccccggccccttcccccaggccaccctgtacctgcccaaccccaaggacccccagttccagcagcacccccccaaggtgaccttccccacctacgtgatgggcgacaccaagaagaccagcgccccccccttcatcctggtgggcagcaacgtgcaggaggcccagggctggaagcccctgcccggccacgccgtggtgagccagagcgacgtgctgagatacgtggccatgcaggtgcccatcgccgtgcccgccgacgagaagtaccagaagcacaccctgagcccccagaacgccaacccccccagcggccaggacgtgcccagacccaagagccccgtgttcctgagcgtggccttccccgtggaggacgtggccaagaagagcagcggcagcggcgacaagtgcgcccccttcggcagctacggcatcgccggcgaggtgaccgtgaccaccgcccacaagagaagaaaggccgagaccgagaactag

SEQ ID NO: 74956 - DNA, 1140 bp, Artificial Sequence; identical to SEQ ID NO: 74955
  Description of Artificial Sequence: Synthetic coding sequence

SEQ ID NO: 74957 - DNA, 666 bp, Artificial Sequence
  Description of Artificial Sequence: Synthetic coding sequence
atgatcagcagcaagcccagactggtggtgccctacggcctgaagaccctgctggagggcatcagcagagccgtgctgaagaccaaccccagcaacatcaaccagttcgccgccgcctacttccaggagctgaccatgtacagaggcaacaccaccatggacatcaaggacctggtgaagcagttccaccagatcaaggtggagaagtggagcgagggcaccaccccccagaagaagctggagtgcctgaaggagcccggcaagaccagcgtggagagcaaggtgcccacccagatggagaagagcaccgacaccgacgaggacaacgtgaccagaaccgagtacagcgacaagaccacccagttccccagcgtgtacgccgtgcccggcaccgagcagaccgaggccgtgggcggcctgagcagcaagcccgccacccccaagaccaccaccccccccagcagccccccccccaccgccgtgagccccgagttcgcctacgtgcccgccgaccccgcccagctggccgcccagatgctggaggacgtggccaagaagagcagcggcagcggcgacaagtgcgcccccttcggcagctacggcatcgccggcgaggtgaccgtgaccaccgcccacaagagaagaaaggccgagaccgagaactag

SEQ ID NO: 74958 - DNA, 1482 bp, Artificial Sequence
  Description of Artificial Sequence: Synthetic coding sequence
atgatcagcagcaagcccagactggtggtgccctacggcctgaagaccctgctggagggcatcagcagagccgtgctgaagaccaaccccagcaacatcaaccagttcgccgccgcctacttccaggagctgaccatgtacagaggcaacaccaccatggacatcaaggacctggtgaagcagttccaccagatcaaggtggagaagtggagcgagggcaccaccccccagaagaagctggagtgcctgaaggagcccggcaagaccagcgtggagagcaaggtgcccacccagatggagaagagcaccgacaccgacgaggacaacgtgaccagaaccgagtacagcgacaagaccacccagttccccagcgtgtacgccgtgcccggcaccgagcagaccgaggccgtgggcggcctgagcagcaagcccgccacccccaagaccaccaccccccccagcagccccccccccaccgccgtgagccccgagttcgcctacgtgcccgccgaccccgcccagctggccgcccagatgctgggcaaggtgagcagcatccacagcgaccagagcgacgtgctgatggtggacgtggccaccagcatgcccgtggtgatcaaggaggtgcccagcagcgaggccgccgaggacgtgatggtggccgcccccctggtgtgcagcggcaaggtgctggaggtgcaggtggtgaaccagaccagcgtgcacgtggacctgggcagccagcccaaggagaacgaggccgagcccagcaccgccagcagcgtgcccctgcaggacgagcaggagccccccgcctacgaccaggcccccgaggtgaccctgcaggccgacatcgaggtgatgagcaccgtgcacatcagcagcgtgtacaacgacgtgcccgtgaccgagggcgtggtgtacatcgagcagctgcccgagcagatcgtgatccccttcaccgaccaggtggcctgcctgaaggagaacgagcagagcaaggagaacgagcagagccccagagtgagccccaagagcgtggtggagaagaccaccagcggcatgagcaagaagagcgtggagagcgtgaagctggcccagctggaggagaacgccaagtacagcagcgtgtacatggaggccgaggccaccgccctgctgagcgacaccagcctgaagggccagcccgaggtgcccgcccagctgctggacgccgagggcgccatcaagatcggcagcgagaagagcctgcacctggaggtggagatcaccagcatcgtgagcgacaacaccggccaggaggagagcggcgagaacagcgtgccccaggagatggagggcaagcccgtgctgagcggcgaggccgccgaggccgtgcacagcggcaccagcgtgaagagcagcagcggccccttcccccccgcccccgagggcctgaccgcccccgagatcgagcccgagggcgagagcaccgccgagtag

SEQ ID NO: 74959 - DNA, 1428 bp, Artificial Sequence
  Description of Artificial Sequence: Synthetic coding sequence
atgatcagcagcaagcccagactggtggtgccctacggcctgaagaccctgctggagggcatcagcagagccgtgctgaagaccaaccccagcaacatcaaccagttcgccgccgcctacttccaggagctgaccatgtacagagtggagaagtggagcgagggcaccaccccccagaagaagctggagtgcctgaaggagcccggcaagaccagcgtggagagcaaggtgcccacccagatggagaagagcaccgacaccgacgaggacaacgtgaccagaaccgagtacagcgacaagaccacccagttccccagcgtgtacgccgtgcccggcaccgagcagaccgaggccgtgggcggcctgagcagcaagcccgccacccccaagaccaccaccccccccagcagccccccccccaccgccgtgagccccgagttcgcctacgtgcccgccgaccccgcccagctggccgcccagatgctgggcaaggtgagcagcatccacagcgaccagagcgacgtgctgatggtggacgtggccaccagcatgcccgtggtgatcaaggaggtgcccagcagcgaggccgccgaggacgtgatggtggccgcccccctggtgtgcagcggcaaggtgctggaggtgcaggtggtgaaccagaccagcgtgcacgtggacctgggcagccagcccaaggagaacgaggccgagcccagcaccgccagcagcgtgcccctgcaggacgagcaggagccccccgcctacgaccaggcccccgaggtgaccctgcaggccgacatcgaggtgatgagcaccgtgcacatcagcagcgtgtacaacgacgtgcccgtgaccgagggcgtggtgtacatcgagcagctgcccgagcagatcgtgatccccttcaccgaccaggtggcctgcctgaaggagaacgagcagagcaaggagaacgagcagagccccagagtgagccccaagagcgtggtggagaagaccaccagcggcatgagcaagaagagcgtggagagcgtgaagctggcccagctggaggagaacgccaagtacagcagcgtgtacatggaggccgaggccaccgccctgctgagcgacaccagcctgaagggccagcccgaggtgcccgcccagctgctggacgccgagggcgccatcaagatcggcagcgagaagagcctgcacctggaggtggagatcaccagcatcgtgagcgacaacaccggccaggaggagagcggcgagaacagcgtgccccaggagatggagggcaagcccgtgctgagcggcgaggccgccgaggccgtgcacagcggcaccagcgtgaagagcagcagcggccccttcccccccgcccccgagggcctgaccgcccccgagatcgagcccgagggcgagagcaccgccgagtag

SEQ ID NO: 74960 - DNA, 1452 bp, Artificial Sequence
  Description of Artificial Sequence: Synthetic coding sequence
atgagcttcagcgacagcagcgccaccttcctgctgaacgagggcagcgccgacagctacaccagcagacccagcctggacagcgacgtgagcctggaggaggacagagagagcgccagaagagaggtggagagccaggcccagcagcagctggagagagccaagcacaagcccgtggccttcgccgtgagaaccaacgtgagctactgcggcgtgctggacgaggagtgccccgtgcagggcagcggcgtgaacttcgaggccaaggacttcctgcacatcaaggagaagtacagcaacgactggtggatcggcagactggtgaaggagggcggcgacatcgccttcatccccagcccccagagactggagagcatcagactgaagcaggagcagaaggccagaagaagcggcaaccccagcagcctgagcgacatcggcaacagaagaagccccccccccagcctggccaagcagaagcagaagcaggccgagcacgtgcccccctacgacgtggtgcccagcatgagacccgtggtgctggtgggccccagcctgaagggctacgaggtgaccgacatgatgcagaaggccctgttcgacttcctgaagcacagattcgacggcagaatcagcatcaccagagtgaccgccgacctgagcctggccaagagaagcgtgctgaacaaccccggcaagagaaccatcatcgagagaagcagcgccagaagcagcatcgccgaggtgcagagcgagatcgagagaatcttcgagctggccaagagcctgcagctggtggtgctggacgccgacaccatcaaccaccccgcccagctggccaagaccagcctggcccccatcatcgtgttcgtgaaggtgagcagccccaaggtgctgcagagactgatcagaagcagaggcaagagccagatgaagcacctgaccgtgcagatgatggcctacgacaagctggtgcagtgcccccccgagagcttcgacgtgatcctggacgagaaccagctggaggacgcctgcgagcacctggccgagtacctggaggtgtactggagagccacccaccaccccgcccccggccccggcctgctgggcccccccagcgccatccccggcctgcagaaccagcagctgctgggcgagagaggcgaggagcacagccccctggagagagacagcctgatgcccagcgacgaggccagcgagagcagcagacaggcctggaccggcagcagccagagaagcagcagacacctggaggaggactacgccgacgcctaccaggacctgtaccagccccacagacagcacaccagcggcctgcccagcgccaacggccacgacccccaggacagactgctggcccaggacagcgagcacaaccacagcgacagaaactggcagagaaacagaccctggcccaaggacagctactag

SEQ ID NO: 74961 - DNA, 1416 bp, Artificial Sequence
  Description of Artificial Sequence: Synthetic coding sequence
atggagggcagcgccgacagctacaccagcagacccagcctggacagcgacgtgagcctggaggaggacagagagagcgccagaagagaggtggagagccaggcccagcagcagctggagagagccaagcacaagcccgtggccttcgccgtgagaaccaacgtgagctactgcggcgtgctggacgaggagtgccccgtgcagggcagcggcgtgaacttcgaggccaaggacttcctgcacatcaaggagaagtacagcaacgactggtggatcggcagactggtgaaggagggcggcgacatcgccttcatccccagcccccagagactggagagcatcagactgaagcaggagcagaaggccagaagaagcggcaaccccagcagcctgagcgacatcggcaacagaagaagccccccccccagcctggccaagcagaagcagaagcaggccgagcacgtgcccccctacgacgtggtgcccagcatgagacccgtggtgctggtgggccccagcctgaagggctacgaggtgaccgacatgatgcagaaggccctgttcgacttcctgaagcacagattcgacggcagaatcagcatcaccagagtgaccgccgacctgagcctggccaagagaagcgtgctgaacaaccccggcaagagaaccatcatcgagagaagcagcgccagaagcagcatcgccgaggtgcagagcgagatcgagagaatcttcgagctggccaagagcctgcagctggtggtgctggacgccgacaccatcaaccaccccgcccagctggccaagaccagcctggcccccatcatcgtgttcgtgaaggtgagcagccccaaggtgctgcagagactgatcagaagcagaggcaagagccagatgaagcacctgaccgtgcagatgatggcctacgacaagctggtgcagtgcccccccgagagcttcgacgtgatcctggacgagaaccagctggaggacgcctgcgagcacctggccgagtacctggaggtgtactggagagccacccaccaccccgcccccggccccggcctgctgggcccccccagcgccatccccggcctgcagaaccagcagctgctgggcgagagaggcgaggagcacagccccctggagagagacagcctgatgcccagcgacgaggccagcgagagcagcagacaggcctggaccggcagcagccagagaagcagcagacacctggaggaggactacgccgacgcctaccaggacctgtaccagccccacagacagcacaccagcggcctgcccagcgccaacggccacgacccccaggacagactgctggcccaggacagcgagcacaaccacagcgacagaaactggcagagaaacagaccctggcccaaggacagctactag

SEQ ID NO: 74962 - DNA, 1332 bp, Artificial Sequence
  Description of Artificial Sequence: Synthetic coding sequence
atgtacgacgacagctacgtgcccggcttcgaggacagcgaggccggcagcgccgacagctacaccagcagacccagcctggacagcgacgtgagcctggaggaggacagagagagcgccagaagagaggtggagagccaggcccagcagcagctggagagagccaagaagtacagcaacgactggtggatcggcagactggtgaaggagggcggcgacatcgccttcatccccagcccccagagactggagagcatcagactgaagcaggagcagaaggccagaagaagcggcaaccccagcagcctgagcgacatcggcaacagaagaagccccccccccagcctggccaagcagaagcagaagcaggccgagcacgtgcccccctacgacgtggtgcccagcatgagacccgtggtgctggtgggccccagcctgaagggctacgaggtgaccgacatgatgcagaaggccctgttcgacttcctgaagcacagattcgacggcagaatcagcatcaccagagtgaccgccgacctgagcctggccaagagaagcgtgctgaacaaccccggcaagagaaccatcatcgagagaagcagcgccagaagcagcatcgccgaggtgcagagcgagatcgagagaatcttcgagctggccaagagcctgcagctggtggtgctggacgccgacaccatcaaccaccccgcccagctggccaagaccagcctggcccccatcatcgtgttcgtgaaggtgagcagccccaaggtgctgcagagactgatcagaagcagaggcaagagccagatgaagcacctgaccgtgcagatgatggcctacgacaagctggtgcagtgcccccccgagagcttcgacgtgatcctggacgagaaccagctggaggacgcctgcgagcacctggccgagtacctggaggtgtactggagagccacccaccaccccgcccccggccccggcctgctgggcccccccagcgccatccccggcctgcagaaccagcagctgctgggcgagagaggcgaggagcacagccccctggagagagacagcctgatgcccagcgacgaggccagcgagagcagcagacaggcctggaccggcagcagccagagaagcagcagacacctggaggaggactacgccgacgcctaccaggacctgtaccagccccacagacagcacaccagcggcctgcccagcgccaacggccacgacccccaggacagactgctggcccaggacagcgagcacaaccacagcgacagaaactggcagagaaacagaccctggcccaaggacagctactag

SEQ ID NO: 74963 - DNA, 1377 bp, Artificial Sequence
  Description of Artificial Sequence: Synthetic coding sequence
atgagcagcagcagctacgccaagaacggcaccgccgacggcccccacagccccaccagccaggtggccagaggcaccaccaccagaagaagcagactgaagagaagcgacggcagcaccaccagcaccagcttcatcctgagacagggcagcgccgacagctacaccagcagacccagcgacagcgacgtgagcctggaggaggacagagaggccatcagacaggagagagagcagcaggccgccatccagctggagagagccaagagcaagcccgtggccttcgccgtgaagaccaacgtgagctactgcggcgccctggacgaggacgtgcccgtgcccagcaccgccatcagcttcgacgccaaggacttcctgcacatcaaggagaagtacaacaacgactggtggatcggcagactggtgaaggagggctgcgagatcggcttcatccccagccccctgagactggagaacatcagaatccagcaggagcagaagagaggcagattccacggcggcaagagcagcggcaacagcagcagcagcctgggcgagatggtgagcggcaccttcagagccacccccaccagcaccgccaagcagaagcagaaggtgaccgagcacatccccccctacgacgtggtgcccagcatgagacccgtggtgctggtgggccccagcctgaagggctacgaggtgaccgacatgatgcagaaggccctgttcgacttcctgaagcacagattcgacggcagaatcagcatcaccagagtgaccgccgacatcagcctggccaagagaagcgtgctgaacaaccccagcaagagagccatcatcgagagaagcaacaccagaagcagcctggccgaggtgcagagcgagatcgagagaatcttcgagctggccagaagcctgcagctggtggtgctggacgccgacaccatcaaccaccccgcccagctgatcaagaccagcctggcccccatcatcgtgcacgtgaaggtgagcagccccaaggtgctgcagagactgatcaagagcagaggcaagagccagagcaagcacctgaacgtgcagctggtggccgccgacaagctggcccagtgcccccccagccagagaatgagacacagcaaccacagcaccgagaacagccccatcgagagaagaagcctgatgaccagcgacgagaactaccacaacgagagagccagaaagagcagaaacagactgagcagcagcagccagcacagcagagaccactaccccctggtggaggaggactaccccgacagctaccaggacacctacaagccccacagaaacagaggcagccccggcggctacagccacgacagcagacacagactgtag

SEQ ID NO: 74964 - DNA, 1509 bp, Artificial Sequence
  Description of Artificial Sequence: Synthetic coding sequence
atggacgtggtggccagaggcaccaccaccagaagaagcagactgaagagaagcgacggcagcaccaccagcaccagcttcatcctgagacagggcagcgccgacagctacaccagcagacccagcgacagcgacgtgagcctggaggaggacagagaggccatcagacaggagagagagcagcaggccgccatccagctggagagagccaagagcaagcccgtggccttcgccgtgaagaccaacgtgagctactgcggcgccctggacgaggacgtgcccgtgcccagcaccgccatcagcttcgacgccaaggacttcctgcacatcaaggagaagtacaacaacgactggtggatcggcagactggtgaaggagggctgcgagatcggcttcatccccagccccctgagactggagaacatcagaatccagcaggagcagaagagaggcagattccacggcggcaagagcagcggcaacagcagcagcagcctgggcgagatggtgagcggcaccttcagagccacccccaccagcaccgccaagcagaagcagaaggtgaccgagcacatccccccctacgacgtggtgcccagcatgagacccgtggtgctggtgggccccagcctgaagggctacgaggtgaccgacatgatgcagaaggccctgttcgacttcctgaagcacagattcgacggcagaatcagcatcaccagagtgaccgccgacatcagcctggccaagagaagcgtgctgaacaaccccagcaagagagccatcatcgagagaagcaacaccagaagcagcctggccgaggtgcagagcgagatcgagagaatcttcgagctggccagaagcctgcagctggtggtgctggacgccgacaccatcaaccaccccgcccagctgatcaagaccagcctggcccccatcatcgtgcacgtgaaggtgagcagccccaaggtgctgcagagactgatcaagagcagaggcaagagccagagcaagcacctgaacgtgcagctggtggccgccgacaagctggcccagtgcccccccgagatgttcgacgtgatcctggacgagaaccagctggaggacgcctgcgagcacctgggcgagtacctggaggcctactggagagccacccacaccaccagcagcacccccatgacccccctgctgggcagaaacctgggcagcaccgccctgagcccctaccccaccgccatcagcggcctgcagagccagagaatgagacacagcaaccacagcaccgagaacagccccatcgagagaagaagcctgatgaccagcgacgagaactaccacaacgagagagccagaaagagcagaaacagactgagcagcagcagccagcacagcagagaccactaccccctggtggaggaggactaccccgacagctaccaggacacctacaagccccacagaaacagaggcagccccggcggctacagccacgacagcagacacagactgtag

SEQ ID NO: 74965 - DNA, 3438 bp, Artificial Sequence
  Description of Artificial Sequence: Synthetic coding sequence
atggccgtgcccgccagaacctgcggcgccagcagacccggccccgccagaaccgccagaccctggcccggctgcggcccccaccccggccccggcaccagaagacccaccagcggcccccccagacccctgtggctgctgctgcccctgctgcccctgctggccgcccccggcgccagcgcctacagcttcccccagcagcacaccatgcagcactgggccagaagactggagcaggaggtggacggcgtgatgagaatcttcggcggcgtgcagcagctgagagagatctacaaggacaacagaaacctgttcgaggtgcaggagaacgagccccagaagctggtggagaaggtggccggcgacatcgagagcctgctggacagaaaggtgcaggccctgaagagactggccgacgccgccgagaacttccagaaggcccacagatggcaggacaacatcaaggaggaggacatcgtgtactacgacgccaaggccgacgccgagctggacgaccccgagagcgaggacgtggagagaggcagcaaggccagcaccctgagactggacttcatcgaggaccccaacttcaagaacaaggtgaactacagctacgccgccgtgcagatccccaccgacatctacaagggcagcaccgtgatcctgaacgagctgaactggaccgaggccctggagaacgtgttcatggagaacagaagacaggaccccaccctgctgtggcaggtgttcggcagcgccaccggcgtgaccagatactaccccgccaccccctggagagcccccaagaagatcgacctgtacgacgtgagaagaagaccctggtacatccagggcgccagcagccccaaggacatggtgatcatcgtggacgtgagcggcagcgtgagcggcctgaccctgaagctgatgaagaccagcgtgtgcgagatgctggacaccctgagcgacgacgactacgtgaacgtggccagcttcaacgagaaggcccagcccgtgagctgcttcacccacctggtgcaggccaacgtgagaaacaagaaggtgttcaaggaggccgtgcagggcatggtggccaagggcaccaccggctacaaggccggcttcgagtacgccttcgaccagctgcagaacagcaacatcaccagagccaactgcaacaagatgatcatgatgttcaccgacggcggcgaggacagagtgcaggacgtgttcgagaagtacaactggcccaacagaaccgtgagagtgttcaccttcagcgtgggccagcacaactacgacgtgacccccctgcagtggatggcctgcgccaacaagggctactacttcgagatccccagcatcggcgccatcagaatcaacacccaggagtacctggacgtgctgggcagacccatggtgctggccggcaaggaggccaagcaggtgcagtggaccaacgtgtacgaggacgccctgggcctgggcctggtggtgaccggcaccctgcccgtgttcaacctgacccaggacggccccggcgagaagaagaaccagctgatcctgggcgtgatgggcatcgacgtggccctgaacgacatcaagagactgacccccaactacaccctgggcgccaacggctacgtgttcgccatcgacctgaacggctacgtgctgctgcaccccaacctgaagccccagaccaccaacttcagagagcccgtgaccctggacttcctggacgccgagctggaggacgagaacaaggaggagatcagaagaagcatgatcgacggcaacaagggccacaagcagatcagaaccctggtgaagagcctggacgagagatacatcgacgaggtgaccagaaactacacctgggtgcccatcagaagcaccaactacagcctgggcctggtgctgcccccctacagcaccttctacctgcaggccaacctgagcgaccagatcctgcaggtgaagtacttcgagttcctgctgcccagcagcttcgagagcgagggccacgtgttcatcgcccccagagagtactgcaaggacctgaacgccagcgacaacaacaccgagttcctgaagaacttcatcgagctgatggagaaggtgacccccgacagcaagcagtgcaacaacttcctgctgcacaacctgatcctggacaccggcatcacccagcagctggtggagagagtgtggagagaccaggacctgaacacctacagcctgctggccgtgttcgccgccaccgacggcggcatcaccagagtgttccccaacaaggccgccgaggactggaccgagaaccccgagcccttcaacgccagcttctacagaagaagcctggacaaccacggctacgtgttcaagcccccccaccaggacgccctgctgagacccctggagctggagaacgacaccgtgggcatcctggtgagcaccgccgtggagctgagcctgggcagaagaaccctgagacccgccgtggtgggcgtgaagctggacctggaggcctgggccgagaagttcaaggtgctggccagcaacagaacccaccaggaccagccccagaagtgcggccccaacagccactgcgagatggactgcgaggtgaacaacgaggacctgctgtgcgtgctgatcgacgacggcggcttcctggtgctgagcaaccagaaccaccagtgggaccaggtgggcagattcttcagcgaggtggacgccaacctgatgctggccctgtacaacaacagcttctacaccagaaaggagagctacgactaccaggccgcctgcgccccccagccccccggcaacctgggcgccgcccccagaggcgtgttcgtgcccaccgtggccgacttcctgaacctggcctggtggaccagcgccgccgcctggagcctgttccagcagctgctgtacggcctgatctaccacagctggttccaggccgaccccgccgaggccgagggcagccccgagaccagagagagcagctgcgtgatgaagcagacccagtactacttcggcagcgtgaacgccagctacaacgccatcatcgactgcggcaactgcagcagactgttccacgcccagagactgaccaacaccaacctgctgttcgtggtggccgagaagcccctgtgcagccagtgcgaggccggcagactgctgcagaaggagacccactgccccgccgacggccccgagcagtgcgagctggtgcagagacccagatacagaagaggcccccacatctgcttcgactacaacgccaccgaggacaccagcgactgcggcagaggcgccagcttcccccccagcctgggcgtgctggtgagcctgcagctgctgctgctgctgggcctgccccccagaccccagccccaggtgctggtgcacgccagcagaagactgtag

SEQ ID NO: 74966 - DNA, 3231 bp, Artificial Sequence
  Description of Artificial Sequence: Synthetic coding sequence
atgcagcactgggccagaagactggagcaggaggtggacggcgtgatgagaatcttcggcggcgtgcagcagctgagagagatctacaaggacaacagaaacctgttcgaggtgcaggagaacgagccccagaagctggtggagaaggtggccggcgacatcgagagcctgctggacagaaaggtgcaggccctgaagagactggccgacgccgccgagaacttccagaaggcccacagatggcaggacaacatcaaggaggaggacatcgtgtactacgacgccaaggccgacgccgagctggacgaccccgagagcgaggacgtggagagaggcagcaaggccagcaccctgagactggacttcatcgaggaccccaacttcaagaacaaggtgaactacagctacgccgccgtgcagatccccaccgacatctacaagggcagcaccgtgatcctgaacgagctgaactggaccgaggccctggagaacgtgttcatggagaacagaagacaggaccccaccctgctgtggcaggtgttcggcagcgccaccggcgtgaccagatactaccccgccaccccctggagagcccccaagaagatcgacctgtacgacgtgagaagaagaccctggtacatccagggcgccagcagccccaaggacatggtgatcatcgtggacgtgagcggcagcgtgagcggcctgaccctgaagctgatgaagaccagcgtgtgcgagatgctggacaccctgagcgacgacgactacgtgaacgtggccagcttcaacgagaaggcccagcccgtgagctgcttcacccacctggtgcaggccaacgtgagaaacaagaaggtgttcaaggaggccgtgcagggcatggtggccaagggcaccaccggctacaaggccggcttcgagtacgccttcgaccagctgcagaacagcaacatcaccagagccaactgcaacaagatgatcatgatgttcaccgacggcggcgaggacagagtgcaggacgtgttcgagaagtacaactggcccaacagaaccgtgagagtgttcaccttcagcgtgggccagcacaactacgacgtgacccccctgcagtggatggcctgcgccaacaagggctactacttcgagatccccagcatcggcgccatcagaatcaacacccaggagtacctggacgtgctgggcagacccatggtgctggccggcaaggaggccaagcaggtgcagtggaccaacgtgtacgaggacgccctgggcctgggcctggtggtgaccggcaccctgcccgtgttcaacctgacccaggacggccccggcgagaagaagaaccagctgatcctgggcgtgatgggcatcgacgtggccctgaacgacatcaagagactgacccccaactacaccctgggcgccaacggctacgtgttcgccatcgacctgaacggctacgtgctgctgcaccccaacctgaagccccagaccaccaacttcagagagcccgtgaccctggacttcctggacgccgagctggaggacgagaacaaggaggagatcagaagaagcatgatcgacggcaacaagggccacaagcagatcagaaccctggtgaagagcctggacgagagatacatcgacgaggtgaccagaaactacacctgggtgcccatcagaagcaccaactacagcctgggcctggtgctgcccccctacagcaccttctacctgcaggccaacctgagcgaccagatcctgcaggtgaagtacttcgagttcctgctgcccagcagcttcgagagcgagggccacgtgttcatcgcccccagagagtactgcaaggacctgaacgccagcgacaacaacaccgagttcctgaagaacttcatcgagctgatggagaaggtgacccccgacagcaagcagtgcaacaacttcctgctgcacaacctgatcctggacaccggcatcacccagcagctggtggagagagtgtggagagaccaggacctgaacacctacagcctgctggccgtgttcgccgccaccgacggcggcatcaccagagtgttccccaacaaggccgccgaggactggaccgagaaccccgagcccttcaacgccagcttctacagaagaagcctggacaaccacggctacgtgttcaagcccccccaccaggacgccctgctgagacccctggagctggagaacgacaccgtgggcatcctggtgagcaccgccgtggagctgagcctgggcagaagaaccctgagacccgccgtggtgggcgtgaagctggacctggaggcctgggccgagaagttcaaggtgctggccagcaacagaacccaccaggaccagccccagaagtgcggccccaacagccactgcgagatggactgcgaggtgaacaacgaggacctgctgtgcgtgctgatcgacgacggcggcttcctggtgctgagcaaccagaaccaccagtgggaccaggtgggcagattcttcagcgaggtggacgccaacctgatgctggccctgtacaacaacagcttctacaccagaaaggagagctacgactaccaggccgcctgcgccccccagccccccggcaacctgggcgccgcccccagaggcgtgttcgtgcccaccgtggccgacttcctgaacctggcctggtggaccagcgccgccgcctggagcctgttccagcagctgctgtacggcctgatctaccacagctggttccaggccgaccccgccgaggccgagggcagccccgagaccagagagagcagctgcgtgatgaagcagacccagtactacttcggcagcgtgaacgccagctacaacgccatcatcgactgcggcaactgcagcagactgttccacgcccagagactgaccaacaccaacctgctgttcgtggtggccgagaagcccctgtgcagccagtgcgaggccggcagactgctgcagaaggagacccactgccccgccgacggccccgagcagtgcgagctggtgcagagacccagatacagaagaggcccccacatctgcttcgactacaacgccaccgaggacaccagcgactgcggcagaggcgccagcttcccccccagcctgggcgtgctggtgagcctgcagctgctgctgctgctgggcctgccccccagaccccagccccaggtgctggtgcacgccagcagaagactgtag

SEQ ID NO: 74967 - DNA, 3441 bp, Artificial Sequence
  Description of Artificial Sequence: Synthetic coding sequence
atggccgtgcccgccagaacctgcggcgccagcagacccggccccgccagaaccgccagaccctggcccggctgcggcccccaccccggccccggcaccagaagacccaccagcggcccccccagacccctgtggctgctgctgcccctgctgcccctgctggccgcccccggcgccagcgcctacagcttcccccagcagcacaccatgcagcactgggccagaagactggagcaggaggtggacggcgtgatgagaatcttcggcggcgtgcagcagctgagagagatctacaaggacaacagaaacctgttcgaggtgcaggagaacgagccccagaagctggtggagaaggtggccggcgacatcgagagcctgctggacagaaaggtgcaggccctgaagagactggccgacgccgccgagaacttccagaaggcccacagatggcaggacaacatcaaggaggaggacatcgtgtactacgacgccaaggccgacgccgagctggacgaccccgagagcgaggacgtggagagaggcagcaaggccagcaccctgagactggacttcatcgaggaccccaacttcaagaacaaggtgaactacagctacgccgccgtgcagatccccaccgacatctacaagggcagcaccgtgatcctgaacgagctgaactggaccgaggccctggagaacgtgttcatggagaacagaagacaggaccccaccctgctgtggcaggtgttcggcagcgccaccggcgtgaccagatactaccccgccaccccctggagagcccccaagaagatcgacctgtacgacgtgagaagaagaccctggtacatccagggcgccagcagccccaaggacatggtgatcatcgtggacgtgagcggcagcgtgagcggcctgaccctgaagctgatgaagaccagcgtgtgcgagatgctggacaccctgagcgacgacgactacgtgaacgtggccagcttcaacgagaaggcccagcccgtgagctgcttcacccacctggtgcaggccaacgtgagaaacaagaaggtgttcaaggaggccgtgcagggcatggtggccaagggcaccaccggctacaaggccggcttcgagtacgccttcgaccagctgcagaacagcaacatcaccagagccaactgcaacaagatgatcatgatgttcaccgacggcggcgaggacagagtgcaggacgtgttcgagaagtacaactggcccaacagaaccgtgagagtgttcaccttcagcgtgggccagcacaactacgacgtgacccccctgcagtggatggcctgcgccaacaagggctactacttcgagatccccagcatcggcgccatcagaatcaacacccaggagtacctggacgtgctgggcagacccatggtgctggccggcaaggaggccaagcaggtgcagtggaccaacgtgtacgaggacgccctgggcctgggcctggtggtgaccggcaccctgcccgtgttcaacctgacccaggacggccccggcgagaagaagaaccagctgatcctgggcgtgatgggcatcgacgtggccctgaacgacatcaagagactgacccccaactacaccctgggcgccaacggctacgtgttcgccatcgacctgaacggctacgtgctgctgcaccccaacctgaagccccagaccaccaacttcagagagcccgtgaccctggacttcctggacgccgagctggaggacgagaacaaggaggagatcagaagaagcatgatcgacggcaacaagggccacaagcagatcagaaccctggtgaagagcctggacgagagatacatcgacgaggtgaccagaaactacacctgggtgcccatcagaagcaccaactacagcctgggcctggtgctgcccccctacagcaccttctacctgcaggccaacctgagcgaccagatcctgcaggtgaagtacttcgagttcctgctgcccagcagcttcgagagcgagggccacgtgttcatcgcccccagagagtactgcaaggacctgaacgccagcgacaacaacaccgagttcctgaagaacttcatcgagctgatggagaaggtgacccccgacagcaagcagtgcaacaacttcctgctgcacaacctgatcctggacaccggcatcacccagcagctggtggagagagtgtggagagaccaggacctgaacacctacagcctgctggccgtgttcgccgccaccgacggcggcatcaccagagtgttccccaacaaggccgccgaggactggaccgagaaccccgagcccttcaacgccagcttctacagaagaagcctggacaaccacggctacgtgttcaagcccccccaccaggacgccctgctgagacccctggagctggagaacgacaccgtgggcatcctggtgagcaccgccgtggagctgagcctgggcagaagaaccctgagacccgccgtggtgggcgtgaagctggacctggaggcctgggccgagaagttcaaggtgctggccagcaacagaacccaccaggaccagccccagaagtgcggccccaacagccactgcgagatggactgcgaggtgaacaacgaggacctgctgtgcgtgctgatcgacgacggcggcttcctggtgctgagcaaccagaaccaccagtgggaccaggtgggcagattcttcagcgaggtggacgccaacctgatgctggccctgtacaacaacagcttctacaccagaaaggagagctacgactaccaggccgcctgcgccccccagccccccggcaacctgggcgccgcccccagaggcgtgttcgtgcccaccgtggccgacttcctgaacctggcctggtggaccagcgccgccgcctggagcctgttccagcagctgctgtacggcctgatctaccacagctggttccaggccgaccccgccgaggccgagggcagccccgagaccagagagagcagctgcgtgatgaagcagacccagtactacttcggcagcgtgaacgccagctacaacgccatcatcgactgcggcaactgcagcagactgttccacgcccagagactgaccaacaccaacctgctgttcgtggtggccgagaagcccctgtgcagccagtgcgaggccggcagactgctgcagaaggagacccactgctgccccgccgacggccccgagcagtgcgagctggtgcagagacccagatacagaagaggcccccacatctgcttcgactacaacgccaccgaggacaccagcgactgcggcagaggcgccagcttcccccccagcctgggcgtgctggtgagcctgcagctgctgctgctgctgggcctgccccccagaccccagccccaggtgctggtgcacgccagcagaagactgtag

SEQ ID NO: 74968 - DNA, 3432 bp, Artificial Sequence
  Description of Artificial Sequence: Synthetic coding sequence
atggccgtgcccgccagaacctgcggcgccagcagacccggccccgccagaaccgccagaccctggcccggctgcggcccccaccccggccccggcaccagaagacccaccagcggcccccccagacccctgtggctgctgctgcccctgctgcccctgctggccgcccccggcgccagcgcctacagcttcccccagcagcacaccatgcagcactgggccagaagactggagcaggaggtggacggcgtgatgagaatcttcggcggcgtgcagcagctgagagagatctacaaggacaacagaaacctgttcgaggtgcaggagaacgagccccagaagctggtggagaaggtggccggcgacatcgagagcctgctggacagaaaggtgcaggccctgaagagactggccgacgccgccgagaacttccagaaggcccacagatggcaggacaacatcaaggaggaggacatcgtgtactacgacgccaaggccgacgccgagctggacgaccccgagagcgaggacgtggagagaggcagcaaggccagcaccctgagactggacttcatcgaggaccccaacttcaagaacaaggtgaactacagctacgccgccgtgcagatccccaccgacatctacaagggcagcaccgtgatcctgaacgagctgaactggaccgaggccctggagaacgtgttcatggagaacagaagacaggaccccaccctgctgtggcaggtgttcggcagcgccaccggcgtgaccagatactaccccgccaccccctggagagcccccaagaagatcgacctgtacgacgtgagaagaagaccctggtacatccagggcgccagcagccccaaggacatggtgatcatcgtggacgtgagcggcagcgtgagcggcctgaccctgaagctgatgaagaccagcgtgtgcgagatgctggacaccctgagcgacgacgactacgtgaacgtggccagcttcaacgagaaggcccagcccgtgagctgcttcacccacctggtgcaggccaacgtgagaaacaagaaggtgttcaaggaggccgtgcagggcatggtggccaagggcaccaccggctacaaggccggcttcgagtacgccttcgaccagctgcagaacagcaacatcaccagagccaactgcaacaagatgatcatgatgttcaccgacggcggcgaggacagagtgcaggacgtgttcgagaagtacaactggcccaacagaaccgtgagagtgttcaccttcagcgtgggccagcacaactacgacgtgacccccctgcagtggatggcctgcgccaacaagggctactacttcgagatccccagcatcggcgccatcagaatcaacacccaggagtacctggacgtgctgggcagacccatggtgctggccggcaaggaggccaagcaggtgcagtggaccaacgtgtacgaggacgccctgggcctgggcctggtggtgaccggcaccctgcccgtgttcaacctgacccaggacggccccggcgagaagaagaaccagctgatcctgggcgtgatgggcatcgacgtggccctgaacgacatcaagagactgacccccaactacaccctgggcgccaacggctacgtgttcgccatcgacctgaacggctacgtgctgctgcaccccaacctgaagccccagaccaccaacttcagagagcccgtgaccctggacttcctggacgccgagctggaggacgagaacaaggaggagatcagaagaagcatgatcgacggcaacaagggccacaagcagatcagaaccctggtgaagagcctggacgagagatacatcgacgaggtgaccagaaactacacctgggtgcccatcagaagcaccaactacagcctgggcctggtgctgcccccctacagcaccttctacctgcaggccaacctgagcgaccagatcctgcaggtgaagtacttcgagttcctgctgcccagcagcttcgagagcgagggccacgtgttcatcgcccccagagagtactgcaaggacctgaacgccagcgacaacaacaccgagttcctgaagaacttcatcgagctgatggagaaggtgacccccgacagcaagcagtgcaacaacttcctgctgcacaacctgatcctggacaccggcatcacccagcagctggtggagagagtgtggagagaccaggacctgaacacctacagcctgctggccgtgttcgccgccaccgacggcggcatcaccagagtgttccccaacaaggccgccgaggactggaccgagaaccccgagcccttcaacgccagcttctacagaagaagcctggacaaccacggctacgtgttcaagcccccccaccaggacgccctgctgagacccctggagctggagaacgacaccgtgggcatcctggtgagcaccgccgtggagctgagcctgggcagaagaaccctgagacccgccgtggtgggcgtgaagctggacctggaggcctgggccgagaagttcaaggtgctggccagcaacagaacccaccaggaccagccccagaagtgcggccccaacagccactgcgagatggactgcgaggtgaacaacgaggacctgctgtgcgtgctgatcgacgacggcggcttcctggtgctgagcaaccagaaccaccagtgggaccaggtgggcagattcttcagcgaggtggacgccaacctgatgctggccctgtacaacaacagcttctacaccagaaaggagagctacgactaccaggccgcctgcgccccccagccccccggcaacctgggcgccgcccccagaggcgtgttcgtgcccaccgtggccgacttcctgaacctggcctggtggaccagcgccgccgcctggagcctgttccagcagctgctgtacggcctgatctaccacagctggttccaggccgaccccgccgaggccgagggcagccccgagaccagagagagcagctgcgtgatgaagcagacccagtactacttcggcagcgtgaacgccagctacaacgccatcatcgactgcggcaactgcagcagactgttccacgcccagagactgaccaacaccaacctgctgttcgtggtggccgagaagcccctgtgcagccagtgcgaggccggcagactgctgcagaaggagacccacagcgacggccccgagcagtgcgagctggtgcagagacccagatacagaagaggcccccacatctgcttcgactacaacgccaccgaggacaccagcgactgcggcagaggcgccagcttcccccccagcctgggcgtgctggtgagcctgcagctgctgctgctgctgggcctgccccccagaccccagccccaggtgctggtgcacgccagcagaagactgtag

SEQ ID NO: 74969 - DNA, 3462 bp, Artificial Sequence
  Description of Artificial Sequence: Synthetic coding sequence
atggccgtgcccgccagaacctgcggcgccagcagacccggccccgccagaaccgccagaccctggcccggctgcggcccccaccccggccccggcaccagaagacccaccagcggcccccccagacccctgtggctgctgctgcccctgctgcccctgctggccgcccccggcgccagcgcctacagcttcccccagcagcacaccatgcagcactgggccagaagactggagcaggaggtggacggcgtgatgagaatcttcggcggcgtgcagcagctgagagagatctacaaggacaacagaaacctgttcgaggtgcaggagaacgagccccagaagctggtggagaaggtggccggcgacatcgagagcctgctggacagaaaggtgcaggccctgaagagactggccgacgccgccgagaacttccagaaggcccacagatggcaggacaacatcaaggaggaggacatcgtgtactacgacgccaaggccgacgccgagctggacgaccccgagagcgaggacgtggagagaggcagcaaggccagcaccctgagactggacttcatcgaggaccccaacttcaagaacaaggtgaactacagctacgccgccgtgcagatccccaccgacatctacaagggcagcaccgtgatcctgaacgagctgaactggaccgaggccctggagaacgtgttcatggagaacagaagacaggaccccaccctgctgtggcaggtgttcggcagcgccaccggcgtgaccagatactaccccgccaccccctggagagcccccaagaagatcgacctgtacgacgtgagaagaagaccctggtacatccagggcgccagcagccccaaggacatggtgatcatcgtggacgtgagcggcagcgtgagcggcctgaccctgaagctgatgaagaccagcgtgtgcgagatgctggacaccctgagcgacgacgactacgtgaacgtggccagcttcaacgagaaggcccagcccgtgagctgcttcacccacctggtgcaggccaacgtgagaaacaagaaggtgttcaaggaggccgtgcagggcatggtggccaagggcaccaccggctacaaggccggcttcgagtacgccttcgaccagctgcagaacagcaacatcaccagagccaactgcaacaagatgatcatgatgttcaccgacggcggcgaggacagagtgcaggacgtgttcgagaagtacaactggcccaacagaaccgtgagagtgttcaccttcagcgtgggccagcacaactacgacgtgacccccctgcagtggatggcctgcgccaacaagggctactacttcgagatccccagcatcggcgccatcagaatcaacacccaggagtacctggacgtgctgggcagacccatggtgctggccggcaaggaggccaagcaggtgcagtggaccaacgtgtacgaggacgccctgggcctgggcctggtggtgaccggcaccctgcccgtgttcaacctgacccaggacggccccggcgagaagaagaaccagctgatcctgggcgtgatgggcatcgacgtggccctgaacgacatcaagagactgacccccaactacaccctgggcgccaacggctacgtgttcgccatcgacctgaacggctacgtgctgctgcaccccaacctgaagccccagaccaccaacttcagagagcccgtgaccctggacttcctggacgccgagctggaggacgagaacaaggaggagatcagaagaagcatgatcgacggcaacaagggccacaagcagatcagaaccctggtgaagagcctggacgagagatacatcgacgaggtgaccagaaactacacctgggtgcccatcagaagcaccaactacagcctgggcctggtgctgcccccctacagcaccttctacctgcaggccaacctgagcgaccagatcctgcaggtgaagctgcccatcagcaagctgaaggacttcgagttcctgctgcccagcagcttcgagagcgagggccacgtgttcatcgcccccagagagtactgcaaggacctgaacgccagcgacaacaacaccgagttcctgaagaacttcatcgagctgatggagaaggtgacccccgacagcaagcagtgcaacaacttcctgctgcacaacctgatcctggacaccggcatcacccagcagctggtggagagagtgtggagagaccaggacctgaacacctacagcctgctggccgtgttcgccgccaccgacggcggcatcaccagagtgttccccaacaaggccgccgaggactggaccgagaaccccgagcccttcaacgccagcttctacagaagaagcctggacaaccacggctacgtgttcaagcccccccaccaggacgccctgctgagacccctggagctggagaacgacaccgtgggcatcctggtgagcaccgccgtggagctgagcctgggcagaagaaccctgagacccgccgtggtgggcgtgaagctggacctggaggcctgggccgagaagttcaaggtgctggccagcaacagaacccaccaggaccagccccagaagtgcggccccaacagccactgcgagatggactgcgaggtgaacaacgaggacctgctgtgcgtgctgatcgacgacggcggcttcctggtgctgagcaaccagaaccaccagtgggaccaggtgggcagattcttcagcgaggtggacgccaacctgatgctggccctgtacaacaacagcttctacaccagaaaggagagctacgactaccaggccgcctgcgccccccagccccccggcaacctgggcgccgcccccagaggcgtgttcgtgcccaccgtggccgacttcctgaacctggcctggtggaccagcgccgccgcctggagcctgttccagcagctgctgtacggcctgatctaccacagctggttccaggccgaccccgccgaggccgagggcagccccgagaccagagagagcagctgcgtgatgaagcagacccagtactacttcggcagcgtgaacgccagctacaacgccatcatcgactgcggcaactgcagcagactgttccacgcccagagactgaccaacaccaacctgctgttcgtggtggccgagaagcccctgtgcagccagtgcgaggccggcagactgctgcagaaggagacccactgctgccccgccgacggccccgagcagtgcgagctggtgcagagacccagatacagaagaggcccccacatctgcttcgactacaacgccaccgaggacaccagcgactgcggcagaggcgccagcttcccccccagcctgggcgtgctggtgagcctgcagctgctgctgctgctgggcctgccccccagaccccagccccaggtgctggtgcacgccagcagaagactgtag

SEQ ID NO: 74970 - DNA, 3453 bp, Artificial Sequence
  Description of Artificial Sequence: Synthetic coding sequence
atggccgtgcccgccagaacctgcggcgccagcagacccggccccgccagaaccgccagaccctggcccggctgcggcccccaccccggccccggcaccagaagacccaccagcggcccccccagacccctgtggctgctgctgcccctgctgcccctgctggccgcccccggcgccagcgcctacagcttcccccagcagcacaccatgcagcactgggccagaagactggagcaggaggtggacggcgtgatgagaatcttcggcggcgtgcagcagctgagagagatctacaaggacaacagaaacctgttcgaggtgcaggagaacgagccccagaagctggtggagaaggtggccggcgacatcgagagcctgctggacagaaaggtgcaggccctgaagagactggccgacgccgccgagaacttccagaaggcccacagatggcaggacaacatcaaggaggaggacatcgtgtactacgacgccaaggccgacgccgagctggacgaccccgagagcgaggacgtggagagaggcagcaaggccagcaccctgagactggacttcatcgaggaccccaacttcaagaacaaggtgaactacagctacgccgccgtgcagatccccaccgacatctacaagggcagcaccgtgatcctgaacgagctgaactggaccgaggccctggagaacgtgttcatggagaacagaagacaggaccccaccctgctgtggcaggtgttcggcagcgccaccggcgtgaccagatactaccccgccaccccctggagagcccccaagaagatcgacctgtacgacgtgagaagaagaccctggtacatccagggcgccagcagccccaaggacatggtgatcatcgtggacgtgagcggcagcgtgagcggcctgaccctgaagctgatgaagaccagcgtgtgcgagatgctggacaccctgagcgacgacgactacgtgaacgtggccagcttcaacgagaaggcccagcccgtgagctgcttcacccacctggtgcaggccaacgtgagaaacaagaaggtgttcaaggaggccgtgcagggcatggtggccaagggcaccaccggctacaaggccggcttcgagtacgccttcgaccagctgcagaacagcaacatcaccagagccaactgcaacaagatgatcatgatgttcaccgacggcggcgaggacagagtgcaggacgtgttcgagaagtacaactggcccaacagaaccgtgagagtgttcaccttcagcgtgggccagcacaactacgacgtgacccccctgcagtggatggcctgcgccaacaagggctactacttcgagatccccagcatcggcgccatcagaatcaacacccaggagtacctggacgtgctgggcagacccatggtgctggccggcaaggaggccaagcaggtgcagtggaccaacgtgtacgaggacgccctgggcctgggcctggtggtgaccggcaccctgcccgtgttcaacctgacccaggacggccccggcgagaagaagaaccagctgatcctgggcgtgatgggcatcgacgtggccctgaacgacatcaagagactgacccccaactacaccctgggcgccaacggctacgtgttcgccatcgacctgaacggctacgtgctgctgcaccccaacctgaagccccagaccaccaacttcagagagcccgtgaccctggacttcctggacgccgagctggaggacgagaacaaggaggagatcagaagaagcatgatcgacggcaacaagggccacaagcagatcagaaccctggtgaagagcctggacgagagatacatcgacgaggtgaccagaaactacacctgggtgcccatcagaagcaccaactacagcctgggcctggtgctgcccccctacagcaccttctacctgcaggccaacctgagcgaccagatcctgcaggtgaagctgcccatcagcaagctgaaggacttcgagttcctgctgcccagcagcttcgagagcgagggccacgtgttcatcgcccccagagagtactgcaaggacctgaacgccagcgacaacaacaccgagttcctgaagaacttcatcgagctgatggagaaggtgacccccgacagcaagcagtgcaacaacttcctgctgcacaacctgatcctggacaccggcatcacccagcagctggtggagagagtgtggagagaccaggacctgaacacctacagcctgctggccgtgttcgccgccaccgacggcggcatcaccagagtgttccccaacaaggccgccgaggactggaccgagaaccccgagcccttcaacgccagcttctacagaagaagcctggacaaccacggctacgtgttcaagcccccccaccaggacgccctgctgagacccctggagctggagaacgacaccgtgggcatcctggtgagcaccgccgtggagctgagcctgggcagaagaaccctgagacccgccgtggtgggcgtgaagctggacctggaggcctgggccgagaagttcaaggtgctggccagcaacagaacccaccaggaccagccccagaagtgcggccccaacagccactgcgagatggactgcgaggtgaacaacgaggacctgctgtgcgtgctgatcgacgacggcggcttcctggtgctgagcaaccagaaccaccagtgggaccaggtgggcagattcttcagcgaggtggacgccaacctgatgctggccctgtacaacaacagcttctacaccagaaaggagagctacgactaccaggccgcctgcgccccccagccccccggcaacctgggcgccgcccccagaggcgtgttcgtgcccaccgtggccgacttcctgaacctggcctggtggaccagcgccgccgcctggagcctgttccagcagctgctgtacggcctgatctaccacagctggttccaggccgaccccgccgaggccgagggcagccccgagaccagagagagcagctgcgtgatgaagcagacccagtactacttcggcagcgtgaacgccagctacaacgccatcatcgactgcggcaactgcagcagactgttccacgcccagagactgaccaacaccaacctgctgttcgtggtggccgagaagcccctgtgcagccagtgcgaggccggcagactgctgcagaaggagacccacagcgacggccccgagcagtgcgagctggtgcagagacccagatacagaagaggcccccacatctgcttcgactacaacgccaccgaggacaccagcgactgcggcagaggcgccagcttcccccccagcctgggcgtgctggtgagcctgcagctgctgctgctgctgggcctgccccccagaccccagccccaggtgctggtgcacgccagcagaagactgtag

SEQ ID NO: 74971 - DNA, 3276 bp, Artificial Sequence
  Description of Artificial Sequence: Synthetic coding sequence
atggccggccccggcagccccagaagagccagcagaggcgccagcgccctgctggccgccgccctgctgtacgccgccctgggcgacgtggtgagaagcgagcagcagatccccctgagcgtggtgaagctgtgggccagcgccttcggcggcgagatcaagagcatcgccgccaagtacagcggcagccagctgctgcagaagaagtacaaggagtacgagaaggacgtggccatcgaggagatcgacggcctgcagctggtgaagaagctggccaagaacatggaggagatgttccacaagaagagcgaggccgtgagaagactggtggaggccgccgaggaggcccacctgaagcacgagttcgacgccgacctgcagtacgagtacttcaacgccgtgctgatcaacgagagagacaaggacggcaacttcctggagctgggcaaggagttcatcctggcccccaacgaccacttcaacaacctgcccgtgaacatcagcctgagcgacgtgcaggtgcccaccaacatgtacaacaaggaccccgccatcgtgaacggcgtgtactggagcgagagcctgaacaaggtgttcgtggacaacttcgacagagaccccagcctgatctggcagtacttcggcagcgccaagggcttcttcagacagtaccccggcatcaagtgggagcccgacgagaacggcgtgatcgccttcgactgcagaaacagaaagtggtacatccaggccgccaccagccccaaggacgtggtgatcctggtggacgtgagcggcagcatgaagggcctgagactgaccatcgccaagcagaccgtgagcagcatcctggacaccctgggcgacgacgacttcttcaacatcatcgcctacaacgaggagctgcactacgtggagccctgcctgaacggcaccctggtgcaggccgacagaaccaacaaggagcacttcagagagcacctggacaagctgttcgccaagggcatcggcatgctggacatcgccctgaacgaggccttcaacatcctgagcgacttcaaccacaccggccagggcagcatctgcagccaggccatcatgctgatcaccgacggcgccgtggacacctacgacaccatcttcgccaagtacaactggcccgacagaaaggtgagaatcttcacctacctgatcggcagagaggccgccttcgccgacaacctgaagtggatggcctgcgccaacaagggcttcttcacccagatcagcaccctggccgacgtgcaggagaacgtgatggagtacctgcacgtgctgagcagacccaaggtgatcgaccaggagcacgacgtggtgtggaccgaggcctacatcgacagcaccctgccccaggcccagaagctgaccgacgaccagggccccgtgctgatgaccaccgtggccatgcccgtgttcagcaagcagaacgagaccagaagcaagggcatcctgctgggcgtggtgggcaccgacgtgcccgtgaaggagctgctgaagaccatccccaagtacaagctgggcatccacggctacgccttcgccatcaccaacaacggctacatcctgacccaccccgagctgagactgctgtacgaggagggcaagaagagaagaaagcccaactacagcagcgtggacctgagcgaggtggagtgggaggacagagacgacgtgctgagaaacgccatggtgaacagaaagaccggcaagttcagcatggaggtgaagaagaccgtggacaagggcaagagagtgctggtgatgaccaacgactactactacaccgacatcaagggcacccccttcagcctgggcgtggccctgagcagaggccacggcaagtacttcttcagaggcaacgtgaccatcgaggagggcctgcacgacctggagcaccccgacgtgagcctggccgacgagtggagctactgcaacaccgacctgcaccccgagcacagacacctgagccagctggaggccatcaagctgtacctgaagggcaaggagcccctgctgcagtgcgacaaggagctgatccaggaggtgctgttcgacgccgtggtgagcgcccccatcgaggcctactggaccagcctggccctgaacaagagcgagaacagcgacaagggcgtggaggtggccttcctgggcaccagaaccggcctgagcagaatcaacctgttcgtgggcgccgagcagctgaccaaccaggacttcctgaaggccggcgacaaggagaacatcttcaacgccgaccacttccccctgtggtacagaagagccgccgagcagatccccggcagcttcgtgtacagcatccccttcagcaccggccccgtgaacaagagcaacgtggtgaccgccagcaccagcatccagctgctggacgagagaaagagccccgtggtggccgccgtgggcatccagatgaagctggagttcttccagagaaagttctggaccgccagcagacagtgcgccagcctggacggcaagtgcagcatcagctgcgacgacgagaccgtgaactgctacctgatcgacaacaacggcttcatcctggtgagcgaggactacacccagaccggcgacttcttcggcgagatcgagggcgccgtgatgaacaagctgctgaccatgggcagcttcaagagaatcaccctgtacgactaccaggccatgtgcagagccaacaaggagagcagcgacggcgcccacggcctgctggacccctacaacgccttcctgagcgccgtgaagtggatcatgaccgagctggtgctgttcctggtggagttcaacctgtgcagctggtggcacagcgacatgaccgccaaggcccagaagctgaagcagaccctggagccctgcgacaccgagtaccccgccttcgtgagcgagagaaccatcaaggagaccaccggcaacatcgcctgcgaggactgcagcaagagcttcgtgatccagcagatccccagcagcaacctgttcatggtggtggtggacagcagctgcctgtgcgagagcgtggcccccatcaccatggcccccatcgagatcagatacaacgagagcctgaagtgcgagagactgaaggcccagaagatcagaagaagacccgagagctgccacggcttccaccccgaggagaacgccagagagtgcggcggcgcccccagcctgcaggcccagaccgtgctgctgctgctgcccctgctgctgatgctgttcagcagatag

SEQ ID NO: 74972 - DNA, 2997 bp, Artificial Sequence
  Description of Artificial Sequence: Synthetic coding sequence
atgggcgagctgagacaggagagaagcaccgccctgcagagactggtggaggccgccgaggaggcccacctgaagcacgagttcgacgccgacctgcagtacgagtacttcaacgccgtgctgatcaacgagagagacaaggacggcaacttcctggagctgggcaaggagttcatcctggcccccaacgaccacttcaacaacctgcccgtgaacatcagcctgagcgacgtgcaggtgcccaccaacatgtacaacaaggaccccgccatcgtgaacggcgtgtactggagcgagagcctgaacaaggtgttcgtggacaacttcgacagagaccccagcctgatctggcagtacttcggcagcgccaagggcttcttcagacagtaccccggcatcaagtgggagcccgacgagaacggcgtgatcgccttcgactgcagaaacagaaagtggtacatccaggccgccaccagccccaaggacgtggtgatcctggtggacgtgagcggcagcatgaagggcctgagactgaccatcgccaagcagaccgtgagcagcatcctggacaccctgggcgacgacgacttcttcaacatcatcgcctacaacgaggagctgcactacgtggagccctgcctgaacggcaccctggtgcaggccgacagaaccaacaaggagcacttcagagagcacctggacaagctgttcgccaagggcatcggcatgctggacatcgccctgaacgaggccttcaacatcctgagcgacttcaaccacaccggccagggcagcatctgcagccaggccatcatgctgatcaccgacggcgccgtggacacctacgacaccatcttcgccaagtacaactggcccgacagaaaggtgagaatcttcacctacctgatcggcagagaggccgccttcgccgacaacctgaagtggatggcctgcgccaacaagggcttcttcacccagatcagcaccctggccgacgtgcaggagaacgtgatggagtacctgcacgtgctgagcagacccaaggtgatcgaccaggagcacgacgtggtgtggaccgaggcctacatcgacagcaccgtgagccaggccgagcagctgaccgacgaccagggccccgtgctgatgaccaccgtggccatgcccgtgttcagcaagcagaacgagaccagaagcaagggcatcctgctgggcgtggtgggcaccgacgtgcccgtgaaggagctgctgaagaccatccccaagtacaagctgggcatccacggctacgccttcgccatcaccaacaacggctacatcctgacccaccccgagctgagactgctgtacgaggagggcaagaagagaagaaagcccaactacagcagcgtggacctgagcgaggtggagtgggaggacagagacgacgtgctgagaaacgccatggtgaacagaaagaccggcaagttcagcatggaggtgaagaagaccgtggacaagggcaagagagtgctggtgatgaccaacgactactactacaccgacatcaagggcacccccttcagcctgggcgtggccctgagcagaggccacggcaagtacttcttcagaggcaacgtgaccatcgaggagggcctgcacgacctggagcaccccgacgtgagcctggccgacgagtggagctactgcaacaccgacctgcaccccgagcacagacacctgagccagctggaggccatcaagctgtacctgaagggcaaggagcccctgctgcagtgcgacaaggagctgatccaggaggtgctgttcgacgccgtggtgagcgcccccatcgaggcctactggaccagcctggccctgaacaagagcgagaacagcgacaagggcgtggaggtggccttcctgggcaccagaaccggcctgagcagaatcaacctgttcgtgggcgccgagcagctgaccaaccaggacttcctgaaggccggcgacaaggagaacatcttcaacgccgaccacttccccctgtggtacagaagagccgccgagcagatccccggcagcttcgtgtacagcatccccttcagcaccggccccgtgaacaagagcaacgtggtgaccgccagcaccagcatccagctgctggacgagagaaagagccccgtggtggccgccgtgggcatccagatgaagctggagttcttccagagaaagttctggaccgccagcagacagtgcgccagcctggacggcaagtgcagcatcagctgcgacgacgagaccgtgaactgctacctgatcgacaacaacggcttcatcctggtgagcgaggactacacccagaccggcgacttcttcggcgagatcgagggcgccgtgatgaacaagctgctgaccatgggcagcttcaagagaatcaccctgtacgactaccaggccatgtgcagagccaacaaggagagcagcgacggcgcccacggcctgctggacccctacaacgccttcctgagcgccgtgaagtggatcatgaccgagctggtgctgttcctggtggagttcaacctgtgcagctggtggcacagcgacatgaccgccaaggcccagaagctgaagcagaccctggagccctgcgacaccgagtaccccgccttcgtgagcgagagaaccatcaaggagaccaccggcaacatcgcctgcgaggactgcagcaagagcttcgtgatccagcagatccccagcagcaacctgttcatggtggtggtggacagcagctgcctgtgcgagagcgtggcccccatcaccatggcccccatcgagatcagccagcacaacgagagcctgaagtgcgagagactgaaggcccagaagatcagaagaagacccgagagctgccacggcttccaccccgaggagaacgccagagagtgcggcggcgcccccagcctgcaggcccagaccgtgctgctgctgctgcccctgctgctgatgctgttcagcagatag

SEQ ID NO: 74973 - DNA, 3276 bp, Artificial Sequence; identical to SEQ ID NO: 74971
  Description of Artificial Sequence: Synthetic coding sequence

SEQ ID NO: 74974 - DNA, 1557 bp, Artificial Sequence
  Description of Artificial Sequence: Synthetic coding sequence
gagatcctgttccaccagatgcagaaccagatcaagagactggtggaggccgccgaggaggcccacctgaagcacgagttcgacgccgacctgcagtacgagtacttcaacgccgtgctgatcaacgagagagacaaggacggcaacttcctggagctgggcaaggagttcatcctggcccccaacgaccacttcaacaacctgcccgtgaacatcagcctgagcgacgtgcaggtgcccaccaacatgtacaacaaggaccccgccatcgtgaacggcgtgtactggagcgagagcctgaacaaggtgttcgtggacaacttcgacagagaccccagcctgatctggcagtacttcggcagcgccaagggcttcttcagacagtaccccggcatcaagtgggagcccgacgagaacggcgtgatcgccttcgactgcagaaacagaaagtggtacatccaggccgccaccagccccaaggacgtggtgatcctggtggacgtgagcggcagcatgaagggcctgagactgaccatcgccaagcagaccgtgagcagcatcctggacaccctgggcgacgacgacttcttcaacatcatcgcctacaacgaggagctgcactacgtggagccctgcctgaacggcaccctggtgcaggccgacagaaccaacaaggagcacttcagagagcacctggacaagctgttcgccaagggcatcggcatgctggacatcgccctgaacgaggccttcaacatcctgagcgacttcaaccacaccggccagggcagcatctgcagccaggccatcatgctgatcaccgacggcgccgtggacacctacgacaccatcttcgccaagtacaactggcccgacagaaaggtgagaatcttcacctacctgatcggcagagaggccgccttcgccgacaacctgaagtggatggcctgcgccaacaagggcttcttcacccagatcagcaccctggccgacgtgcaggagaacgtgatggagtacctgcacgtgctgagcagacccaaggtgatcgaccaggagcacgacgtggtgtggaccgaggcctacatcgacagcaccctgaccgacgaccagggccccgtgctgatgaccaccgtggccatgcccgtgttcagcaagcagaacgagaccagaagcaagggcatcctgctgggcgtggtgggcaccgacgtgcccgtgaaggagctgctgaagaccatccccaagtacaagctgggcatccacggctacgccttcgccatcaccaacaacggctacatcctgacccaccccgagctgagactgctgtacgaggagggcaagaagagaagaaagcccaactacagcagcgtggacctgagcgaggtggagtgggaggacagagacgacgtgctgagaaacgccatggtgaacagaaagaccggcaagttcagcatggaggtgaagaagaccgtggacaagggcttcagatgcggcgccttccagagaagctgggagatcttcctgcccagagagtgcaaccacagaagaagacccgcctag

SEQ ID NO: 74975 - DNA, 3276 bp, Artificial Sequence; identical to SEQ ID NO: 74971
  Description of Artificial Sequence: Synthetic coding sequence

SEQ ID NO: 74976 - DNA, 1578 bp, Artificial Sequence
  Description of Artificial Sequence: Synthetic coding sequence
atggaggagatgttccacaagaagagcgaggccgtgagaagactggtggaggccgccgaggaggcccacctgaagcacgagttcgacgccgacctgcagtacgagtacttcaacgccgtgctgatcaacgagagagacaaggacggcaacttcctggagctgggcaaggagttcatcctggcccccaacgaccacttcaacaacctgcccgtgaacatcagcctgagcgacgtgcaggtgcccaccaacatgtacaacaaggaccccgccatcgtgaacggcgtgtactggagcgagagcctgaacaaggtgttcgtggacaacttcgacagagaccccagcctgatctggcagtacttcggcagcgccaagggcttcttcagacagtaccccggcatcaagtgggagcccgacgagaacggcgtgatcgccttcgactgcagaaacagaaagtggtacatccaggccgccaccagccccaaggacgtggtgatcctggtggacgtgagcggcagcatgaagggcctgagactgaccatcgccaagcagaccgtgagcagcatcctggacaccctgggcgacgacgacttcttcaacatcatcgcctacaacgaggagctgcactacgtggagccctgcctgaacggcaccctggtgcaggccgacagaaccaacaaggagcacttcagagagcacctggacaagctgttcgccaagggcatcggcatgctggacatcgccctgaacgaggccttcaacatcctgagcgacttcaaccacaccggccagggcagcatctgcagccaggccatcatgctgatcaccgacggcgccgtggacacctacgacaccatcttcgccaagtacaactggcccgacagaaaggtgagaatcttcacctacctgatcggcagagaggccgccttcgccgacaacctgaagtggatggcctgcgccaacaagggcttcttcacccagatcagcaccctggccgacgtgcaggagaacgtgatggagtacctgcacgtgctgagcagacccaaggtgatcgaccaggagcacgacgtggtgtggaccgaggcctacatcgacagcaccctgccccaggcccagaagctgaccgacgaccagggccccgtgctgatgaccaccgtggccatgcccgtgttcagcaagcagaacgagaccagaagcaagggcatcctgctgggcgtggtgggcaccgacgtgcccgtgaaggagctgctgaagaccatccccaagtacaagctgggcatccacggctacgccttcgccatcaccaacaacggctacatcctgacccaccccgagctgagactgctgtacgaggagggcaagaagagaagaaagcccaactacagcagcgtggacctgagcgaggtggagtgggaggacagagacgacgtgctgagaaacgccatggtgaacagaaagaccggcaagttcagcatggaggtgaagaagaccgtggacaagggcttcagatgcggcgccttccagagaagctgggagatcttcctgcccagagagtgcaaccacagaagaagacccgcctag

SEQ ID NO: 74977 - DNA, 2994 bp, Artificial Sequence
  Description of Artificial Sequence: Synthetic coding sequence
atggaggagatgttccacaagaagagcgaggccgtgagaagactggtggaggccgccgaggaggcccacctgaagcacgagttcgacgccgacctgcagtacgagtacttcaacgccgtgctgatcaacgagagagacaaggacggcaacttcctggagctgggcaaggagttcatcctggcccccaacgaccacttcaacaacctgcccgtgaacatcagcctgagcgacgtgcaggtgcccaccaacatgtacaacaaggaccccgccatcgtgaacggcgtgtactggagcgagagcctgaacaaggtgttcgtggacaacttcgacagagaccccagcctgatctggcagtacttcggcagcgccaagggcttcttcagacagtaccccggcatcaagtgggagcccgacgagaacggcgtgatcgccttcgactgcagaaacagaaagtggtacatccaggccgccaccagccccaaggacgtggtgatcctggtggacgtgagcggcagcatgaagggcctgagactgaccatcgccaagcagaccgtgagcagcatcctggacaccctgggcgacgacgacttcttcaacatcatcgcctacaacgaggagctgcactacgtggagccctgcctgaacggcaccctggtgcaggccgacagaaccaacaaggagcacttcagagagcacctggacaagctgttcgccaagggcatcggcatgctggacatcgccctgaacgaggccttcaacatcctgagcgacttcaaccacaccggccagggcagcatctgcagccaggccatcatgctgatcaccgacggcgccgtggacacctacgacaccatcttcgccaagtacaactggcccgacagaaaggtgagaatcttcacctacctgatcggcagagaggccgccttcgccgacaacctgaagtggatggcctgcgccaacaagggcttcttcacccagatcagcaccctggccgacgtgcaggagaacgtgatggagtacctgcacgtgctgagcagacccaaggtgatcgaccaggagcacgacgtggtgtggaccgaggcctacatcgacagcaccctgccccaggcccagaagctgaccgacgaccagggccccgtgctgatgaccaccgtggccatgcccgtgttcagcaagcagaacgagaccagaagcaagggcatcctgctgggcgtggtgggcaccgacgtgcccgtgaaggagctgctgaagaccatccccaagtacaagctgggcatccacggctacgccttcgccatcaccaacaacggctacatcctgacccaccccgagctgagactgctgtacgaggagggcaagaagagaagaaagcccaactacagcagcgtggacctgagcgaggtggagtgggaggacagagacgacgtgctgagaaacgccatggtgaacagaaagaccggcaagttcagcatggaggtgaagaagaccgtggacaagggcaagagagtgctggtgatgaccaacgactactactacaccgacatcaagggcacccccttcagcctgggcgtggccctgagcagaggccacggcaagtacttcttcagaggcaacgtgaccatcgaggagggcctgcacgacctggagcaccccgacgtgagcctggccgacgagtggagctactgcaacaccgacctgcaccccgagcacagacacctgagccagctggaggccatcaagctgtacctgaagggcaaggagcccctgctgcagtgcgacaaggagctgatccaggaggtgctgttcgacgccgtggtgagcgcccccatcgaggcctactggaccagcctggccctgaacaagagcgagaacagcgacaagggcgtggaggtggccttcctgggcaccagaaccggcctgagcagaatcaacctgttcgtgggcgccgagcagctgaccaaccaggacttcctgaaggccggcgacaaggagaacatcttcaacgccgaccacttccccctgtggtacagaagagccgccgagcagatccccggcagcttcgtgtacagcatccccttcagcaccggccccgtgaacaagagcaacgtggtgaccgccagcaccagcatccagctgctggacgagagaaagagccccgtggtggccgccgtgggcatccagatgaagctggagttcttccagagaaagttctggaccgccagcagacagtgcgccagcctggacggcaagtgcagcatcagctgcgacgacgagaccgtgaactgctacctgatcgacaacaacggcttcatcctggtgagcgaggactacacccagaccggcgacttcttcggcgagatcgagggcgccgtgatgaacaagctgctgaccatgggcagcttcaagagaatcaccctgtacgactaccaggccatgtgcagagccaacaaggagagcagcgacggcgcccacggcctgctggacccctacaacgccttcctgagcgccgtgaagtggatcatgaccgagctggtgctgttcctggtggagttcaacctgtgcagctggtggcacagcgacatgaccgccaaggcccagaagctgaagcagaccctggagccctgcgacaccgagtaccccgccttcgtgagcgagagaaccatcaaggagaccaccggcaacatcgcctgcgaggactgcagcaagagcttcgtgatccagcagatccccagcagcaacctgttcatggtggtggtggacagcagctgcctgtgcgagagcgtggcccccatcaccatggcccccatcgagatcagatacaacgagagcctgaagtgcgagagactgaaggcccagaagatcagaagaagacccgagagctgccacggcttccaccccgaggagaacgccagagagtgcggcggcgcccccagcctgcaggcccagaccgtgctgctgctgctgcccctgctgctgatgctgttcagcagatag

SEQ ID NO: 74978 - DNA, 381 bp, Artificial Sequence
  Description of Artificial Sequence: Synthetic coding sequence
atggaggagatgttccacaagaagagcgaggccgtgagaagactggtggaggccgccgaggaggcccacctgaagcacgagttcgacgccgacctgcagtacgagtacttcaacgccgtgctgatcaacgagagagacaaggacggcaacttcctggagctgggcaaggagttcatcctggcccccaacgaccacttcaacaacctgcccgtgaacatcagcctgagcgacgtgcaggtgcccaccaacatgtacaacaaggaccccgccatcgtgaacggcgtgtactggagcgagagcctgaacaaggtgttcgtggacaacttcgacagagaccccagcctgatctggcagtacttcggcagcgccaagggcttctag

SEQ ID NO: 74979 - DNA, 2925 bp, Artificial Sequence
  Description of Artificial Sequence: Synthetic coding sequence
atggtgtgcggctgcagcgccctgctgcccctgcccaaccccagacccaccatgcccgccacccccaacttcctggccaaccccagcagcagcagcagatggatccccctgcagcccatgcccgtggcctgggccttcgtgcagaagaccagcgccctgctgtggctgctgctgctgggcaccagcctgagccccgcctggggccaggccaagatccccctggagaccgtgaagctgtgggccgacaccttcggcggcgacctgtacaacaccgtgaccaagtacagcggcagcctgctgctgcagaagaagtacaaggacgtggagagcagcctgaagatcgaggaggtggacggcctggagctggtgagaaagttcagcgaggacatggagaacatgctgagaagaaaggtggaggccgtgcagaacctggtggaggccgccgaggaggccgacctgaaccacgagttcaacgagagcctggtgttcgactactacaacagcgtgctgatcaacgagagagacgagaagggcaacttcgtggagctgggcgccgagttcctgctggagagcaacgcccacttcagcaacctgcccgtgaacaccagcatcagcagcgtgcagctgcccaccaacgtgtacaacaaggaccccgacatcctgaacggcgtgtacatgagcgaggccctgaacgccgtgttcgtggagaacttccagagagaccccaccctgacctggcagtacttcggcagcgccaccggcttcttcagaatctaccccggcatcaagtggacccccgacgagaacggcgtgatcaccttcgactgcagaaacagaggctggtacatccaggccgccaccagccccaaggacatcgtgatcctggtggacgtgagcggcagcatgaagggcctgagaatgaccatcgccaagcacaccatcaccaccatcctggacaccctgggcgagaacgacttcatcaacatcatcgcctacaacgactacgtgcactacatcgagccctgcttcaagggcatcctggtgcaggccgacagagacaacagagagcacttcaagctgctggtggaggagctgatggtgaagggcgtgggcgtggtggaccaggccctgagagaggccttccagatcctgaagcagttccaggaggccaagcagggcagcctgtgcaaccaggccatcatgctgatcagcgacggcgccgtggaggactacgagcccgtgttcgagaagtacaactggcccgactgcaaggtgagagtgttcacctacctgatcggcagagaggtgagcttcgccgacagaatgaagtggatcgcctgcaacaacaagggctactacacccagatcagcaccctggccgacacccaggagaacgtgatggagtacctgcacgtgctgagcagacccatggtgatcaaccacgaccacgacatcatctggaccgaggcctacatggacagcaagctgctgagcagccaggcccagagcctgaccctgctgaccaccgtggccatgcccgtgttcagcaagaagaacgagaccagaagccacggcatcctgctgggcgtggtgggcagcgacgtggccctgagagagctgatgaagctggcccccagatacaagctgggcgtgcacggctacgccttcctgaacaccaacaacggctacatcctgagccaccccgacctgagacccctgtacagagagggcaagaagctgaagcccaagcccaactacaacagcgtggacctgagcgaggtggagtgggaggaccaggccgagagcctgagaaccgccatgatcaacagagagaccggcaccctgagcatggacgtgaaggtgcccatggacaagggcaagagagtgctgttcctgaccaacgactacttcttcaccgacatcagcgacacccccttcagcctgggcgtggtgctgagcagaggccacggcgagtacatcctgctgggcaacaccagcgtggaggagggcctgcacgacctgctgcaccccgacctggccctggccggcgactggatctactgcatcaccgacatcgaccccgaccacagaaagctgagccagctggaggccatgatcagattcctgaccagaaaggaccccgacctggagtgcgacgaggagctggtgagagaggtgctgttcgacgccgtggtgaccgcccccatggaggcctactggaccgccctggccctgaacatgagcgaggagagcgagcacgtggtggacatggccttcctgggcaccagagccggcctgctgagaagcagcctgttcgtgggcagcgagaaggtgagcgacagaaagttcctgacccccgaggacgaggccagcgtgttcaccctggacagattccccctgtggtacagacaggccagcgagcaccccgccggcagcttcgtgttcaacctgagatgggccgagggccccgagagcgccggcgagcccatggtggtgaccgccagcaccgccgtggccgtgaccgtggacaagagaaccgccatcgccgccgccgccggcgtgcagatgaagctggagttcctgcagagaaagttctgggccgccaccagacagtgcagcaccgtggacggcccctgcacccagagctgcgaggacagcgacctggactgcttcgtgatcgacaacaacggcttcatcctgatcagcaagagaagcagagagaccggcagattcctgggcgaggtggacggcgccgtgctgacccagctgctgagcatgggcgtgttcagccaggtgaccatgtacgactaccaggccatgtgcaagcccagcagccaccaccacagcgccgcccagcccctggtgagccccatcagcgccttcctgaccgccaccagatggctgctgcaggagctggtgctgtag

SEQ ID NO: 74980 - DNA, 3414 bp, Artificial Sequence
  Description of Artificial Sequence: Synthetic coding sequence
atggtgtgcggctgcagcgccctgctgcccctgcccaaccccagacccaccatgcccgccacccccaacttcctggccaaccccagcagcagcagcagatggatccccctgcagcccatgcccgtggcctgggccttcgtgcagaagaccagcgccctgctgtggctgctgctgctgggcaccagcctgagccccgcctggggccaggccaagatccccctggagaccgtgaagctgtgggccgacaccttcggcggcgacctgtacaacaccgtgaccaagtacagcggcagcctgctgctgcagaagaagtacaaggacgtggagagcagcctgaagatcgaggaggtggacggcctggagctggtgagaaagttcagcgaggacatggagaacatgctgagaagaaaggtggaggccgtgcagaacctggtggaggccgccgaggaggccgacctgaaccacgagttcaacgagagcctggtgttcgactactacaacagcgtgctgatcaacgagagagacgagaagggcaacttcgtggagctgggcgccgagttcctgctggagagcaacgcccacttcagcaacctgcccgtgaacaccagcatcagcagcgtgcagctgcccaccaacgtgtacaacaaggaccccgacatcctgaacggcgtgtacatgagcgaggccctgaacgccgtgttcgtggagaacttccagagagaccccaccctgacctggcagtacttcggcagcgccaccggcttcttcagaatctaccccggcatcaagtggacccccgacgagaacggcgtgatcaccttcgactgcagaaacagaggctggtacatccaggccgccaccagccccaaggacatcgtgatcctggtggacgtgagcggcagcatgaagggcctgagaatgaccatcgccaagcacaccatcaccaccatcctggacaccctgggcgagaacgacttcatcaacatcatcgcctacaacgactacgtgcactacatcgagccctgcttcaagggcatcctggtgcaggccgacagagacaacagagagcacttcaagctgctggtggaggagctgatggtgaagggcgtgggcgtggtggaccaggccctgagagaggccttccagatcctgaagcagttccaggaggccaagcagggcagcctgtgcaaccaggccatcatgctgatcagcgacggcgccgtggaggactacgagcccgtgttcgagaagtacaactggcccgactgcaaggtgagagtgttcacctacctgatcggcagagaggtgagcttcgccgacagaatgaagtggatcgcctgcaacaacaagggctactacacccagatcagcaccctggccgacacccaggagaacgtgatggagtacctgcacgtgctgagcagacccatggtgatcaaccacgaccacgacatcatctggaccgaggcctacatggacagcaagctgctgagcagccaggcccagagcctgaccctgctgaccaccgtggccatgcccgtgttcagcaagaagaacgagaccagaagccacggcatcctgctgggcgtggtgggcagcgacgtggccctgagagagctgatgaagctggcccccagatacaagctgggcgtgcacggctacgccttcctgaacaccaacaacggctacatcctgagccaccccgacctgagacccctgtacagagagggcaagaagctgaagcccaagcccaactacaacagcgtggacctgagcgaggtggagtgggaggaccaggccgagagcctgagaaccgccatgatcaacagagagaccggcaccctgagcatggacgtgaaggtgcccatggacaagggcaagagagtgctgttcctgaccaacgactacttcttcaccgacatcagcgacacccccttcagcctgggcgtggtgctgagcagaggccacggcgagtacatcctgctgggcaacaccagcgtggaggagggcctgcacgacctgctgcaccccgacctggccctggccggcgactggatctactgcatcaccgacatcgaccccgaccacagaaagctgagccagctggaggccatgatcagattcctgaccagaaaggaccccgacctggagtgcgacgaggagctggtgagagaggtgctgttcgacgccgtggtgaccgcccccatggaggcctactggaccgccctggccctgaacatgagcgaggagagcgagcacgtggtggacatggccttcctgggcaccagagccggcctgctgagaagcagcctgttcgtgggcagcgagaaggtgagcgacagaaagttcctgacccccgaggacgaggccagcgtgttcaccctggacagattccccctgtggtacagacaggccagcgagcaccccgccggcagcttcgtgttcaacctgagatgggccgagggccccgagagcgccggcgagcccatggtggtgaccgccagcaccgccgtggccgtgaccgtggacaagagaaccgccatcgccgccgccgccggcgtgcagatgaagctggagttcctgcagagaaagttctgggccgccaccagacagtgcagcaccgtggacggcccctgcacccagagctgcgaggacagcgacctggactgcttcgtgatcgacaacaacggcttcatcctgatcagcaagagaagcagagagaccggcagattcctgggcgaggtggacggcgccgtgctgacccagctgctgagcatgggcgtgttcagccaggtgaccatgtacgactaccaggccatgtgcaagcccagcagccaccaccacagcgccgcccagcccctggtgagccccatcagcgccttcctgaccgccaccagatggctgctgcaggagctggtgctgttcctgctggagtggagcgtgtggggcagctggtacgacagaggcgccgaggccaagagcgtgttccaccacagccacaagcacaagaagcaggaccccctgcagccctgcgacaccgagtaccccgtgttcgtgtaccagcccgccatcagagaggccaacggcatcgtggagtgcggcccctgccagaaggtgttcgtggtgcagcagatccccaacagcaacctgctgctgctggtgaccgaccccacctgcgactgcagcatcttcccccccgtgctgcaggaggccaccgaggtgaagtacaacgccagcgtgaagtgcgacagaatgagaagccagaagctgagaagaagacccgacagctgccacgccttccaccccgaggagaacgcccaggactgcggcggcgccagcgacaccagcgccagcccccccctgctgctgctgcccgtgtgcgcctggggcctgctgccccagctgctgagatag

SEQ ID NO: 74981 - DNA, 3222 bp, Artificial Sequence
  Description of Artificial Sequence: Synthetic coding sequence
atggccgtggccctgggcaccagaagaagagacagagtgaagctgtgggccgacaccttcggcggcgacctgtacaacaccgtgaccaagtacagcggcagcctgctgctgcagaagaagtacaaggacgtggagagcagcctgaagatcgaggaggtggacggcctggagctggtgagaaagttcagcgaggacatggagaacatgctgagaagaaaggtggaggccgtgcagaacctggtggaggccgccgaggaggccgacctgaaccacgagttcaacgagagcctggtgttcgactactacaacagcgtgctgatcaacgagagagacgagaagggcaacttcgtggagctgggcgccgagttcctgctggagagcaacgcccacttcagcaacctgcccgtgaacaccagcatcagcagcgtgcagctgcccaccaacgtgtacaacaaggaccccgacatcctgaacggcgtgtacatgagcgaggccctgaacgccgtgttcgtggagaacttccagagagaccccaccctgacctggcagtacttcggcagcgccaccggcttcttcagaatctaccccggcatcaagtggacccccgacgagaacggcgtgatcaccttcgactgcagaaacagaggctggtacatccaggccgccaccagccccaaggacatcgtgatcctggtggacgtgagcggcagcatgaagggcctgagaatgaccatcgccaagcacaccatcaccaccatcctggacaccctgggcgagaacgacttcatcaacatcatcgcctacaacgactacgtgcactacatcgagccctgcttcaagggcatcctggtgcaggccgacagagacaacagagagcacttcaagctgctggtggaggagctgatggtgaagggcgtgggcgtggtggaccaggccctgagagaggccttccagatcctgaagcagttccaggaggccaagcagggcagcctgtgcaaccaggccatcatgctgatcagcgacggcgccgtggaggactacgagcccgtgttcgagaagtacaactggcccgactgcaaggtgagagtgttcacctacctgatcggcagagaggtgagcttcgccgacagaatgaagtggatcgcctgcaacaacaagggctactacacccagatcagcaccctggccgacacccaggagaacgtgatggagtacctgcacgtgctgagcagacccatggtgatcaaccacgaccacgacatcatctggaccgaggcctacatggacagcaagctgctgagcagccaggcccagagcctgaccctgctgaccaccgtggccatgcccgtgttcagcaagaagaacgagaccagaagccacggcatcctgctgggcgtggtgggcagcgacgtggccctgagagagctgatgaagctggcccccagatacaagctgggcgtgcacggctacgccttcctgaacaccaacaacggctacatcctgagccaccccgacctgagacccctgtacagagagggcaagaagctgaagcccaagcccaactacaacagcgtggacctgagcgaggtggagtgggaggaccaggccgagagcctgagaaccgccatgatcaacagagagaccggcaccctgagcatggacgtgaaggtgcccatggacaagggcaagagagtgctgttcctgaccaacgactacttcttcaccgacatcagcgacacccccttcagcctgggcgtggtgctgagcagaggccacggcgagtacatcctgctgggcaacaccagcgtggaggagggcctgcacgacctgctgcaccccgacctggccctggccggcgactggatctactgcatcaccgacatcgaccccgaccacagaaagctgagccagctggaggccatgatcagattcctgaccagaaaggaccccgacctggagtgcgacgaggagctggtgagagaggtgctgttcgacgccgtggtgaccgcccccatggaggcctactggaccgccctggccctgaacatgagcgaggagagcgagcacgtggtggacatggccttcctgggcaccagagccggcctgctgagaagcagcctgttcgtgggcagcgagaaggtgagcgacagaaagttcctgacccccgaggacgaggccagcgtgttcaccctggacagattccccctgtggtacagacaggccagcgagcaccccgccggcagcttcgtgttcaacctgagatgggccgagggccccgagagcgccggcgagcccatggtggtgaccgccagcaccgccgtggccgtgaccgtggacaagagaaccgccatcgccgccgccgccggcgtgcagatgaagctggagttcctgcagagaaagttctgggccgccaccagacagtgcagcaccgtggacggcccctgcacccagagctgcgaggacagcgacctggactgcttcgtgatcgacaacaacggcttcatcctgatcagcaagagaagcagagagaccggcagattcctgggcgaggtggacggcgccgtgctgacccagctgctgagcatgggcgtgttcagccaggtgaccatgtacgactaccaggccatgtgcaagcccagcagccaccaccacagcgccgcccagcccctggtgagccccatcagcgccttcctgaccgccaccagatggctgctgcaggagctggtgctgttcctgctggagtggagcgtgtggggcagctggtacgacagaggcgccgaggccaagagcgtgttccaccacagccacaagcacaagaagcaggaccccctgcagccctgcgacaccgagtaccccgtgttcgtgtaccagcccgccatcagagaggccaacggcatcgtggagtgcggcccctgccagaaggtgttcgtggtgcagcagatccccaacagcaacctgctgctgctggtgaccgaccccacctgcgactgcagcatcttcccccccgtgctgcaggaggccaccgaggtgaagtacaacgccagcgtgaagtgcgacagaatgagaagccagaagctgagaagaagacccgacagctgccacgccttccaccccgaggagaacgcccaggactgcggcggcgccagcgacaccagcgccagcccccccctgctgctgctgcccgtgtgcgcctggggcctgctgccccagctgctgagatag

SEQ ID NO: 74982 - DNA, 615 bp, Artificial Sequence
  Description of Artificial Sequence: Synthetic coding sequence
atgtacgactaccaggccatgtgcaagcccagcagccaccaccacagcgccgcccagcccctggtgagccccatcagcgccttcctgaccgccaccagatggctgctgcaggagctggtgctgttcctgctggagtggagcgtgtggggcagctggtacgacagaggcgccgaggccaagagcgtgttccaccacagccacaagcacaagaagcaggaccccctgcagccctgcgacaccgagtaccccgtgttcgtgtaccagcccgccatcagagaggccaacggcatcgtggagtgcggcccctgccagaaggtgttcgtggtgcagcagatccccaacagcaacctgctgctgctggtgaccgaccccacctgcgactgcagcatcttcccccccgtgctgcaggaggccaccgaggtgaagtacaacgccagcgtgaagtgcgacagaatgagaagccagaagctgagaagaagacccgacagctgccacgccttccaccccgaggagaacgcccaggactgcggcggcgccagcgacaccagcgccagcccccccctgctgctgctgcccgtgtgcgcctggggcctgctgccccagctgctgagatag

SEQ ID NO: 74983 - DNA, 615 bp, Artificial Sequence; identical to SEQ ID NO: 74982
  Description of Artificial Sequence: Synthetic coding sequence

SEQ ID NO: 74984 - DNA, 804 bp, Artificial Sequence
  Description of Artificial Sequence: Synthetic coding sequence
atgaagctggagttcctgcagagaaagttctgggccgccaccagacaggacctggactgcttcgtgatcgacaacaacggcttcatcctgatcagcaagagaagcagagagaccggcagattcctgggcgaggtggacggcgccgtgctgacccagctgctgagcatgggcgtgttcagccaggtgaccatgtacgactaccaggccatgtgcaagcccagcagccaccaccacagcgccgcccagcccctggtgagccccatcagcgccttcctgaccgccaccagatggctgctgcaggagctggtgctgttcctgctggagtggagcgtgtggggcagctggtacgacagaggcgccgaggccaagagcgtgttccaccacagccacaagcacaagaagcaggaccccctgcagccctgcgacaccgagtaccccgtgttcgtgtaccagcccgccatcagagaggccaacggcatcgtggagtgcggcccctgccagaaggtgttcgtggtgcagcagatccccaacagcaacctgctgctgctggtgaccgaccccacctgcgactgcagcatcttcccccccgtgctgcaggaggccaccgaggtgaagtacaacgccagcgtgaagtgcgacagaatgagaagccagaagctgagaagaagacccgacagctgccacgccttccaccccgaggagaacgcccaggactgcggcggcgccagcgacaccagcgccagcccccccctgctgctgctgcccgtgtgcgcctggggcctgctgccccagctgctgagatag

SEQ ID NO: 74985 - DNA, 615 bp, Artificial Sequence; identical to SEQ ID NO: 74982
  Description of Artificial Sequence: Synthetic coding sequence

SEQ ID NO: 74986 - DNA, 1572 bp, Artificial Sequence
  Description of Artificial Sequence: Synthetic coding sequence
atggtgcagaagaccagcatgagcagaggcccctacccccccagccaggagatccccatggaggtgttcgaccccagcccccagggcaagtacagcaagagaaagggcagattcaagagaagcgacggcagcaccagcagcgacaccaccagcaacagcttcgtgagacagggcagcgccgagagctacaccagcagacccagcgacagcgacgtgagcctggaggaggacagagaggccctgagaaaggaggccgagagacaggccctggcccagctggagaaggccaagaccaagcccgtggccttcgccgtgagaaccaacgtgggctacaaccccagccccggcgacgaggtgcccgtgcagggcgtggccatcaccttcgagcccaaggacttcctgcacatcaaggagaagtacaacaacgactggtggatcggcagactggtgaaggagggctgcgaggtgggcttcatccccagccccgtgaagctggacagcctgagactgctgcaggagcagaagctgagacagaacagactgggcagcagcaagagcggcgacaacagcagcagcagcctgggcgacgtggtgaccggcaccagaagacccaccccccccgccagcggcaacgagatgaccaacctggccttcgagctggaccccctggagctggaggaggaggaggccgagctgggcgagcagagcggcagcgccaagaccagcgtgagcagcgtgaccaccccccccccccacggcaagagaatccccttcttcaagaagaccgagcacgtgcccccctacgacgtggtgcccagcatgagacccatcatcctggtgggccccagcctgaagggctacgaggtgaccgacatgatgcagaaggccctgttcgacttcctgaagcacagattcgacggcagaatcagcatcaccagagtgaccgccgacatcagcctggccaagagaagcgtgctgaacaaccccagcaagcacatcatcatcgagagaagcaacaccagaagcagcctggccgaggtgcagagcgagatcgagagaatcttcgagctggccagaaccctgcagctggtggccctggacgccgacaccatcaaccaccccgcccagctgagcaagaccagcctggcccccatcatcgtgtacatcaagatcaccagccccaaggtgctgcagagactgatcaagagcagaggcaagagccagagcaagcacctgaacgtgcagatcgccgccagcgagaagctggcccagtgcccccccgagatgttcgacatcatcctggacgagaaccagctggaggacgcctgcgagcacctggccgagtacctggaggcctactggaaggccacccacccccccagcagcaccccccccaaccccctgctgaacagaaccatggccaccgccgccctggccgccagccccgcccccgtgagcaacctgcaggtgcaggtgctgaccagcctgagaagaaacctgggcttctggggcggcctggagagcagccagagaggcagcgtggtgccccaggagcaggagcacgccatgtag

SEQ ID NO: 74987 - DNA, 1797 bp, Artificial Sequence
  Description of Artificial Sequence: Synthetic coding sequence
atggtgcagaagaccagcatgagcagaggcccctacccccccagccaggagatccccatggaggtgttcgaccccagcccccagggcaagtacagcaagagaaagggcagattcaagagaagcgacggcagcaccagcagcgacaccaccagcaacagcttcgtgagacagggcagcgccgagagctacaccagcagacccagcgacagcgacgtgagcctggaggaggacagagaggccctgagaaaggaggccgagagacaggccctggcccagctggagaaggccaagaccaagcccgtggccttcgccgtgagaaccaacgtgggctacaaccccagccccggcgacgaggtgcccgtgcagggcgtggccatcaccttcgagcccaaggacttcctgcacatcaaggagaagtacaacaacgactggtggatcggcagactggtgaaggagggctgcgaggtgggcttcatccccagccccgtgaagctggacagcctgagactgctgcaggagcagaagctgagacagaacagactgggcagcagcaagagcggcgacaacagcagcagcagcctgggcgacgtggtgaccggcaccagaagacccaccccccccgccagcgccaagcagaagcagaagagcaccgagcacgtgcccccctacgacgtggtgcccagcatgagacccatcatcctggtgggccccagcctgaagggctacgaggtgaccgacatgatgcagaaggccctgttcgacttcctgaagcacagattcgacggcagaatcagcatcaccagagtgaccgccgacatcagcctggccaagagaagcgtgctgaacaaccccagcaagcacatcatcatcgagagaagcaacaccagaagcagcctggccgaggtgcagagcgagatcgagagaatcttcgagctggccagaaccctgcagctggtggccctggacgccgacaccatcaaccaccccgcccagctgagcaagaccagcctggcccccatcatcgtgtacatcaagatcaccagccccaaggtgctgcagagactgatcaagagcagaggcaagagccagagcaagcacctgaacgtgcagatcgccgccagcgagaagctggcccagtgcccccccgagatgttcgacatcatcctggacgagaaccagctggaggacgcctgcgagcacctggccgagtacctggaggcctactggaaggccacccacccccccagcagcaccccccccaaccccctgctgaacagaaccatggccaccgccgccctggccgccagccccgcccccgtgagcaacctgcagggcccctacctggccagcggcgaccagcccctggagagagccaccggcgagcacgccagcatgcacgagtaccccggcgagctgggccagccccccggcctgtaccccagcagccacccccccggcagagccggcaccctgagagccctgagcagacaggacaccttcgacgccgacacccccggcagcagaaacagcgcctacaccgagctgggcgacagctgcgtggacatggagaccgaccccagcgagggccccggcctgggcgaccccgccggcggcggcaccccccccgccagacagggcagctgggaggacgaggaggaggactacgaggaggagctgaccgacaacagaaacagaggcagaaacaaggccagatactgcgccgagggcggcggccccgtgctgggcagaaacaagaacgagctggagggctggggcagaggcgtgtacatcagatag

SEQ ID NO: 74988 - DNA, 1437 bp, Artificial Sequence
  Description of Artificial Sequence: Synthetic coding sequence
atggtgcagaagaccagcatgagcagaggcccctacccccccagccaggagatccccatggaggtgttcgaccccagcccccagggcaagtacagcaagagaaagggcagattcaagagaagcgacggcagcaccagcagcgacaccaccagcaacagcttcgtgagacagggcagcgccgagagctacaccagcagacccagcgacagcgacgtgagcctggaggaggacagagaggccctgagaaaggaggccgagagacaggccctggcccagctggagaaggccaagaccaagcccgtggccttcgccgtgagaaccaacgtgggctacaaccccagccccggcgacgaggtgcccgtgcagggcgtggccatcaccttcgagcccaaggacttcctgcacatcaaggagaagtacaacaacgactggtggatcggcagactggtgaaggagggctgcgaggtgggcttcatccccagccccgtgaagctggacagcctgagactgctgcaggagcagaagctgagacagaacagactgggcagcagcaagagcggcgacaacagcagcagcagcctgggcgacgtggtgaccggcaccagaagacccaccccccccgccagcgccaagcagaagcagaagagcaccgagcacgtgcccccctacgacgtggtgcccagcatgagacccatcatcctggtgggccccagcctgaagggctacgaggtgaccgacatgatgcagaaggccctgttcgacttcctgaagcacagattcgacggcagaatcagcatcaccagagtgaccgccgacatcagcctggccaagagaagcgtgctgaacaaccccagcaagcacatcatcatcgagagaagcaacaccagaagcagcctggccgaggtgcagagcgagatcgagagaatcttcgagctggccagaaccctgcagctggtggccctggacgccgacaccatcaaccaccccgcccagctgagcaagaccagcctggcccccatcatcgtgtacatcaagatcaccagccccaaggtgctgcagagactgatcaagagcagaggcaagagccagagcaagcacctgaacgtgcagatcgccgccagcgagaagctggcccagtgcccccccgagatgttcgacatcatcctggacgagaaccagctggaggacgcctgcgagcacctggccgagtacctggaggcctactggaaggccacccacccccccagcagcaccccccccaaccccctgctgaacagaaccatggccaccgccgccctggccgccagccccgcccccgtgagcaacctgcaggtgcaggtgctgaccagcctgagaagaaacctgggcttctggggcggcctggagagcagccagagaggcagcgtggtgccccaggagcaggagcacgccatgtag

SEQ ID NO: 74989 - DNA, 1290 bp, Artificial Sequence
  Description of Artificial Sequence: Synthetic coding sequence
atggaggcccccagcagaaccgtggtggtgggcagcgccgagagctacaccagcagacccagcgacagcgacgtgagcctggaggaggacagagaggccctgagaaaggaggccgagagacaggccctggcccagctggagaaggccaagaccaagcccgtggccttcgccgtgagaaccaacgtgggctacaaccccagccccggcgacgaggtgcccgtgcagggcgtggccatcaccttcgagcccaaggacttcctgcacatcaaggagaagtacaacaacgactggtggatcggcagactggtgaaggagggctgcgaggtgggcttcatccccagccccgtgaagctggacagcctgagactgctgcaggagcagaagctgagacagaacagactgggcagcagcaagagcggcgacaacagcagcagcagcctgggcgacgtggtgaccggcaccagaagacccaccccccccgccagcgacagccccgtgcagaccgagcacgtgcccccctacgacgtggtgcccagcatgagacccatcatcctggtgggccccagcctgaagggctacgaggtgaccgacatgatgcagaaggccctgttcgacttcctgaagcacagattcgacggcagaatcagcatcaccagagtgaccgccgacatcagcctggccaagagaagcgtgctgaacaaccccagcaagcacatcatcatcgagagaagcaacaccagaagcagcctggccgaggtgcagagcgagatcgagagaatcttcgagctggccagaaccctgcagctggtggccctggacgccgacaccatcaaccaccccgcccagctgagcaagaccagcctggcccccatcatcgtgtacatcaagatcaccagccccaaggtgctgcagagactgatcaagagcagaggcaagagccagagcaagcacctgaacgtgcagatcgccgccagcgagaagctggcccagtgcccccccgagatgttcgacatcatcctggacgagaaccagctggaggacgcctgcgagcacctggccgagtacctggaggcctactggaaggccacccacccccccagcagcaccccccccaaccccctgctgaacagaaccatggccaccgccgccctggccgccagccccgcccccgtgagcaacctgcaggtgcaggtgctgaccagcctgagaagaaacctgggcttctggggcggcctggagagcagccagagaggcagcgtggtgccccaggagcaggagcacgccatgtag

SEQ ID NO: 74990 - DNA, 1647 bp, Artificial Sequence
  Description of Artificial Sequence: Synthetic coding sequence
agcggcagcctgtacttccagggcagcgccgagagctacaccagcagacccagcgacagcgacgtgagcctggaggaggacagagaggccctgagaaaggaggccgagagacaggccctggcccagctggagaaggccaagaccaagcccgtggccttcgccgtgagaaccaacgtgggctacaaccccagccccggcgacgaggtgcccgtgcagggcgtggccatcaccttcgagcccaaggacttcctgcacatcaaggagaagtacaacaacgactggtggatcggcagactggtgaaggagggctgcgaggtgggcttcatccccagccccgtgaagctggacagcctgagactgctgcaggagcagaagctgagacagaacagactgggcagcagcaagagcggcgacaacagcagcagcagcctgggcgacgtggtgaccggcaccagaagacccaccccccccgccagcggcaagagccacagacacgccaccgagcacgtgcccccctacgacgtggtgcccagcatgagacccatcatcctggtgggccccagcctgaagggctacgaggtgaccgacatgatgcagaaggccctgttcgacttcctgaagcacagattcgacggcagaatcagcatcaccagagtgaccgccgacatcagcctggccaagagaagcgtgctgaacaaccccagcaagcacatcatcatcgagagaagcaacaccagaagcagcctggccgaggtgcagagcgagatcgagagaatcttcgagctggccagaaccctgcagctggtggccctggacgccgacaccatcaaccaccccgcccagctgagcaagaccagcctggcccccatcatcgtgtacatcaagatcaccagccccaaggtgctgcagagactgatcaagagcagaggcaagagccagagcaagcacctgaacgtgcagatcgccgccagcgagaagctggcccagtgcccccccgagatgttcgacatcatcctggacgagaaccagctggaggacgcctgcgagcacctggccgagtacctggaggcctactggaaggccacccacccccccagcagcaccccccccaaccccctgctgaacagaaccatggccaccgccgccctggccgccagccccgcccccgtgagcaacctgcagggcccctacctggccagcggcgaccagcccctggagagagccaccggcgagcacgccagcatgcacgagtaccccggcgagctgggccagccccccggcctgtaccccagcagccacccccccggcagagccggcaccctgagagccctgagcagacaggacaccttcgacgccgacacccccggcagcagaaacagcgcctacaccgagctgggcgacagctgcgtggacatggagaccgaccccagcgagggccccggcctgggcgaccccgccggcggcggcaccccccccgccagacagggcagctgggaggacgaggaggaggactacgaggaggagctgaccgacaacagaaacagaggcagaaacaaggccagatactgcgccgagggcggcggccccgtgctgggcagaaacaagaacgagctggagggctggggcagaggcgtgtacatcagatag

SEQ ID NO: 74991 - DNA, 1899 bp, Artificial Sequence
  Description of Artificial Sequence: Synthetic coding sequence
atgaaccagggcagcggcctggacctgctgaagatcagctacggcaagggcgccagaagaaagaacagattcaagggcagcgacggcagcaccagcagcgacaccaccagcaacagcttcgtgagacagggcagcgccgacagctacaccagcagacccagcgacagcgacgtgagcctggaggaggacagagaggccgtgagaagagaggccgagagacaggcccaggcccagctggagaaggccaagaccaagcccgtggccttcgccgtgagaaccaacgtgagctacagcgccgcccacgaggacgacgtgcccgtgcccggcatggccatcagcttcgaggccaaggacttcctgcacgtgaaggagaagttcaacaacgactggtggatcggcagactggtgaaggagggctgcgagatcggcttcatccccagccccgtgaagctggagaacatgagactgcagcacgagcagagagccaagcagggcaagttctacagcagcaagagcggcggcaacagcagcagcagcctgggcgacatcgtgcccagcagcagaaagagcaccccccccagcagcgccatcgacatcgacgccaccggcctggacgccgaggagaacgacatccccgccaaccacagaagccccaagcccagcgccaacagcgtgaccagcccccacagcaaggagaagagaatgcccttcttcaagaagaccgagcacacccccccctacgacgtggtgcccagcatgagacccgtggtgctggtgggccccagcctgaagggctacgaggtgaccgacatgatgcagaaggccctgttcgacttcctgaagcacagattcgagggcagaatcagcatcaccagagtgaccgccgacatcagcctggccaagagaagcgtgctgaacaaccccagcaagcacgccatcatcgagagaagcaacaccagaagcagcctggccgaggtgcagagcgagatcgagagaatcttcgagctggccagaaccctgcagctggtggtgctggacgccgacaccatcaaccaccccgcccagctgagcaagaccagcctggcccccatcatcgtgtacgtgaagatcagcagccccaaggtgctgcagagactgatcaagagcagaggcaagagccaggccaagcacctgaacgtgcagatggtggccgccgacaagctggcccagtgcccccccgagctgttcgacgtgatcctggacgagaaccagctggaggacgcctgcgagcacctggccgactacctggaggcctactggaaggccacccacccccccagcagcagcctgcccaaccccctgctgagcagaaccctggccaccagcagcctgcccctgagccccaccctggccagcaacagccagggcagccagggcgaccagagaaccgacagaagcgcccccatcagaagcgccagccaggccgaggaggagcccagcgtggagcccgtgaagaagagccagcacagaagcagcagcagcgccccccaccacaaccacagaagcggcaccagcagaggcctgagcagacaggagaccttcgacagcgagacccaggagagcagagacagcgcctacgtggagcccaaggaggactacagccacgaccacgtggaccactacgccagccacagagaccacaaccacagagacgagacccacggcagcagcgaccacagacacagagagagcagacacagaagcagagacgtggacagagagcaggaccacaacgagtgcaacaagcagagaagcagacacaagagcaaggacagatactgcgagaaggacggcgaggtgatcagcaagaagagaaacgaggccggcgagtggaacagagacgtgtacatcagacagtag

SEQ ID NO: 74992 - DNA, 1983 bp, Artificial Sequence
  Description of Artificial Sequence: Synthetic coding sequence
atggtgcagagagacatgagcaagagcccccccaccgccgccgccgccgtggcccaggagatccagatggagctgctggagaacgtggcccccgccggcgccctgggcgccgccgcccagagctacggcaagggcgccagaagaaagaacagattcaagggcagcgacggcagcaccagcagcgacaccaccagcaacagcttcgtgagacagggcagcgccgacagctacaccagcagacccagcgacagcgacgtgagcctggaggaggacagagaggccgtgagaagagaggccgagagacaggcccaggcccagctggagaaggccaagaccaagcccgtggccttcgccgtgagaaccaacgtgagctacagcgccgcccacgaggacgacgtgcccgtgcccggcatggccatcagcttcgaggccaaggacttcctgcacgtgaaggagaagttcaacaacgactggtggatcggcagactggtgaaggagggctgcgagatcggcttcatccccagccccgtgaagctggagaacatgagactgcagcacgagcagagagccaagcagggcaagttctacagcagcaagagcggcggcaacagcagcagcagcctgggcgacatcgtgcccagcagcagaaagagcaccccccccagcagcgccatcgacatcgacgccaccggcctggacgccgaggagaacgacatccccgccaaccacagaagccccaagcccagcgccaacagcgtgaccagcccccacagcaaggagaagagaatgcccttcttcaagaagaccgagcacacccccccctacgacgtggtgcccagcatgagacccgtggtgctggtgggccccagcctgaagggctacgaggtgaccgacatgatgcagaaggccctgttcgacttcctgaagcacagattcgagggcagaatcagcatcaccagagtgaccgccgacatcagcctggccaagagaagcgtgctgaacaaccccagcaagcacgccatcatcgagagaagcaacaccagaagcagcctggccgaggtgcagagcgagatcgagagaatcttcgagctggccagaaccctgcagctggtggtgctggacgccgacaccatcaaccaccccgcccagctgagcaagaccagcctggcccccatcatcgtgtacgtgaagatcagcagccccaaggtgctgcagagactgatcaagagcagaggcaagagccaggccaagcacctgaacgtgcagatggtggccgccgacaagctggcccagtgcccccccgagctgttcgacgtgatcctggacgagaaccagctggaggacgcctgcgagcacctggccgactacctggaggcctactggaaggccacccacccccccagcagcagcctgcccaaccccctgctgagcagaaccctggccaccagcagcctgcccctgagccccaccctggccagcaacagccagggcagccagggcgaccagagaaccgacagaagcgcccccatcagaagcgccagccaggccgaggaggagcccagcgtggagcccgtgaagaagagccagcacagaagcagcagcagcgccccccaccacaaccacagaagcggcaccagcagaggcctgagcagacaggagaccttcgacagcgagacccaggagagcagagacagcgcctacgtggagcccaaggaggactacagccacgaccacgtggaccactacgccagccacagagaccacaaccacagagacgagacccacggcagcagcgaccacagacacagagagagcagacacagaagcagagacgtggacagagagcaggaccacaacgagtgcaacaagcagagaagcagacacaagagcaaggacagatactgcgagaaggacggcgaggtgatcagcaagaagagaaacgaggccggcgagtggaacagagacgtgtacatcagacagtag

SEQ ID NO: 74993 - DNA, 1911 bp, Artificial Sequence
  Description of Artificial Sequence: Synthetic coding sequence
atggtgcagagagacatgagcaagagcccccccaccgccgccgccgccgtggcccaggagatccagatggagctgctggagaacgtggcccccgccggcgccctgggcgccgccgcccagagctacggcaagggcgccagaagaaagaacagattcaagggcagcgacggcagcaccagcagcgacaccaccagcaacagcttcgtgagacagggcagcgccgacagctacaccagcagacccagcgacagcgacgtgagcctggaggaggacagagaggccgtgagaagagaggccgagagacaggcccaggcccagctggagaaggccaagaccaagcccgtggccttcgccgtgagaaccaacgtgagctacagcgccgcccacgaggacgacgtgcccgtgcccggcatggccatcagcttcgaggccaaggacttcctgcacgtgaaggagaagttcaacaacgactggtggatcggcagactggtgaaggagggctgcgagatcggcttcatccccagccccgtgaagctggagaacatgagactgcagcacgagcagagagccaagcagggcaagttctacagcagcaagagcggcggcaacagcagcagcagcctgggcgacatcgtgcccagcagcagaaagagcaccccccccagcagcggcgccaagagcgccgacgagcaggaccagtggaagaccgccggcctgttctggagattcaccaccgagcacacccccccctacgacgtggtgcccagcatgagacccgtggtgctggtgggccccagcctgaagggctacgaggtgaccgacatgatgcagaaggccctgttcgacttcctgaagcacagattcgagggcagaatcagcatcaccagagtgaccgccgacatcagcctggccaagagaagcgtgctgaacaaccccagcaagcacgccatcatcgagagaagcaacaccagaagcagcctggccgaggtgcagagcgagatcgagagaatcttcgagctggccagaaccctgcagctggtggtgctggacgccgacaccatcaaccaccccgcccagctgagcaagaccagcctggcccccatcatcgtgtacgtgaagatcagcagccccaaggtgctgcagagactgatcaagagcagaggcaagagccaggccaagcacctgaacgtgcagatggtggccgccgacaagctggcccagtgcccccccgagctgttcgacgtgatcctggacgagaaccagctggaggacgcctgcgagcacctggccgactacctggaggcctactggaaggccacccacccccccagcagcagcctgcccaaccccctgctgagcagaaccctggccaccagcagcctgcccctgagccccaccctggccagcaacagccagggcagccagggcgaccagagaaccgacagaagcgcccccatcagaagcgccagccaggccgaggaggagcccagcgtggagcccgtgaagaagagccagcacagaagcagcagcagcgccccccaccacaaccacagaagcggcaccagcagaggcctgagcagacaggagaccttcgacagcgagacccaggagagcagagacagcgcctacgtggagcccaaggaggactacagccacgaccacgtggaccactacgccagccacagagaccacaaccacagagacgagacccacggcagcagcgaccacagacacagagagagcagacacagaagcagagacgtggacagagagcaggaccacaacgagtgcaacaagcagagaagcagacacaagagcaaggacagatactgcgagaaggacggcgaggtgatcagcaagaagagaaacgaggccggcgagtggaacagagacgtgtacatcagacagtag

SEQ ID NO: 74994 - DNA, 1839 bp, Artificial Sequence
  Description of Artificial Sequence: Synthetic coding sequence
atgaaggccacctggatcagactgctgaagagagccaagggcggcagactgaagaacagcgacatctgcggcagcgccgacagctacaccagcagacccagcgacagcgacgtgagcctggaggaggacagagaggccgtgagaagagaggccgagagacaggcccaggcccagctggagaaggccaagaccaagcccgtggccttcgccgtgagaaccaacgtgagctacagcgccgcccacgaggacgacgtgcccgtgcccggcatggccatcagcttcgaggccaaggacttcctgcacgtgaaggagaagttcaacaacgactggtggatcggcagactggtgaaggagggctgcgagatcggcttcatccccagccccgtgaagctggagaacatgagactgcagcacgagcagagagccaagcagggcaagttctacagcagcaagagcggcggcaacagcagcagcagcctgggcgacatcgtgcccagcagcagaaagagcaccccccccagcagcgccatcgacatcgacgccaccggcctggacgccgaggagaacgacatccccgccaaccacagaagccccaagcccagcgccaacagcgtgaccagcccccacagcaaggagaagagaatgcccttcttcaagaagaccgagcacacccccccctacgacgtggtgcccagcatgagacccgtggtgctggtgggccccagcctgaagggctacgaggtgaccgacatgatgcagaaggccctgttcgacttcctgaagcacagattcgagggcagaatcagcatcaccagagtgaccgccgacatcagcctggccaagagaagcgtgctgaacaaccccagcaagcacgccatcatcgagagaagcaacaccagaagcagcctggccgaggtgcagagcgagatcgagagaatcttcgagctggccagaaccctgcagctggtggtgctggacgccgacaccatcaaccaccccgcccagctgagcaagaccagcctggcccccatcatcgtgtacgtgaagatcagcagccccaaggtgctgcagagactgatcaagagcagaggcaagagccaggccaagcacctgaacgtgcagatggtggccgccgacaagctggcccagtgcccccccgagctgttcgacgtgatcctggacgagaaccagctggaggacgcctgcgagcacctggccgactacctggaggcctactggaaggccacccacccccccagcagcagcctgcccaaccccctgctgagcagaaccctggccaccagcagcctgcccctgagccccaccctggccagcaacagccagggcagccagggcgaccagagaaccgacagaagcgcccccatcagaagcgccagccaggccgaggaggagcccagcgtggagcccgtgaagaagagccagcacagaagcagcagcagcgccccccaccacaaccacagaagcggcaccagcagaggcctgagcagacaggagaccttcgacagcgagacccaggagagcagagacagcgcctacgtggagcccaaggaggactacagccacgaccacgtggaccactacgccagccacagagaccacaaccacagagacgagacccacggcagcagcgaccacagacacagagagagcagacacagaagcagagacgtggacagagagcaggaccacaacgagtgcaacaagcagagaagcagacacaagagcaaggacagatactgcgagaaggacggcgaggtgatcagcaagaagagaaacgaggccggcgagtggaacagagacgtgtacatcagacagtag

SEQ ID NO: 74995 - DNA, 1704 bp, Artificial Sequence
  Description of Artificial Sequence: Synthetic coding sequence
atgcagtgctgcggcctggtgcacagaagaagagtgagagtgagctacggcagcgccgacagctacaccagcagacccagcgacagcgacgtgagcctggaggaggacagagaggccgtgagaagagaggccgagagacaggcccaggcccagctggagaaggccaagaccaagcccgtggccttcgccgtgagaaccaacgtgagctacagcgccgcccacgaggacgacgtgcccgtgcccggcatggccatcagcttcgaggccaaggacttcctgcacgtgaaggagaagttcaacaacgactggtggatcggcagactggtgaaggagggctgcgagatcggcttcatccccagccccgtgaagctggagaacatgagactgcagcacgagcagagagccaagcagggcaagttctacagcagcaagagcggcggcaacagcagcagcagcctgggcgacatcgtgcccagcagcagaaagagcaccccccccagcagcgccaagcagaagcagaagagcaccgagcacacccccccctacgacgtggtgcccagcatgagacccgtggtgctggtgggccccagcctgaagggctacgaggtgaccgacatgatgcagaaggccctgttcgacttcctgaagcacagattcgagggcagaatcagcatcaccagagtgaccgccgacatcagcctggccaagagaagcgtgctgaacaaccccagcaagcacgccatcatcgagagaagcaacaccagaagcagcctggccgaggtgcagagcgagatcgagagaatcttcgagctggccagaaccctgcagctggtggtgctggacgccgacaccatcaaccaccccgcccagctgagcaagaccagcctggcccccatcatcgtgtacgtgaagatcagcagccccaaggtgctgcagagactgatcaagagcagaggcaagagccaggccaagcacctgaacgtgcagatggtggccgccgacaagctggcccagtgcccccccgagctgttcgacgtgatcctggacgagaaccagctggaggacgcctgcgagcacctggccgactacctggaggcctactggaaggccacccacccccccagcagcagcctgcccaaccccctgctgagcagaaccctggccaccagcagcctgcccctgagccccaccctggccagcaacagccagggcagccagggcgaccagagaaccgacagaagcgcccccatcagaagcgccagccaggccgaggaggagcccagcgtggagcccgtgaagaagagccagcacagaagcagcagcagcgccccccaccacaaccacagaagcggcaccagcagaggcctgagcagacaggagaccttcgacagcgagacccaggagagcagagacagcgcctacgtggagcccaaggaggactacagccacgaccacgtggaccactacgccagccacagagaccacaaccacagagacgagacccacggcagcagcgaccacagacacagagagagcagacacagaagcagagacgtggacagagagcaggaccacaacgagtgcaacaagcagagaagcagacacaagagcaaggacagatactgcgagaaggacggcgaggtgatcagcaagaagagaaacgaggccggcgagtggaacagagacgtgtacatcagacagtag

SEQ ID NO: 74996 - DNA, 1821 bp, Artificial Sequence
  Description of Artificial Sequence: Synthetic coding sequence
atgctggacagaagactgatcgccccccagaccaagtacatcatccccggcggcagcgccgacagctacaccagcagacccagcgacagcgacgtgagcctggaggaggacagagaggccgtgagaagagaggccgagagacaggcccaggcccagctggagaaggccaagaccaagcccgtggccttcgccgtgagaaccaacgtgagctacagcgccgcccacgaggacgacgtgcccgtgcccggcatggccatcagcttcgaggccaaggacttcctgcacgtgaaggagaagttcaacaacgactggtggatcggcagactggtgaaggagggctgcgagatcggcttcatccccagccccgtgaagctggagaacatgagactgcagcacgagcagagagccaagcagggcaagttctacagcagcaagagcggcggcaacagcagcagcagcctgggcgacatcgtgcccagcagcagaaagagcaccccccccagcagcgccatcgacatcgacgccaccggcctggacgccgaggagaacgacatccccgccaaccacagaagccccaagcccagcgccaacagcgtgaccagcccccacagcaaggagaagagaatgcccttcttcaagaagaccgagcacacccccccctacgacgtggtgcccagcatgagacccgtggtgctggtgggccccagcctgaagggctacgaggtgaccgacatgatgcagaaggccctgttcgacttcctgaagcacagattcgagggcagaatcagcatcaccagagtgaccgccgacatcagcctggccaagagaagcgtgctgaacaaccccagcaagcacgccatcatcgagagaagcaacaccagaagcagcctggccgaggtgcagagcgagatcgagagaatcttcgagctggccagaaccctgcagctggtggtgctggacgccgacaccatcaaccaccccgcccagctgagcaagaccagcctggcccccatcatcgtgtacgtgaagatcagcagccccaaggtgctgcagagactgatcaagagcagaggcaagagccaggccaagcacctgaacgtgcagatggtggccgccgacaagctggcccagtgcccccccgagctgttcgacgtgatcctggacgagaaccagctggaggacgcctgcgagcacctggccgactacctggaggcctactggaaggccacccacccccccagcagcagcctgcccaaccccctgctgagcagaaccctggccaccagcagcctgcccctgagccccaccctggccagcaacagccagggcagccagggcgaccagagaaccgacagaagcgcccccatcagaagcgccagccaggccgaggaggagcccagcgtggagcccgtgaagaagagccagcacagaagcagcagcagcgccccccaccacaaccacagaagcggcaccagcagaggcctgagcagacaggagaccttcgacagcgagacccaggagagcagagacagcgcctacgtggagcccaaggaggactacagccacgaccacgtggaccactacgccagccacagagaccacaaccacagagacgagacccacggcagcagcgaccacagacacagagagagcagacacagaagcagagacgtggacagagagcaggaccacaacgagtgcaacaagcagagaagcagacacaagagcaaggacagatactgcgagaaggacggcgaggtgatcagcaagaagagaaacgaggccggcgagtggaacagagacgtgtacatcagacagtag

SEQ ID NO: 74997 - DNA, 1827 bp, Artificial Sequence
  Description of Artificial Sequence: Synthetic coding sequence
atgaaccagggcagcggcctggacctgctgaagatcagctacggcaagggcgccagaagaaagaacagattcaagggcagcgacggcagcaccagcagcgacaccaccagcaacagcttcgtgagacagggcagcgccgacagctacaccagcagacccagcgacagcgacgtgagcctggaggaggacagagaggccgtgagaagagaggccgagagacaggcccaggcccagctggagaaggccaagaccaagcccgtggccttcgccgtgagaaccaacgtgagctacagcgccgcccacgaggacgacgtgcccgtgcccggcatggccatcagcttcgaggccaaggacttcctgcacgtgaaggagaagttcaacaacgactggtggatcggcagactggtgaaggagggctgcgagatcggcttcatccccagccccgtgaagctggagaacatgagactgcagcacgagcagagagccaagcagggcaagttctacagcagcaagagcggcggcaacagcagcagcagcctgggcgacatcgtgcccagcagcagaaagagcaccccccccagcagcggcgccaagagcgccgacgagcaggaccagtggaagaccgccggcctgttctggagattcaccaccgagcacacccccccctacgacgtggtgcccagcatgagacccgtggtgctggtgggccccagcctgaagggctacgaggtgaccgacatgatgcagaaggccctgttcgacttcctgaagcacagattcgagggcagaatcagcatcaccagagtgaccgccgacatcagcctggccaagagaagcgtgctgaacaaccccagcaagcacgccatcatcgagagaagcaacaccagaagcagcctggccgaggtgcagagcgagatcgagagaatcttcgagctggccagaaccctgcagctggtggtgctggacgccgacaccatcaaccaccccgcccagctgagcaagaccagcctggcccccatcatcgtgtacgtgaagatcagcagccccaaggtgctgcagagactgatcaagagcagaggcaagagccaggccaagcacctgaacgtgcagatggtggccgccgacaagctggcccagtgcccccccgagctgttcgacgtgatcctggacgagaaccagctggaggacgcctgcgagcacctggccgactacctggaggcctactggaaggccacccacccccccagcagcagcctgcccaaccccctgctgagcagaaccctggccaccagcagcctgcccctgagccccaccctggccagcaacagccagggcagccagggcgaccagagaaccgacagaagcgcccccatcagaagcgccagccaggccgaggaggagcccagcgtggagcccgtgaagaagagccagcacagaagcagcagcagcgccccccaccacaaccacagaagcggcaccagcagaggcctgagcagacaggagaccttcgacagcgagacccaggagagcagagacagcgcctacgtggagcccaaggaggactacagccacgaccacgtggaccactacgccagccacagagaccacaaccacagagacgagacccacggcagcagcgaccacagacacagagagagcagacacagaagcagagacgtggacagagagcaggaccacaacgagtgcaacaagcagagaagcagacacaagagcaaggacagatactgcgagaaggacggcgaggtgatcagcaagaagagaaacgaggccggcgagtggaacagagacgtgtacatcagacagtag

SEQ ID NO: 74998 - DNA, 1818 bp, Artificial Sequence
  Description of Artificial Sequence: Synthetic coding sequence
atgcagtgctgcggcctggtgcacagaagaagagtgagagtgagctacggcagcgccgacagctacaccagcagacccagcgacagcgacgtgagcctggaggaggacagagaggccgtgagaagagaggccgagagacaggcccaggcccagctggagaaggccaagaccaagcccgtggccttcgccgtgagaaccaacgtgagctacagcgccgcccacgaggacgacgtgcccgtgcccggcatggccatcagcttcgaggccaaggacttcctgcacgtgaaggagaagttcaacaacgactggtggatcggcagactggtgaaggagggctgcgagatcggcttcatccccagccccgtgaagctggagaacatgagactgcagcacgagcagagagccaagcagggcaagttctacagcagcaagagcggcggcaacagcagcagcagcctgggcgacatcgtgcccagcagcagaaagagcaccccccccagcagcgccatcgacatcgacgccaccggcctggacgccgaggagaacgacatccccgccaaccacagaagccccaagcccagcgccaacagcgtgaccagcccccacagcaaggagaagagaatgcccttcttcaagaagaccgagcacacccccccctacgacgtggtgcccagcatgagacccgtggtgctggtgggccccagcctgaagggctacgaggtgaccgacatgatgcagaaggccctgttcgacttcctgaagcacagattcgagggcagaatcagcatcaccagagtgaccgccgacatcagcctggccaagagaagcgtgctgaacaaccccagcaagcacgccatcatcgagagaagcaacaccagaagcagcctggccgaggtgcagagcgagatcgagagaatcttcgagctggccagaaccctgcagctggtggtgctggacgccgacaccatcaaccaccccgcccagctgagcaagaccagcctggcccccatcatcgtgtacgtgaagatcagcagccccaaggtgctgcagagactgatcaagagcagaggcaagagccaggccaagcacctgaacgtgcagatggtggccgccgacaagctggcccagtgcccccccgagctgttcgacgtgatcctggacgagaaccagctggaggacgcctgcgagcacctggccgactacctggaggcctactggaaggccacccacccccccagcagcagcctgcccaaccccctgctgagcagaaccctggccaccagcagcctgcccctgagccccaccctggccagcaacagccagggcagccagggcgaccagagaaccgacagaagcgcccccatcagaagcgccagccaggccgaggaggagcccagcgtggagcccgtgaagaagagccagcacagaagcagcagcagcgccccccaccacaaccacagaagcggcaccagcagaggcctgagcagacaggagaccttcgacagcgagacccaggagagcagagacagcgcctacgtggagcccaaggaggactacagccacgaccacgtggaccactacgccagccacagagaccacaaccacagagacgagacccacggcagcagcgaccacagacacagagagagcagacacagaagcagagacgtggacagagagcaggaccacaacgagtgcaacaagcagagaagcagacacaagagcaaggacagatactgcgagaaggacggcgaggtgatcagcaagaagagaaacgaggccggcgagtggaacagagacgtgtacatcagacagtag

SEQ ID NO: 74999 - DNA, 1455 bp, Artificial Sequence
  Description of Artificial Sequence: Synthetic coding sequence
atgtacgacgacagctacgtgcccggcttcgaggacagcgaggccggcagcgccgacagctacaccagcagacccagcctggacagcgacgtgagcctggaggaggacagagagagcgccagaagagaggtggagagccaggcccagcagcagctggagagagccaagcacaagcccgtggccttcgccgtgagaaccaacgtgagctactgcggcgtgctggacgaggagtgccccgtgcagggcagcggcgtgaacttcgaggccaaggacttcctgcacatcaaggagaagtacagcaacgactggtggatcggcagactggtgaaggagggcggcgacatcgccttcatccccagcccccagagactggagagcatcagactgaagcaggagcagaaggccagaagaagcggcaaccccagcagcctgagcgacatcggcaacagaagaagccccccccccagcctggccaagcagaagcagaagcaggccgagcacgtgcccccctacgacgtggtgcccagcatgagacccgtggtgctggtgggccccagcctgaagggctacgaggtgaccgacatgatgcagaaggccctgttcgacttcctgaagcacagattcgacggcagaatcagcatcaccagagtgaccgccgacctgagcctggccaagagaagcgtgctgaacaaccccggcaagagaaccatcatcgagagaagcagcgccagaagcagcatcgccgaggtgcagagcgagatcgagagaatcttcgagctggccaagagcctgcagctggtggtgctggacgccgacaccatcaaccaccccgcccagctggccaagaccagcctggcccccatcatcgtgttcgtgaaggtgagcagccccaaggtgctgcagagactgatcagaagcagaggcaagagccagatgaagcacctgaccgtgcagatgatggcctacgacaagctggtgcagtgcccccccgagagcttcgacgtgatcctggacgagaaccagctggaggacgcctgcgagcacctggccgagtacctggaggtgtactggagagccacccaccaccccgcccccggccccggcctgctgggcccccccagcgccatccccggcctgcagaaccagcagctgctgggcgagagaggcgaggagcacagccccctggagagagacagcctgatgcccagcgacgaggccagcgagagcagcagacaggcctggaccggcagcagccagagaagcagcagacacctggaggaggactacgccgacgcctaccaggacctgtaccagccccacagacagcacaccagcggcctgcccagcgccaacggccacgacccccaggacagactgctggcccaggacagcgagcacaaccacagcgacagaaactggcagagaaacagaccctggcccaaggacagctactag

SEQ ID NO: 75000 - DNA, 1566 bp, Artificial Sequence
  Description of Artificial Sequence: Synthetic coding sequence
atgagcagcagcagctacgccaagaacggcaccgccgacggcccccacagccccaccagccaggtggccagaggcaccaccaccagaagaagcagactgaagagaagcgacggcagcaccaccagcaccagcttcatcctgagacagggcagcgccgacagctacaccagcagacccagcgacagcgacgtgagcctggaggaggacagagaggccatcagacaggagagagagcagcaggccgccatccagctggagagagccaagagcaagcccgtggccttcgccgtgaagaccaacgtgagctactgcggcgccctggacgaggacgtgcccgtgcccagcaccgccatcagcttcgacgccaaggacttcctgcacatcaaggagaagtacaacaacgactggtggatcggcagactggtgaaggagggctgcgagatcggcttcatccccagccccctgagactggagaacatcagaatccagcaggagcagaagagaggcagattccacggcggcaagagcagcggcaacagcagcagcagcctgggcgagatggtgagcggcaccttcagagccacccccaccagcaccgtgaagatggtgctgaagatccacaccgagcacatccccccctacgacgtggtgcccagcatgagacccgtggtgctggtgggccccagcctgaagggctacgaggtgaccgacatgatgcagaaggccctgttcgacttcctgaagcacagattcgacggcagaatcagcatcaccagagtgaccgccgacatcagcctggccaagagaagcgtgctgaacaaccccagcaagagagccatcatcgagagaagcaacaccagaagcagcctggccgaggtgcagagcgagatcgagagaatcttcgagctggccagaagcctgcagctggtggtgctggacgccgacaccatcaaccaccccgcccagctgatcaagaccagcctggcccccatcatcgtgcacgtgaaggtgagcagccccaaggtgctgcagagactgatcaagagcagaggcaagagccagagcaagcacctgaacgtgcagctggtggccgccgacaagctggcccagtgcccccccgagatgttcgacgtgatcctggacgagaaccagctggaggacgcctgcgagcacctgggcgagtacctggaggcctactggagagccacccacaccaccagcagcacccccatgacccccctgctgggcagaaacctgggcagcaccgccctgagcccctaccccaccgccatcagcggcctgcagagccagagaatgagacacagcaaccacagcaccgagaacagccccatcgagagaagaagcctgatgaccagcgacgagaactaccacaacgagagagccagaaagagcagaaacagactgagcagcagcagccagcacagcagagaccactaccccctggtggaggaggactaccccgacagctaccaggacacctacaagccccacagaaacagaggcagccccggcggctacagccacgacagcagacacagactgtag

SEQ ID NO: 75001 - DNA, 1464 bp, Artificial Sequence
  Description of Artificial Sequence: Synthetic coding sequence
atgtacgacaacctgtacctgcacggcatcgaggacagcgaggccggcagcgccgacagctacaccagcagacccagcgacagcgacgtgagcctggaggaggacagagaggccatcagacaggagagagagcagcaggccgccatccagctggagagagccaagagcaagcccgtggccttcgccgtgaagaccaacgtgagctactgcggcgccctggacgaggacgtgcccgtgcccagcaccgccatcagcttcgacgccaaggacttcctgcacatcaaggagaagtacaacaacgactggtggatcggcagactggtgaaggagggctgcgagatcggcttcatccccagccccctgagactggagaacatcagaatccagcaggagcagaagagaggcagattccacggcggcaagagcagcggcaacagcagcagcagcctgggcgagatggtgagcggcaccttcagagccacccccaccagcaccgtgaagatggtgctgaagatccacaccgagcacatccccccctacgacgtggtgcccagcatgagacccgtggtgctggtgggccccagcctgaagggctacgaggtgaccgacatgatgcagaaggccctgttcgacttcctgaagcacagattcgacggcagaatcagcatcaccagagtgaccgccgacatcagcctggccaagagaagcgtgctgaacaaccccagcaagagagccatcatcgagagaagcaacaccagaagcagcctggccgaggtgcagagcgagatcgagagaatcttcgagctggccagaagcctgcagctggtggtgctggacgccgacaccatcaaccaccccgcccagctgatcaagaccagcctggcccccatcatcgtgcacgtgaaggtgagcagccccaaggtgctgcagagactgatcaagagcagaggcaagagccagagcaagcacctgaacgtgcagctggtggccgccgacaagctggcccagtgcccccccgagatgttcgacgtgatcctggacgagaaccagctggaggacgcctgcgagcacctgggcgagtacctggaggcctactggagagccacccacaccaccagcagcacccccatgacccccctgctgggcagaaacctgggcagcaccgccctgagcccctaccccaccgccatcagcggcctgcagagccagagaatgagacacagcaaccacagcaccgagaacagccccatcgagagaagaagcctgatgaccagcgacgagaactaccacaacgagagagccagaaagagcagaaacagactgagcagcagcagccagcacagcagagaccactaccccctggtggaggaggactaccccgacagctaccaggacacctacaagccccacagaaacagaggcagccccggcggctacagccacgacagcagacacagactgtag

SEQ ID NO: 75002 - DNA, 1461 bp, Artificial Sequence
  Description of Artificial Sequence: Synthetic coding sequence
atgtacgacaacctgtacctgcacggcatcgaggacagcgaggccggcagcgccgacagctacaccagcagacccagcgacagcgacgtgagcctggaggaggacagagaggccatcagacaggagagagagcagcaggccgccatccagctggagagagccaagagcaagcccgtggccttcgccgtgaagaccaacgtgagctactgcggcgccctggacgaggacgtgcccgtgcccagcaccgccatcagcttcgacgccaaggacttcctgcacatcaaggagaagtacaacaacgactggtggatcggcagactggtgaaggagggctgcgagatcggcttcatccccagccccctgagactggagaacatcagaatccagcaggagcagaagagaggcagattccacggcggcaagagcagcggcaacagcagcagcagcctgggcgagatggtgagcggcaccttcagagccacccccaccagcaccgccaagcagaagcagaaggtgaccgagcacatccccccctacgacgtggtgcccagcatgagacccgtggtgctggtgggccccagcctgaagggctacgaggtgaccgacatgatgcagaaggccctgttcgacttcctgaagcacagattcgacggcagaatcagcatcaccagagtgaccgccgacatcagcctggccaagagaagcgtgctgaacaaccccagcaagagagccatcatcgagagaagcaacaccagaagcagcctggccgaggtgcagagcgagatcgagagaatcttcgagctggccagaagcctgcagctggtggtgctggacgccgacaccatcaaccaccccgcccagctgatcaagaccagcctggcccccatcatcgtgcacgtgaaggtgagcagccccaaggtgctgcagagactgatcaagagcagaggcaagagccagagcaagcacctgaacgtgcagctggtggccgccgacaagctggcccagtgcccccccgagatgttcgacgtgatcctggacgagaaccagctggaggacgcctgcgagcacctgggcgagtacctggaggcctactggagagccacccacaccaccagcagcacccccatgacccccctgctgggcagaaacctgggcagcaccgccctgagcccctaccccaccgccatcagcggcctgcagagccagagaatgagacacagcaaccacagcaccgagaacagccccatcgagagaagaagcctgatgaccagcgacgagaactaccacaacgagagagccagaaagagcagaaacagactgagcagcagcagccagcacagcagagaccactaccccctggtggaggaggactaccccgacagctaccaggacacctacaagccccacagaaacagaggcagccccggcggctacagccacgacagcagacacagactgtag

SEQ ID NO: 75003 - DNA, 1563 bp, Artificial Sequence
  Description of Artificial Sequence: Synthetic coding sequence
atgagcagcagcagctacgccaagaacggcaccgccgacggcccccacagccccaccagccaggtggccagaggcaccaccaccagaagaagcagactgaagagaagcgacggcagcaccaccagcaccagcttcatcctgagacagggcagcgccgacagctacaccagcagacccagcgacagcgacgtgagcctggaggaggacagagaggccatcagacaggagagagagcagcaggccgccatccagctggagagagccaagagcaagcccgtggccttcgccgtgaagaccaacgtgagctactgcggcgccctggacgaggacgtgcccgtgcccagcaccgccatcagcttcgacgccaaggacttcctgcacatcaaggagaagtacaacaacgactggtggatcggcagactggtgaaggagggctgcgagatcggcttcatccccagccccctgagactggagaacatcagaatccagcaggagcagaagagaggcagattccacggcggcaagagcagcggcaacagcagcagcagcctgggcgagatggtgagcggcaccttcagagccacccccaccagcaccgccaagcagaagcagaaggtgaccgagcacatccccccctacgacgtggtgcccagcatgagacccgtggtgctggtgggccccagcctgaagggctacgaggtgaccgacatgatgcagaaggccctgttcgacttcctgaagcacagattcgacggcagaatcagcatcaccagagtgaccgccgacatcagcctggccaagagaagcgtgctgaacaaccccagcaagagagccatcatcgagagaagcaacaccagaagcagcctggccgaggtgcagagcgagatcgagagaatcttcgagctggccagaagcctgcagctggtggtgctggacgccgacaccatcaaccaccccgcccagctgatcaagaccagcctggcccccatcatcgtgcacgtgaaggtgagcagccccaaggtgctgcagagactgatcaagagcagaggcaagagccagagcaagcacctgaacgtgcagctggtggccgccgacaagctggcccagtgcccccccgagatgttcgacgtgatcctggacgagaaccagctggaggacgcctgcgagcacctgggcgagtacctggaggcctactggagagccacccacaccaccagcagcacccccatgacccccctgctgggcagaaacctgggcagcaccgccctgagcccctaccccaccgccatcagcggcctgcagagccagagaatgagacacagcaaccacagcaccgagaacagccccatcgagagaagaagcctgatgaccagcgacgagaactaccacaacgagagagccagaaagagcagaaacagactgagcagcagcagccagcacagcagagaccactaccccctggtggaggaggactaccccgacagctaccaggacacctacaagccccacagaaacagaggcagccccggcggctacagccacgacagcagacacagactgtag

SEQ ID NO: 75004 - DNA, 1248 bp, Artificial Sequence
  Description of Artificial Sequence: Synthetic coding sequence
ttctacttcctgtgccagggcagcgccgacagctacaccagcagacccagcgacagcgacgtgagcctggaggaggacagagaggccatcagacaggagagagagcagcaggccgccatccagctggagagagccaagagcaagcccgtggccttcgccgtgaagaccaacgtgagctactgcggcgccctggacgaggacgtgcccgtgcccagcaccgccatcagcttcgacgccaaggacttcctgcacatcaaggagaagtacaacaacgactggtggatcggcagactggtgaaggagggctgcgagatcggcttcatccccagccccctgagactggagaacatcagaatccagcaggagcagaagagaggcagattccacggcggcaagagcagcggcaacagcagcagcagcctgggcgagatggtgagcggcaccttcagagccacccccaccagcaccgccaagcagaagcagaaggtgaccgagcacatccccccctacgacgtggtgcccagcatgagacccgtggtgctggtgggccccagcctgaagggctacgaggtgaccgacatgatgcagaaggccctgttcgacttcctgaagcacagattcgacggcagaatcagcatcaccagagtgaccgccgacatcagcctggccaagagaagcgtgctgaacaaccccagcaagagagccatcatcgagagaagcaacaccagaagcagcctggccgaggtgcagagcgagatcgagagaatcttcgagctggccagaagcctgcagctggtggtgctggacgccgacaccatcaaccaccccgcccagctgatcaagaccagcctggcccccatcatcgtgcacgtgaaggtgagcagccccaaggtgctgcagagactgatcaagagcagaggcaagagccagagcaagcacctgaacgtgcagctggtggccgccgacaagctggcccagtgcccccccagccagagaatgagacacagcaaccacagcaccgagaacagccccatcgagagaagaagcctgatgaccagcgacgagaactaccacaacgagagagccagaaagagcagaaacagactgagcagcagcagccagcacagcagagaccactaccccctggtggaggaggactaccccgacagctaccaggacacctacaagccccacagaaacagaggcagccccggcggctacagccacgacagcagacacagactgtag

SEQ ID NO: 75005 - DNA, 558 bp, Artificial Sequence
  Description of Artificial Sequence: Synthetic coding sequence
atgagcggcagcttcgagctgagcgtgcaggacctgaacgacctgctgagcgacggcagcggctgctacagcctgcccagccagccctgcaacgaggtgacccccagaatctacgtgggcaacgccagcgtggcccaggacatccccaagctgcagaagctgggcatcacccacgtgctgaacgccgccgagggcagaagcttcatgcacgtgaacaccaacgccaacttctacaaggacagcggcatcacctacctgggcatcaaggccaacgacacccaggagttcaacctgagcgcctacttcgagagagccgccgacttcatcgaccaggccctggcccagaagaacggcagagtgctggtgcactgcagagagggctacagcagaagccccaccctggtgatcgcctacctgatgatgagacagaagatggacgtgaagagcgccctgagcatcgtgagacagaacagagagatcggccccaacgacggcttcctggcccagctgtgccagctgaacgacagactggccaaggagggcaagctgaagccctag

SEQ ID NO: 75006 - DNA, 972 bp, Artificial Sequence
  Description of Artificial Sequence: Synthetic coding sequence
atgggcctgttcgacagaggcgtgcagatgctgctgaccaccgtgggcgccttcgccgccttcagcctgatgaccatcgccgtgggcaccgactactggctgtacagcagaggcgtgtgcaagaccaagagcgtgagcgagaacgagaccagcaagaagaacgaggaggtgatgacccacagcggcctgtggagaacctgctgcctggagggcaacttcaagggcctgtgcaagcagatcgaccacttccccgaggacgccgactacgaggccgacaccgccgagtacttcctgagagccgtgagagccagcagcatcttccccatcctgagcgtgatcctgctgttcatgggcggcctgtgcatcgccgccagcgagttctacaagaccagacacaacatcatcctgagcgccggcatcttcttcgtgagcgccggcctgagcaacatcatcggcatcatcgtgtacatcagcgccaacgccggcgaccccagcaagagcgacagcaagaagaacagctacagctacggctggagcttctacttcggcgccctgagcttcatcatcgccgagatggtgggcgtgctggccgtgcacatgttcatcgacagacacaagcagctgagagccaccgccagagccaccgactacctgcaggccagcgccatcaccagaatccccagctacagatacagataccagagaagaagcagaagcagcagcagaagcaccgagcccagccacagcagagacgccagccccgtgggcatcaagggcttcaacaccctgcccagcaccgagatcagcatgtacaccctgagcagagaccccctgaaggccgccaccacccccaccgccacctacaacagcgacagagacaacagcttcctgcaggtgcacaactgcatccagaaggagaacaaggacagcctgcacagcaacaccgccaacagaagaaccacccccgtgtag

SEQ ID NO: 75007 - DNA, 948 bp, Artificial Sequence
  Description of Artificial Sequence: Synthetic coding sequence
atgagaatgtgcgacagaggcatccagatgctgatcaccaccgtgggcgccttcgccgccttcagcctgatgaccatcgccgtgggcaccgactactggctgtacagcagaggcgtgtgcagaaccaagagcaccagcgacaacgagaccagcagaaagaacgaggaggtgatgacccacagcggcctgtggagaacctgctgcctggagggcgccttcagaggcgtgtgcaagaagatcgaccacttccccgaggacgccgactacgagcaggacaccgccgagtacctgctgagagccgtgagagccagcagcgtgttccccatcctgagcgtgaccctgctgttcttcggcggcctgtgcgtggccgccagcgagttccacagaagcagacacaacgtgatcctgagcgccggcatcttcttcgtgagcgccggcctgagcaacatcatcggcatcatcgtgtacatcagcgccaacgccggcgaccccggccagagagacagcaagaagagctacagctacggctggagcttctacttcggcgccttcagcttcatcatcgccgagatcgtgggcgtggtggccgtgcacatctacatcgagaagcaccagcagctgagagccaagagccacagcgagttcctgaagaagagcaccttcgccagactgcccccctacagatacagattcagaagaagaagcagcagcagaagcaccgagcccagaagcagagacctgagccccatcagcaagggcttccacaccatccccagcaccgacatcagcatgttcaccctgagcagagaccccagcaagatcaccatgggcaccctgctgaacagcgacagagaccacgccttcctgcagttccacaacagcacccccaaggagttcaaggagagcctgcacaacaaccccgccaacagaagaaccacccccgtgtag

SEQ ID NO: 75008 - DNA, 891 bp, Artificial Sequence
  Description of Artificial Sequence: Synthetic coding sequence
atgagcgcctgcggcagaaaggccctgaccctgctgagcagcgtgttcgccgtgtgcggcctgggcctgctgggcatcgccgtgagcaccgactactggctgtacctggaggagggcgtgatcgtgccccagaaccagagcaccgagatcaagatgagcctgcacagcggcctgtggagagtgtgcttcctggccggcgaggagagaggcagatgcttcaccatcgagtacgtgatgcccatgaacacccagctgaccagcgagagcaccgtgaacgtgctgaagatgatcagaagcgccacccccttccccctggtgagcctgttcttcatgttcatcggcttcatcctgaacaacatcggccacatcagaccccacagaaccatcctggccttcgtgagcggcatcttcttcatcctgagcggcctgagcctggtggtgggcctggtgctgtacatcagcagcatcaacgacgagatgctgaacagaaccaaggacgccgagacctacttcaactacaagtacggctggagcttcgccttcgccgccatcagcttcctgctgaccgaggtgaagcccgtgaccctgagcatggacagactgggcctgggcaccgcccccctgagcagaggcgagtggggctggggcagaagagacatcccccagcccttctggacccccgaccaccccctgtacttccccagcagcagccagaacgtgagcctgagctacctgagcggcagcccccccgccagaatgagccccggcccctgcagctgcccccacgtgcacttccccccccacagcagctgcgtgctgtgcagaccccagcccagagagatgagacaggcccccgccgccagccccagcagcgccgtgttcagcctgtag

SEQ ID NO: 75009 - DNA, 828 bp, Artificial Sequence
  Description of Artificial Sequence: Synthetic coding sequence
atgagcgcctgcggcagaaaggccctgaccctgctgagcagcgtgttcgccgtgtgcggcctgggcctgctgggcatcgccgtgagcaccgactactggctgtacctggaggagggcgtgatcgtgccccagaaccagagcaccgagatcaagatgagcctgcacagcggcctgtggagagtgtgcttcctggccggcgaggagagaggcagatgcttcaccatcgagtacgtgatgcccatgaacacccagctgaccagcgagagcaccgtgaacgtgctgaagatgatcagaagcgccacccccttccccctggtgagcctgttcttcatgttcatcggcttcatcctgaacaacatcggccacatcagaccccacagaaccatcctggccttcgtgagcggcatcttcttcatcctgagcggcctgagcctggtggtgggcctggtgctgtacatcagcagcatcaacgacgagatgctgaacagaaccaaggacgccgagacctacttcaactacaagtacggctggagcttcgccttcgccgccatcagcttcctgctgaccgagagcgccggcgtgatgagcgtgtacctgttcatgaagagatacaccgccgaggacatgtacagaccccaccccggcttctacagacccagactgagcaactgcagcgactacagcggccagttcctgcaccccgacgcctgggtgagaggcagaagccccagcgacatcagcagcgaggccagcctgcagatgaacagcaactaccccgccctgctgaagtgccccgactacgaccagatgagcagcagcccctgctag

SEQ ID NO: 75010 - DNA, 828 bp, Artificial Sequence; identical to SEQ ID NO: 75009
  Description of Artificial Sequence: Synthetic coding sequence

SEQ ID NO: 75011 - DNA, 783 bp, Artificial Sequence
  Description of Artificial Sequence: Synthetic coding sequence
atgatgtggagcaacttcttcctgcaggaggagaacagaagaagaggcgccgccggcagaagaagagcccacggccagggcagaagcggcctgacccccgagagagagggcaaggtgaagctggccctgctgctggccgccgtgggcgccaccctggccgtgctgagcgtgggcaccgagttctgggtggagctgaacacctacaaggccaacggcagcgccgtgtgcgaggccgcccacctgggcctgtggaaggcctgcaccaagagactgtggcaggccgacgtgcccgtggacagagacacctgcggccccgccgagctgcccggcgaggccaactgcacctacttcaagttcttcaccaccggcgagaacgccagaatcttccagagaaccaccaagaaggaggtgaacctggccgccgccgtgatcgccgtgctgggcctggccgtgatggccctgggctgcctgtgcatcatcatggtgctgagcaagggcgccgagttcctgctgagagtgggcgccgtgtgcttcggcctgagcggcctgctgctgctggtgagcctggaggtgttcagacacagcgtgagagccctgctgcagagagtgagccccgagcccccccccgcccccagactgacctacgagtacagctggagcctgggctgcggcgtgggcgccggcctgatcctgctgctgggcgccggctgcttcctgctgctgaccctgcccagctggccctggggcagcctgtgccccaagagaggccacagagccacctag

SEQ ID NO: 75012 - DNA, 645 bp, Artificial Sequence
  Description of Artificial Sequence: Synthetic coding sequence
atgatgtggagcaacttcttcctgcaggaggagaacagaagaagaggcgccgccggcagaagaagagcccacggccagggcagaagcggcctgacccccgagagagagggcaaggtgaagctggccctgctgctggccgccgtgggcgccaccctggccgtgctgagcgtgggcaccgagttctgggtggagctgaacacctacaaggccaacggcagcgccgtgtgcgaggccgcccacctgggcctgtggaaggcctgcaccaagagactgtggcaggccgacgtgcccgtggacagagacacctgcggccccgccgagctgcccggcgaggccaactgcacctacttcaagttcttcaccaccggcgagaacgccagaatcttccagagaaccaccaagaagggcctgctgctgctggtgagcctggaggtgttcagacacagcgtgagagccctgctgcagagagtgagccccgagcccccccccgcccccagactgacctacgagtacagctggagcctgggctgcggcgtgggcgccggcctgatcctgctgctgggcgccggctgcttcctgctgctgaccctgcccagctggccctggggcagcctgtgccccaagagaggccacagagccacctag

SEQ ID NO: 75013 - DNA, 570 bp, Artificial Sequence
  Description of Artificial Sequence: Synthetic coding sequence
atgatgtggagcaacttcttcctgcaggaggagaacagaagaagaggcgccgccggcagaagaagagcccacggccagggcagaagcggcctgacccccgagagagagggcaaggtgaagctggccctgctgctggccgccgtgggcgccaccctggccgtgctgagcgtgggcaccgagttctgggtggagctgaacacctacaaggccaacggcagcgccgtgtgcgaggccgcccacctgggcctgtggaaggcctgcaccaagagactgtggcaggccgacgtgcccgtggacagagacacctgcggccccgccgagctgcccggcggcctgctgctgctggtgagcctggaggtgttcagacacagcgtgagagccctgctgcagagagtgagccccgagcccccccccgcccccagactgacctacgagtacagctggagcctgggctgcggcgtgggcgccggcctgatcctgctgctgggcgccggctgcttcctgctgctgaccctgcccagctggccctggggcagcctgtgccccaagagaggccacagagccacctag

SEQ ID NO: 75014 - DNA, 321 bp, Artificial Sequence
  Description of Artificial Sequence: Synthetic coding sequence
atgagcaccaacaacatgagcgaccccagaagacccaacaaggtgctgagatacaagcccccccccagcgagtgcaaccccgccctggacgaccccacccccgactacatgaacctgctgggcatgatcttcagcatgtgcggcctgatgctgaagctgaagtggtgcgcctgggtggccgtgtactgcagcttcatcagcttcgccaacagcagaagcagcgaggacaccaagcagatgatgagcagcttcatgctgagcatcagcgccgtggtgatgagctacctgcagaacccccagcccatgacccccccctggtag

SEQ ID NO: 75015 - DNA, 828 bp, Artificial Sequence
  Description of Artificial Sequence: Synthetic coding sequence
atgagccactgcagcagcagagccctgaccctgctgagcagcgtgttcggcgcctgcggcctgctgctggtgggcatcgccgtgagcaccgactactggctgtacatggaggagggcaccgtgctgccccagaaccagaccaccgaggtgaagatggccctgcacgccggcctgtggagagtgtgcttcttcgccggcagagagaagggcagatgcgtggccagcgagtacttcctggagcccgagatcaacctggtgaccgagaacaccgagaacatcctgaagaccgtgagaaccgccacccccttccccatggtgagcctgttcctggtgttcaccgccttcgtgatcagcaacatcggccacatcagaccccagagaaccatcctggccttcgtgagcggcatcttcttcatcctgagcggcctgagcctggtggtgggcctggtgctgtacatcagcagcatcaacgacgaggtgatgaacagacccagcagcagcgagcagtacttccactacagatacggctggagcttcgccttcgccgccagcagcttcctgctgaaggagggcgccggcgtgatgagcgtgtacctgttcaccaagagatacgccgaggaggagatgtacagaccccaccccgccttctacagacccagactgagcgactgcagcgactacagcggccagttcctgcagcccgaggcctggagaagaggcagaagccccagcgacatcagcagcgacgtgagcatccagatgacccagaactacccccccgccatcaagtaccccgaccacctgcacatcagcaccagcccctgctag

SEQ ID NO: 75016 - DNA, 1278 bp, Artificial Sequence
  Description of Artificial Sequence: Synthetic coding sequence
ctggagagcctgaagagatggaacgaggagagaggcctgtggtgcgagaagggcgtgcaggtgctgctgaccaccgtgggcgccttcgccgccttcggcctgatgaccatcgccatcagcaccgactactggctgtacaccagagccctgatctgcaacaccaccaacctgaccgccggcggcgacgacggcaccccccacagaggcggcggcggcgccagcgagaagaaggaccccggcggcctgacccacagcggcctgtggagaatctgctgcctggagggcctgaagagaggcgtgtgcgtgaagatcaaccacttccccgaggacaccgactacgaccacgacagcgccgagtacctgctgagagtggtgagagccagcagcatcttccccatcctgagcgccatcctgctgctgctgggcggcgtgtgcgtggccgccagcagagtgtacaagagcaagagaaacatcatcctgggcgccggcatcctgttcgtggccgccggcctgagcaacatcatcggcgtgatcgtgtacatcagcgccaacgccggcgagcccggccccaagagagacgaggagaagaagaaccactacagctacggctggagcttctacttcggcggcctgagcttcatcctggccgaggtgatcggcgtgctggccgtgaacatctacatcgagagaagcagagaggcccactgccagagcagaagcgacctgctgaaggccggcggcggcgccggcggcagcggcggcagcggccccagcgccatcctgagactgcccagctacagattcagatacagaagaagaagcagaagcagcagcagaagcagcgagcccagccccagcagagacgccagccccggcggccccggcggccccggcttcgccagcaccgacatcagcatgtacaccctgagcagagaccccagcaagggcagcgtggccgccggcctggccggcgccggcggcggcggcggcggcgccgtgggcgccttcggcggcgccgccggcggcgccggcggcggcggcggcggcggcggcggcgccggcgccgagagagacagaggcggcgccagcggcttcctgaccctgcacaacgccttccccaaggaggccggcggcggcgtgaccgtgaccgtgaccggcccccccgccccccccgcccccgccccccccgcccccagcgcccccgcccccggcaccctggccaaggaggccgccgccagcaacaccaacaccctgaacagaaagaccacccccgtgtag

SEQ ID NO: 75017 - DNA, 6540 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactgggtgaacgacgccgtgggcagagactggccctggatctacttcgtgaccctgatcatcatcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgttctacttcgacatcgtgttcaccaccatcttcaccatcgagatcgccctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagcactacttctgcgacgcctggaacaccttcgacgccctgatcgtggtgggcagcatcgtggacatcgccatcaccgaggtgaaccccgccgagcacacccagtgcagccccagcatgggccccagctgcagccacccccccctggccgtgctgaccgccccccccgtggccgacggcttccagaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgaggagggccccagccccagcgaggcccaccagggcgccgaggaccccttcagacccgccggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 75018 - DNA, 6561 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactgggtgaacgacgccgtgggcagagactggccctggatctacttcgtgaccctgatcatcatcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgttctacttcgacatcgtgttcaccaccatcttcaccatcgagatcgccctgaagatcctgggcaacgccgactacgtgttcaccagcatcttcaccctggagatcatcctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagggctacttcagcgacccctggaacgtgttcgacttcctgatcgtgatcggcagcatcatcgacgtgatcctgagcgagaccaaccactacttctgcgacgcctggaacaccttcgacgccctgatcgtggtgggcagcatcgtggacatcgccatcaccgaggtgaaccccgccgagcacacccagtgcagccccagcatgaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgagggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 75019 - DNA, 6441 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactgggtgaacgacgccgtgggcagagactggccctggatctacttcgtgaccctgatcatcatcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgggcaacgccgactacgtgttcaccagcatcttcaccctggagatcatcctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagcactacttctgcgacgcctggaacaccttcgacgccctgatcgtggtgggcagcatcgtggacatcgccatcaccgaggtgaacaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgaggagggccccagccccagcgaggcccaccagggcgccgaggaccccttcagacccgccggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 75020 - DNA, 6441 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactgggtgaacgacgccgtgggcagagactggccctggatctacttcgtgaccctgatcatcatcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgttctacttcgacatcgtgttcaccaccatcttcaccatcgagatcgccctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagcactacttctgcgacgcctggaacaccttcgacgccctgatcgtggtgggcagcatcgtggacatcgccatcaccgaggtgaacaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgaggagggccccagccccagcgaggcccaccagggcgccgaggaccccttcagacccgccggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 75021 - DNA, 6417 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactgggtgaacgacgccgtgggcagagactggccctggatctacttcgtgaccctgatcatcatcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgttctacttcgacatcgtgttcaccaccatcttcaccatcgagatcgccctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagggctacttcagcgacccctggaacgtgttcgacttcctgatcgtgatcggcagcatcatcgacgtgatcctgagcgagaccaaccccgccgagcacacccagtgcagccccagcatgaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgagggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 75022 - DNA, 6417 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactgggtgaacgacgccgtgggcagagactggccctggatctacttcgtgaccctgatcatcatcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgggcaacgccgactacgtgttcaccagcatcttcaccctggagatcatcctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagcactacttctgcgacgcctggaacaccttcgacgccctgatcgtggtgggcagcatcgtggacatcgccatcaccgaggtgaaccccgccgagcacacccagtgcagccccagcatgaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgagggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 75023 - DNA, 6417 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactggatgcaggacgccatgggctacgagctgccctgggtgtacttcgtgagcctggtgatcttcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgttctacttcgacatcgtgttcaccaccatcttcaccatcgagatcgccctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagggctacttcagcgacccctggaacgtgttcgacttcctgatcgtgatcggcagcatcatcgacgtgatcctgagcgagaccaaccccgccgagcacacccagtgcagccccagcatgaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgagggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 75024 - DNA, 6477 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactgggtgaacgacgccgtgggcagagactggccctggatctacttcgtgaccctgatcatcatcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgttctacttcgacatcgtgttcaccaccatcttcaccatcgagatcgccctgaagatcctgggcaacgccgactacgtgttcaccagcatcttcaccctggagatcatcctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagcactacttctgcgacgcctggaacaccttcgacgccctgatcgtggtgggcagcatcgtggacatcgccatcaccgaggtgaaccccgccgagcacacccagtgcagccccagcatgaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgagggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 75025 - DNA, 6522 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactggatgcaggacgccatgggctacgagctgccctgggtgtacttcgtgagcctggtgatcttcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgttctacttcgacatcgtgttcaccaccatcttcaccatcgagatcgccctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagggctacttcagcgacccctggaacgtgttcgacttcctgatcgtgatcggcagcatcatcgacgtgatcctgagcgagaccaaccccgccgagcacacccagtgcagccccagcatgaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgagggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagagagagacacgtgcccatgtgcgaggacctggagctgagaagagacagcggcagcgccggcacccaggcccactgcctgctgctgagaaaggccaaccccagcagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 75026 - DNA, 6474 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactgggtgaacgacgccgtgggcagagactggccctggatctacttcgtgaccctgatcatcatcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgttctacttcgacatcgtgttcaccaccatcttcaccatcgagatcgccctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagcactacttctgcgacgcctggaacaccttcgacgccctgatcgtggtgggcagcatcgtggacatcgccatcaccgaggtgaaccccgccgagcacacccagtgcagccccagcatgaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgaggagggccccagccccagcgaggcccaccagggcgccgaggaccccttcagacccgccggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 75027 - DNA, 6468 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactgggtgaacgacgccgtgggcagagactggccctggatctacttcgtgaccctgatcatcatcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgggcaacgccgactacgtgttcaccagcatcttcaccctggagatcatcctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagggctacttcagcgacccctggaacgtgttcgacttcctgatcgtgatcggcagcatcatcgacgtgatcctgagcgagaccaaccactacttctgcgacgcctggaacaccttcgacgccctgatcgtggtgggcagcatcgtggacatcgccatcaccgaggtgaacaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgagggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 75028 - DNA, 6630 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactggatgcaggacgccatgggctacgagctgccctgggtgtacttcgtgagcctggtgatcttcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgttctacttcgacatcgtgttcaccaccatcttcaccatcgagatcgccctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagcactacttctgcgacgcctggaacaccttcgacgccctgatcgtggtgggcagcatcgtggacatcgccatcaccgaggtgaaccccgccgagcacacccagtgcagccccagcatgaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgagggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagaatgcactgctgcgacatgctggacggcggcaccttcccccccgccctgggccccagaagagcccccccctgcctgcaccagcagctgcagggcagcctggccggcctgagagaggacaccccctgcatcgtgcccggccacgccagcctgtgctgcagcagcagagtgggcgagtggctgcccgccggctgcaccgccccccagcacgccagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 75029 - DNA, 6474 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactgggtgaacgacgccgtgggcagagactggccctggatctacttcgtgaccctgatcatcatcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgggcaacgccgactacgtgttcaccagcatcttcaccctggagatcatcctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagcactacttctgcgacgcctggaacaccttcgacgccctgatcgtggtgggcagcatcgtggacatcgccatcaccgaggtgaaccccgccgagcacacccagtgcagccccagcatgaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgaggagggccccagccccagcgaggcccaccagggcgccgaggaccccttcagacccgccggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 75030 - DNA, 6501 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactgggtgaacgacgccgtgggcagagactggccctggatctacttcgtgaccctgatcatcatcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgttctacttcgacatcgtgttcaccaccatcttcaccatcgagatcgccctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagggctacttcagcgacccctggaacgtgttcgacttcctgatcgtgatcggcagcatcatcgacgtgatcctgagcgagaccaaccactacttctgcgacgcctggaacaccttcgacgccctgatcgtggtgggcagcatcgtggacatcgccatcaccgaggtgaaccccgccgagcacacccagtgcagccccagcatgaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgagggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 75031 - DNA, 6417 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactggatgcaggacgccatgggctacgagctgccctgggtgtacttcgtgagcctggtgatcttcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgggcaacgccgactacgtgttcaccagcatcttcaccctggagatcatcctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagcactacttctgcgacgcctggaacaccttcgacgccctgatcgtggtgggcagcatcgtggacatcgccatcaccgaggtgaaccccgccgagcacacccagtgcagccccagcatgaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgagggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 75032 - DNA, 6417 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactgggtgaacgacgccgtgggcagagactggccctggatctacttcgtgaccctgatcatcatcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgggcaacgccgactacgtgttcaccagcatcttcaccctggagatcatcctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagggctacttcagcgacccctggaacgtgttcgacttcctgatcgtgatcggcagcatcatcgacgtgatcctgagcgagaccaaccccgccgagcacacccagtgcagccccagcatgaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgagggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 75033 - DNA, 6435 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactgggtgaacgacgccgtgggcagagactggccctggatctacttcgtgaccctgatcatcatcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgttctacttcgacatcgtgttcaccaccatcttcaccatcgagatcgccctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagcactacttctgcgacgcctggaacaccttcgacgccctgatcgtggtgggcagcatcgtggacatcgccatcaccgagaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgaggagggccccagccccagcgaggcccaccagggcgccgaggaccccttcagacccgccggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 75034 - DNA, 6417 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactgggtgaacgacgccgtgggcagagactggccctggatctacttcgtgaccctgatcatcatcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgttctacttcgacatcgtgttcaccaccatcttcaccatcgagatcgccctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagcactacttctgcgacgcctggaacaccttcgacgccctgatcgtggtgggcagcatcgtggacatcgccatcaccgaggtgaaccccgccgagcacacccagtgcagccccagcatgaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgagggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 75035 - DNA, 6474 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactgggtgaacgacgccgtgggcagagactggccctggatctacttcgtgaccctgatcatcatcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgttctacttcgacatcgtgttcaccaccatcttcaccatcgagatcgccctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagggctacttcagcgacccctggaacgtgttcgacttcctgatcgtgatcggcagcatcatcgacgtgatcctgagcgagaccaaccccgccgagcacacccagtgcagccccagcatgaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgaggagggccccagccccagcgaggcccaccagggcgccgaggaccccttcagacccgccggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 75036 - DNA, 6630 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactggatgcaggacgccatgggctacgagctgccctgggtgtacttcgtgagcctggtgatcttcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgttctacttcgacatcgtgttcaccaccatcttcaccatcgagatcgccctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaagggctacttcagcgacccctggaacgtgttcgacttcctgatcgtgatcggcagcatcatcgacgtgatcctgagcgagaccaaccccgccgagcacacccagtgcagccccagcatgaacgccgaggagaacagcagaatcagcatcaccttcttcagactgttcagagtgatgagactggtgaagctgctgagcagaggcgagggcatcagaaccctgctgtggaccttcatcaagagcttccaggccctgccctacgtggccctgctgatcgtgatgctgttcttcatctacgccgtgatcggcatgcaggtgttcggcaagatcgccctgaacgacaccaccgagatcaacagaaacaacaacttccagaccttcccccaggccgtgctgctgctgttcagatgcgccaccggcgaggcctggcaggacatcatgctggcctgcatgcccggcaagaagtgcgcccccgagagcgagcccagcaacagcaccgagggcgagaccccctgcggcagcagcttcgccgtgttctacttcatcagcttctacatgctgtgcgccttcctgatcatcaacctgttcgtggccgtgatcatggacaacttcgactacctgaccagagactggagcatcctgggcccccaccacctggacgagttcaagagaatctgggccgagtacgaccccgaggccaagggcagaatcaagcacctggacgtggtgaccctgctgagaagaatccagccccccctgggcttcggcaagctgtgcccccacagagtggcctgcaagagactggtgagcatgaacatgcccctgaacagcgacggcaccgtgatgttcaacgccaccctgttcgccctggtgagaaccgccctgagaatcaagaccgagggcaacctggagcaggccaacgaggagctgagagccatcatcaagaagatctggaagagaaccagcatgaagctgctggaccaggtggtgccccccgccggcgacgacgaggtgaccgtgggcaagttctacgccaccttcctgatccaggagtacttcagaaagttcaagaagagaaaggagcagggcctggtgggcaagcccagccagagaaacgccctgagcctgcaggccggcctgagaaccctgcacgacatcggccccgagatcagaagagccatcagcggcgacctgaccgccgaggaggagctggacaaggccatgaaggaggccgtgagcgccgccagcgaggacgacatcttcagaagagccggcggcctgttcggcaaccacgtgagctactaccagagcgacggcagaagcgccttcccccagaccttcaccacccagagacccctgcacatcaacaaggccggcagcagccagggcgacaccgagagccccagccacgagaagctggtggacagcaccttcacccccagcagctacagcagcaccggcagcaacgccaacatcaacaacgccaacaacaccgccctgggcagactgcccagacccgccggctaccccagcaccgtgagcaccgtggagggccacggcccccccctgagccccgccatcagagtgcaggaggtggcctggaagctgagcagcaacagaatgcactgctgcgacatgctggacggcggcaccttcccccccgccctgggccccagaagagcccccccctgcctgcaccagcagctgcagggcagcctggccggcctgagagaggacaccccctgcatcgtgcccggccacgccagcctgtgctgcagcagcagagtgggcgagtggctgcccgccggctgcaccgccccccagcacgccagatgccacagcagagagagccaggccgccatggccggccaggaggagaccagccaggacgagacctacgaggtgaagatgaaccacgacaccgaggcctgcagcgagcccagcctgctgagcaccgagatgctgagctaccaggacgacgagaacagacagctgaccctgcccgaggaggacaagagagacatcagacagagccccaagagaggcttcctgagaagcgccagcctgggcagaagagccagcttccacctggagtgcctgaagagacagaaggacagaggcggcgacatcagccagaagaccgtgctgcccctgcacctggtgcaccaccaggccctggccgtggccggcctgagccccctgctgcagagaagccacagccccgccagcttccccagacccttcgccaccccccccgccacccccggcagcagaggctggcccccccagcccgtgcccaccctgagactggagggcgtggagagcagcgagaagctgaacagcagcttccccagcatccactgcggcagctgggccgagaccacccccggcggcggcggcagcagcgccgccagaagagtgagacccgtgagcctgatggtgcccagccaggccggcgcccccggcagacagttccacggcagcgccagcagcctggtggaggccgtgctgatcagcgagggcctgggccagttcgcccaggaccccaagttcatcgaggtgaccacccaggagctggccgacgcctgcgacatgaccatcgaggagatggagagcgccgccgacaacatcctgagcggcggcgccccccagagccccaacggcgccctgctgcccttcgtgaactgcagagacgccggccaggacagagccggcggcgaggaggacgccggctgcgtgagagccagaggcagacccagcgaggaggagctgcaggacagcagagtgtacgtgagcagcctgtag

SEQ ID NO: 75037 - DNA, 3840 bp, Artificial Sequence
  Description of Artificial Sequence: Synthetic coding sequence
atggtgaacgagaacaccagaatgtacatccccgaggagaaccaccagggcagcaactacggcagccccagacccgcccacgccaacatgaacgccaacgccgccgccggcctggcccccgagcacatccccacccccggcgccgccctgagctggcaggccgccatcgacgccgccagacaggccaagctgatgggcagcgccggcaacgccaccatcagcaccgtgagcagcacccagagaaagagacagcagtacggcaagcccaagaagcagggcagcaccaccgccaccagaccccccagagccctgctgtgcctgaccctgaagaaccccatcagaagagcctgcatcagcatcgtggagtggaagcccttcgagatcatcatcctgctgaccatcttcgccaactgcgtggccctggccatctacatccccttccccgaggacgacagcaacgccaccaacagcaacctggagagagtggagtacctgttcctgatcatcttcaccgtggaggccttcctgaaggtgatcgcctacggcctgctgttccaccccaacgcctacctgagaaacggctggaacctgctggacttcatcatcgtggtggtgggcctgttcagcgccatcctggagcaggccaccaaggccgacggcgccaacgccctgggcggcaagggcgccggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatgggcaagatgcacaagacctgctacaaccaggagggcatcgccgacgtgcccgccgaggacgaccccagcccctgcgccctggagaccggccacggcagacagtgccagaacggcaccgtgtgcaagcccggctgggacggccccaagcacggcatcaccaacttcgacaacttcgccttcgccatgctgaccgtgttccagtgcatcaccatggagggctggaccgacgtgctgtactgggtgaacgacgccgtgggcagagactggccctggatctacttcgtgaccctgatcatcatcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggacgagggcatggacgaggagaagcccagaaacatgagcatgcccaccagcgagaccgagagcgtgaacaccgagaacgtggccggcggcgacatcgagggcgagaactgcggcgccagactggcccacagaatcagcaagagcaagttcagcagatactggagaagatggaacagattctgcagaagaaagtgcagagccgccgtgaagagcaacgtgttctactggctggtgatcttcctggtgttcctgaacaccctgaccatcgccagcgagcactacaaccagcccaactggctgaccgaggtgcaggacaccgccaacaaggccctgctggccctgttcaccgccgagatgctgctgaagatgtacagcctgggcctgcaggcctacttcgtgagcctgttcaacagattcgactgcttcgtggtgtgcggcggcatcctggagaccatcctggtggagaccaagatcatgagccccctgggcatcagcgtgctgagatgcgtgagactgctgagaatcttcaagatcaccagatactggaacagcctgagcaacctggtggccagcctgctgaacagcgtgagaagcatcgccagcctgctgctgctgctgttcctgttcatcatcatcttcagcctgctgggcatgcagctgttcggcggcaagttcaacttcgacgagatgcagaccagaagaagcaccttcgacaacttcccccagagcctgctgaccgtgttccagatcctgaccggcgaggactggaacagcgtgatgtacgacggcatcatggcctacggcggccccagcttccccggcatgctggtgtgcatctacttcatcatcctgttcatctgcggcaactacatcctgctgaacgtgttcctggccatcgccgtggacaacctggccgacgccgagagcctgaccagcgcccagaaggaggaggaggaggagaaggagagaaagaagctggccagaaccgccagccccgagaagaagcaggagctggtggagaagcccgccgtgggcgagagcaaggaggagaagatcgagctgaagagcatcaccgccgacggcgagagcccccccgccaccaagatcaacatggacgacctgcagcccaacgagaacgaggacaagagcccctaccccaaccccgagaccaccggcgaggaggacgaggaggagcccgagatgcccgtgggccccagacccagacccctgagcgagctgcacctgaaggagaaggccgtgcccatgcccgaggccagcgccttcttcatcttcagcagcaacaacagattcagactgcagtgccacagaatcgtgaacgacaccatcttcaccaacctgatcctgttcttcatcctgctgagcagcatcagcctggccgccgaggaccccgtgcagcacaccagcttcagaaaccacatcctgggcaacgccgactacgtgttcaccagcatcttcaccctggagatcatcctgaagatgaccgcctacggcgccttcctgcacaagggcagcttctgcagaaactacttcaacatcctggacctgctggtggtgagcgtgagcctgatcagcttcggcatccagagcagcgccatcaacgtggtgaagatcctgagagtgctgagagtgctgagacccctgagagccatcaacagagccaagggcctgaagcacgtggtgcagtgcgtgttcgtggccatcagaaccatcggcaacatcgtgatcgtgaccaccctgctgcagttcatgttcgcctgcatcggcgtgcagctgttcaagggcaagctgtacacctgcagcgacagcagcaagcagaccgaggccgagtgcaagggcaactacatcacctacaaggacggcgaggtggaccaccccatcatccagcccagaagctgggagaacagcaagttcgacttcgacaacgtgctggccgccatgatggccctgttcaccgtgagcaccttcgagggctggcccgagctgctgtacagaagcatcgacagccacaccgaggacaagggccccatctacaactacagagtggagatcagcatcttcttcatcatctacatcatcatcatcgccttcttcatgatgaacatcttcgtgggcttcgtgatcgtgaccttccaggagcagggcgagcaggagtacaagaactgcgagctggacaagaaccagagacagtgcgtggagtacgccctgaaggccagacccctgagaagatacatccccaagaaccagcaccagtacaaggtgtggtacgtggtgaacagcacctacttcgagtacctgatgttcgtgctgatcctgctgaacaccatctgcctggccatgcagcactacggccagagctgcctgttcaagatcgccatgaacatcctgaacatgctgttcaccggcctgttcaccgtggagatgatcctgaagctgatcgccttcaagcccaaggtgggcctgtag

SEQ ID NO: 75038 - DNA, 6546 bp, Artificial Sequence
  Description of Artificial Sequence: Synthetic coding sequence
atgatgatgatgatgatgatgaagaagatgcagcaccagagacagcagcaggccgaccacgccaacgaggccaactacgccagaggcaccagactgcccctgagcggcgagggccccaccagccagcccaacagcagcaagcagaccgtgctgagctggcaggccgccatcgacgccgccagacaggccaaggccgcccagaccatgagcaccagcgcccccccccccgtgggcagcctgagccagagaaagagacagcagtacgccaagagcaagaagcagggcaacagcagcaacagcagacccgccagagccctgttctgcctgagcctgaacaaccccatcagaagagcctgcatcagcatcgtggagtggaagcccttcgacatcttcatcctgctggccatcttcgccaactgcgtggccctggccatctacatccccttccccgaggacgacagcaacagcaccaaccacaacctggagaaggtggagtacgccttcctgatcatcttcaccgtggagaccttcctgaagatcatcgcctacggcctgctgctgcaccccaacgcctacgtgagaaacggctggaacctgctggacttcgtgatcgtgatcgtgggcctgttcagcgtgatcctggagcagctgaccaaggagaccgagggcggcaaccacagcagcggcaagagcggcggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatcggcaagatgcacaagacctgcttcttcgccgacagcgacatcgtggccgaggaggaccccgccccctgcgccttcagcggcaacggcagacagtgcaccgccaacggcaccgagtgcagaagcggctgggtgggccccaacggcggcatcaccaacttcgacaacttcgccttcgccatgctgaccgtgttccagtgcatcaccatggagggctggaccgacgtgctgtactgggtgaacgacgccatcggctgggagtggccctgggtgtacttcgtgagcctgatcatcctgggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggaggagggcggcgaggagggcaagagaaacaccagcatgcccaccagcgagaccgagagcgtgaacaccgagaacgtgagcggcgagggcgagaacagaggctgctgcggcagcctgtggtgctggtggagaagaagaggcgccgccaaggccggccccagcggctgcagaagatggggccaggccatcagcaagagcaagctgagcagaagatggagaagatggaacagattcaacagaagaagatgcagagccgccgtgaagagcgtgaccttctactggctggtgatcgtgctggtgttcctgaacaccctgaccatcagcagcgagcactacaaccagcccgactggctgacccagatccaggacatcgccaacaaggtgctgctggccctgttcacctgcgagatgctggtgaagatgtacagcctgggcctgcaggcctacttcgtgagcctgttcaacagattcgactgcttcgtggtgtgcggcggcatcaccgagaccatcctggtggagctggagatcatgagccccctgggcatcagcgtgttcagatgcgtgagactgctgagaatcttcaaggtgaccagacactggaccagcctgagcaacctggtggccagcctgctgaacagcatgaagagcatcgccagcctgctgctgctgctgttcctgttcatcatcatcttcagcctgctgggcatgcagctgttcggcggcaagttcaacttcgacgagacccagaccaagagaagcaccttcgacaacttcccccaggccctgctgaccgtgttccagatcctgaccggcgaggactggaacgccgtgatgtacgacggcatcatggcctacggcggccccagcagcagcggcatgatcgtgtgcatctacttcatcatcctgttcatctgcggcaactacatcctgctgaacgtgttcctggccatcgccgtggacaacctggccgacgccgagagcctgaacaccgcccagaaggaggaggccgaggagaaggagagaaagaagatcgccagaaaggagagcctggagaacaagaagaacaacaagcccgaggtgaaccagatcgccaacagcgacaacaaggtgaccatcgacgactacagagaggaggacgaggacaaggacccctaccccccctgcgacgtgcccgtgggcgaggaggaggaggaggaggaggaggacgagcccgaggtgcccgccggccccagacccagaagaatcagcgagctgaacatgaaggagaagatcgcccccatccccgagggcagcgccttcttcatcctgagcaagaccaaccccatcagagtgggctgccacaagctgatcaaccaccacatcttcaccaacctgatcctggtgttcatcatgctgagcagcgccgccctggccgccgaggaccccatcagaagccacagcttcagaaacaccatcctgggctacttcgactacgccttcaccgccatcttcaccgtggagatcctgctgaagatgaccaccttcggcgccttcctgcacaagggcgccttctgcagaaactacttcaacctgctggacatgctggtggtgggcgtgagcctggtgagcttcggcatccagagcagcgccatcagcgtggtgaagatcctgagagtgctgagagtgctgagacccctgagagccatcaacagagccaagggcctgaagcacgtggtgcagtgcgtgttcgtggccatcagaaccatcggcaacatcatgatcgtgaccaccctgctgcagttcatgttcgcctgcatcggcgtgcagctgttcaagggcaagttctacagatgcaccgacgaggccaagagcaaccccgaggagtgcagaggcctgttcatcctgtacaaggacggcgacgtggacagccccgtggtgagagagagaatctggcagaacagcgacttcaacttcgacaacgtgctgagcgccatgatggccctgttcaccgtgagcaccttcgagggctggcccgccctgctgtacaaggccatcgacagcaacggcgagaacatcggccccatctacaaccacagagtggagatcagcatcttcttcatcatctacatcatcatcgtggccttcttcatgatgaacatcttcgtgggcttcgtgatcgtgaccttccaggagcagggcgagaaggagtacaagaactgcgagctggacaagaaccagagacagtgcgtggagtacgccctgaaggccagacccctgagaagatacatccccaagaacccctaccagtacaagttctggtacgtggtgaacagcagccccttcgagtacatgatgttcgtgctgatcatgctgaacaccctgtgcctggccatgcagcactacgagcagagcaagatgttcaacgacgccatggacatcctgaacatggtgttcaccggcgtgttcaccgtggagatggtgctgaaggtgatcgccttcaagcccaagggctacttcagcgacgcctggaacaccttcgacagcctgatcgtgatcggcagcatcatcgacgtggccctgagcgaggccgaccccaccgagagcgagaacgtgcccgtgcccaccgccacccccggcaacagcgaggagagcaacagaatcagcatcaccttcttcagactgttcagagtgatgagactggtgaagctgctgagcagaggcgagggcatcagaaccctgctgtggaccttcatcaagagcttccaggccctgccctacgtggccctgctgatcgccatgctgttcttcatctacgccgtgatcggcatgcagatgttcggcaaggtggccatgagagacaacaaccagatcaacagaaacaacaacttccagaccttcccccaggccgtgctgctgctgttcagatgcgccaccggcgaggcctggcaggagatcatgctggcctgcctgcccggcaagctgtgcgaccccgagagcgactacaaccccggcgaggagtacacctgcggcagcaacttcgccatcgtgtacttcatcagcttctacatgctgtgcgccttcctgatcatcaacctgttcgtggccgtgatcatggacaacttcgactacctgaccagagactggagcatcctgggcccccaccacctggacgagttcaagagaatctggagcgagtacgaccccgaggccaagggcagaatcaagcacctggacgtggtgaccctgctgagaagaatccagccccccctgggcttcggcaagctgtgcccccacagagtggcctgcaagagactggtggccatgaacatgcccctgaacagcgacggcaccgtgatgttcaacgccaccctgttcgccctggtgagaaccgccctgaagatcaagaccgagggcaacctggagcaggccaacgaggagctgagagccgtgatcaagaagatctggaagaagaccagcatgaagctgctggaccaggtggtgccccccgccggcgacgacgaggtgaccgtgggcaagttctacgccaccttcctgatccaggactacttcagaaagttcaagaagagaaaggagcagggcctggtgggcaagtaccccgccaagaacaccaccatcgccctgcaggccggcctgagaaccctgcacgacatcggccccgagatcagaagagccatcagctgcgacctgcaggacgacgagcccgaggagaccaagagagaggaggaggacgacgtgttcaagagaaacggcgccctgctgggcaaccacgtgaaccacgtgaacagcgacagaagagacagcctgcagcagaccaacaccacccacagacccctgcacgtgcagagacccagcatcccccccgccagcgacaccgagaagcccctgttcccccccgccggcaacagcgtgtgccacaaccaccacaaccacaacagcatcggcaagcaggtgcccaccagcaccaacgccaacctgaacaacgccaacatgagcaaggccgcccacggcaagagacccagcatcggcaacctggagcacgtgagcgagaacggccaccacagcagccacaagcacgacagagagccccagagaagaagcagcgtgaagagaaccagatactacgagacctacatcagaagcgacagcggcgacgagcagctgcccaccatctgcagagaggaccccgagatccacggctacttcagagacccccactgcctgggcgagcaggagtacttcagcagcgaggagtgctacgaggacgacagcagccccacctggagcagacagaactacggctactacagcagataccccggcagaaacatcgacagcgagagacccagaggctaccaccacccccagggcttcctggaggacgacgacagccccgtgtgctacgacagcagaagaagccccagaagaagactgctgccccccacccccgccagccacagaagaagcagcttcaacttcgagtgcctgagaagacagagcagccaggaggaggtgcccagcagccccatcttcccccacagaaccgccctgcccctgcacctgatgcagcagcagatcatggccgtggccggcctggacagcagcaaggcccagaagtacagccccagccacagcaccagaagctgggccaccccccccgccacccccccctacagagactggaccccctgctacacccccctgatccaggtggagcagagcgaggccctggaccaggtgaacggcagcctgcccagcctgcacagaagcagctggtacaccgacgagcccgacatcagctacagaaccttcacccccgccagcctgaccgtgcccagcagcttcagaaacaagaacagcgacaagcagagaagcgccgacagcctggtggaggccgtgctgatcagcgagggcctgggcagatacgccagagaccccaagttcgtgagcgccaccaagcacgagatcgccgacgcctgcgacctgaccatcgacgagatggagagcgccgccagcaccctgctgaacggcaacgtgagacccagagccaacggcgacgtgggccccctgagccacagacaggactacgagctgcaggacttcggccccggctacagcgacgaggagcccgaccccggcagagacgaggaggacctggccgacgagatgatctgcatcaccaccctgtag

SEQ ID NO: 75039 - DNA, 6486 bp, Artificial Sequence
  Description of Artificial Sequence: Synthetic coding sequence
atgatgatgatgatgatgatgaagaagatgcagcaccagagacagcagcaggccgaccacgccaacgaggccaactacgccagaggcaccagactgcccctgagcggcgagggccccaccagccagcccaacagcagcaagcagaccgtgctgagctggcaggccgccatcgacgccgccagacaggccaaggccgcccagaccatgagcaccagcgcccccccccccgtgggcagcctgagccagagaaagagacagcagtacgccaagagcaagaagcagggcaacagcagcaacagcagacccgccagagccctgttctgcctgagcctgaacaaccccatcagaagagcctgcatcagcatcgtggagtggaagcccttcgacatcttcatcctgctggccatcttcgccaactgcgtggccctggccatctacatccccttccccgaggacgacagcaacagcaccaaccacaacctggagaaggtggagtacgccttcctgatcatcttcaccgtggagaccttcctgaagatcatcgcctacggcctgctgctgcaccccaacgcctacgtgagaaacggctggaacctgctggacttcgtgatcgtgatcgtgggcctgttcagcgtgatcctggagcagctgaccaaggagaccgagggcggcaaccacagcagcggcaagagcggcggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatcggcaagatgcacaagacctgcttcttcgccgacagcgacatcgtggccgaggaggaccccgccccctgcgccttcagcggcaacggcagacagtgcaccgccaacggcaccgagtgcagaagcggctgggtgggccccaacggcggcatcaccaacttcgacaacttcgccttcgccatgctgaccgtgttccagtgcatcaccatggagggctggaccgacgtgctgtactggatgaacgacgccatgggcttcgagctgccctgggtgtacttcgtgagcctggtgatcttcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggaggagggcggcgaggagggcaagagaaacaccagcatgcccaccagcgagaccgagagcgtgaacaccgagaacgtgagcggcgagggcgagaacagaggctgctgcggcagcctgtgccaggccatcagcaagagcaagctgagcagaagatggagaagatggaacagattcaacagaagaagatgcagagccgccgtgaagagcgtgaccttctactggctggtgatcgtgctggtgttcctgaacaccctgaccatcagcagcgagcactacaaccagcccgactggctgacccagatccaggacatcgccaacaaggtgctgctggccctgttcacctgcgagatgctggtgaagatgtacagcctgggcctgcaggcctacttcgtgagcctgttcaacagattcgactgcttcgtggtgtgcggcggcatcaccgagaccatcctggtggagctggagatcatgagccccctgggcatcagcgtgttcagatgcgtgagactgctgagaatcttcaaggtgaccagacactggaccagcctgagcaacctggtggccagcctgctgaacagcatgaagagcatcgccagcctgctgctgctgctgttcctgttcatcatcatcttcagcctgctgggcatgcagctgttcggcggcaagttcaacttcgacgagacccagaccaagagaagcaccttcgacaacttcccccaggccctgctgaccgtgttccagatcctgaccggcgaggactggaacgccgtgatgtacgacggcatcatggcctacggcggccccagcagcagcggcatgatcgtgtgcatctacttcatcatcctgttcatctgcggcaactacatcctgctgaacgtgttcctggccatcgccgtggacaacctggccgacgccgagagcctgaacaccgcccagaaggaggaggccgaggagaaggagagaaagaagatcgccagaaaggagagcctggagaacaagaagaacaacaagcccgaggtgaaccagatcgccaacagcgacaacaaggtgaccatcgacgactacagagaggaggacgaggacaaggacccctaccccccctgcgacgtgcccgtgggcgaggaggaggaggaggaggaggaggacgagcccgaggtgcccgccggccccagacccagaagaatcagcgagctgaacatgaaggagaagatcgcccccatccccgagggcagcgccttcttcatcctgagcaagaccaaccccatcagagtgggctgccacaagctgatcaaccaccacatcttcaccaacctgatcctggtgttcatcatgctgagcagcgccgccctggccgccgaggaccccatcagaagccacagcttcagaaacaccatcctgggctacttcgactacgccttcaccgccatcttcaccgtggagatcctgctgaagatgaccaccttcggcgccttcctgcacaagggcgccttctgcagaaactacttcaacctgctggacatgctggtggtgggcgtgagcctggtgagcttcggcatccagagcagcgccatcagcgtggtgaagatcctgagagtgctgagagtgctgagacccctgagagccatcaacagagccaagggcctgaagcacgtggtgcagtgcgtgttcgtggccatcagaaccatcggcaacatcatgatcgtgaccaccctgctgcagttcatgttcgcctgcatcggcgtgcagctgttcaagggcaagttctacagatgcaccgacgaggccaagagcaaccccgaggagtgcagaggcctgttcatcctgtacaaggacggcgacgtggacagccccgtggtgagagagagaatctggcagaacagcgacttcaacttcgacaacgtgctgagcgccatgatggccctgttcaccgtgagcaccttcgagggctggcccgccctgctgtacaaggccatcgacagcaacggcgagaacatcggccccatctacaaccacagagtggagatcagcatcttcttcatcatctacatcatcatcgtggccttcttcatgatgaacatcttcgtgggcttcgtgatcgtgaccttccaggagcagggcgagaaggagtacaagaactgcgagctggacaagaaccagagacagtgcgtggagtacgccctgaaggccagacccctgagaagatacatccccaagaacccctaccagtacaagttctggtacgtggtgaacagcagccccttcgagtacatgatgttcgtgctgatcatgctgaacaccctgtgcctggccatgcagcactacgagcagagcaagatgttcaacgacgccatggacatcctgaacatggtgttcaccggcgtgttcaccgtggagatggtgctgaaggtgatcgccttcaagcccaagggctacttcagcgacgcctggaacaccttcgacagcctgatcgtgatcggcagcatcatcgacgtggccctgagcgaggccgaccccaccgagagcgagaacgtgcccgtgcccaccgccacccccggcaacagcgaggagagcaacagaatcagcatcaccttcttcagactgttcagagtgatgagactggtgaagctgctgagcagaggcgagggcatcagaaccctgctgtggaccttcatcaagagcttccaggccctgccctacgtggccctgctgatcgccatgctgttcttcatctacgccgtgatcggcatgcagatgttcggcaaggtggccatgagagacaacaaccagatcaacagaaacaacaacttccagaccttcccccaggccgtgctgctgctgttcagatgcgccaccggcgaggcctggcaggagatcatgctggcctgcctgcccggcaagctgtgcgaccccgagagcgactacaaccccggcgaggagtacacctgcggcagcaacttcgccatcgtgtacttcatcagcttctacatgctgtgcgccttcctgatcatcaacctgttcgtggccgtgatcatggacaacttcgactacctgaccagagactggagcatcctgggcccccaccacctggacgagttcaagagaatctggagcgagtacgaccccgaggccaagggcagaatcaagcacctggacgtggtgaccctgctgagaagaatccagccccccctgggcttcggcaagctgtgcccccacagagtggcctgcaagagactggtggccatgaacatgcccctgaacagcgacggcaccgtgatgttcaacgccaccctgttcgccctggtgagaaccgccctgaagatcaagaccgagggcaacctggagcaggccaacgaggagctgagagccgtgatcaagaagatctggaagaagaccagcatgaagctgctggaccaggtggtgccccccgccggcgacgacgaggtgaccgtgggcaagttctacgccaccttcctgatccaggactacttcagaaagttcaagaagagaaaggagcagggcctggtgggcaagtaccccgccaagaacaccaccatcgccctgcaggccggcctgagaaccctgcacgacatcggccccgagatcagaagagccatcagctgcgacctgcaggacgacgagcccgaggagaccaagagagaggaggaggacgacgtgttcaagagaaacggcgccctgctgggcaaccacgtgaaccacgtgaacagcgacagaagagacagcctgcagcagaccaacaccacccacagacccctgcacgtgcagagacccagcatcccccccgccagcgacaccgagaagcccctgttcccccccgccggcaacagcgtgtgccacaaccaccacaaccacaacagcatcggcaagcaggtgcccaccagcaccaacgccaacctgaacaacgccaacatgagcaaggccgcccacggcaagagacccagcatcggcaacctggagcacgtgagcgagaacggccaccacagcagccacaagcacgacagagagccccagagaagaagcagcgtgaagagaaccagatactacgagacctacatcagaagcgacagcggcgacgagcagctgcccaccatctgcagagaggaccccgagatccacggctacttcagagacccccactgcctgggcgagcaggagtacttcagcagcgaggagtgctacgaggacgacagcagccccacctggagcagacagaactacggctactacagcagataccccggcagaaacatcgacagcgagagacccagaggctaccaccacccccagggcttcctggaggacgacgacagccccgtgtgctacgacagcagaagaagccccagaagaagactgctgccccccacccccgccagccacagaagaagcagcttcaacttcgagtgcctgagaagacagagcagccaggaggaggtgcccagcagccccatcttcccccacagaaccgccctgcccctgcacctgatgcagcagcagatcatggccgtggccggcctggacagcagcaaggcccagaagtacagccccagccacagcaccagaagctgggccaccccccccgccacccccccctacagagactggaccccctgctacacccccctgatccaggtggagcagagcgaggccctggaccaggtgaacggcagcctgcccagcctgcacagaagcagctggtacaccgacgagcccgacatcagctacagaaccttcacccccgccagcctgaccgtgcccagcagcttcagaaacaagaacagcgacaagcagagaagcgccgacagcctggtggaggccgtgctgatcagcgagggcctgggcagatacgccagagaccccaagttcgtgagcgccaccaagcacgagatcgccgacgcctgcgacctgaccatcgacgagatggagagcgccgccagcaccctgctgaacggcaacgtgagacccagagccaacggcgacgtgggccccctgagccacagacaggactacgagctgcaggacttcggccccggctacagcgacgaggagcccgaccccggcagagacgaggaggacctggccgacgagatgatctgcatcaccaccctgtag

SEQ ID NO: 75040 - DNA, 6414 bp, Artificial Sequence
  Description of Artificial Sequence: Synthetic coding sequence
atgatgatgatgatgatgatgaagaagatgcagcaccagagacagcagcaggccgaccacgccaacgaggccaactacgccagaggcaccagactgcccctgagcggcgagggccccaccagccagcccaacagcagcaagcagaccgtgctgagctggcaggccgccatcgacgccgccagacaggccaaggccgcccagaccatgagcaccagcgcccccccccccgtgggcagcctgagccagagaaagagacagcagtacgccaagagcaagaagcagggcaacagcagcaacagcagacccgccagagccctgttctgcctgagcctgaacaaccccatcagaagagcctgcatcagcatcgtggagtggaagcccttcgacatcttcatcctgctggccatcttcgccaactgcgtggccctggccatctacatccccttccccgaggacgacagcaacagcaccaaccacaacctggagaaggtggagtacgccttcctgatcatcttcaccgtggagaccttcctgaagatcatcgcctacggcctgctgctgcaccccaacgcctacgtgagaaacggctggaacctgctggacttcgtgatcgtgatcgtgggcctgttcagcgtgatcctggagcagctgaccaaggagaccgagggcggcaaccacagcagcggcaagagcggcggcttcgacgtgaaggccctgagagccttcagagtgctgagacccctgagactggtgagcggcgtgcccagcctgcaggtggtgctgaacagcatcatcaaggccatggtgcccctgctgcacatcgccctgctggtgctgttcgtgatcatcatctacgccatcatcggcctggagctgttcatcggcaagatgcacaagacctgcttcttcgccgacagcgacatcgtggccgaggaggaccccgccccctgcgccttcagcggcaacggcagacagtgcaccgccaacggcaccgagtgcagaagcggctgggtgggccccaacggcggcatcaccaacttcgacaacttcgccttcgccatgctgaccgtgttccagtgcatcaccatggagggctggaccgacgtgctgtactggatgaacgacgccatgggcttcgagctgccctgggtgtacttcgtgagcctggtgatcttcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggaggagggcggcgaggagggcaagagaaacaccagcatgcccaccagcgagaccgagagcgtgaacaccgagaacgtgagcggcgagggcgagaacagaggctgctgcggcagcctgtgccaggccatcagcaagagcaagctgagcagaagatggagaagatggaacagattcaacagaagaagatgcagagccgccgtgaagagcgtgaccttctactggctggtgatcgtgctggtgttcctgaacaccctgaccatcagcagcgagcactacaaccagcccgactggctgacccagatccaggacatcgccaacaaggtgctgctggccctgttcacctgcgagatgctggtgaagatgtacagcctgggcctgcaggcctacttcgtgagcctgttcaacagattcgactgcttcgtggtgtgcggcggcatcaccgagaccatcctggtggagctggagatcatgagccccctgggcatcagcgtgttcagatgcgtgagactgctgagaatcttcaaggtgaccagacactggaccagcctgagcaacctggtggccagcctgctgaacagcatgaagagcatcgccagcctgctgctgctgctgttcctgttcatcatcatcttcagcctgctgggcatgcagctgttcggcggcaagttcaacttcgacgagacccagaccaagagaagcaccttcgacaacttcccccaggccctgctgaccgtgttccagatcctgaccggcgaggactggaacgccgtgatgtacgacggcatcatggcctacggcggccccagcagcagcggcatgatcgtgtgcatctacttcatcatcctgttcatctgcggcaactacatcctgctgaacgtgttcctggccatcgccgtggacaacctggccgacgccgagagcctgaacaccgcccagaaggaggaggccgaggagaaggagagaaagaagatcgccagaaaggagagcctggagaacaagaagaacaacaagcccgaggtgaaccagatcgccaacagcgacaacaaggtgaccatcgacgactacagagaggaggacgaggacaaggacccctaccccccctgcgacgtgcccgtgggcgaggaggaggaggaggaggaggaggacgagcccgaggtgcccgccggccccagacccagaagaatcagcgagctgaacatgaaggagaagatcgcccccatccccgagggcagcgccttcttcatcctgagcaagaccaaccccatcagagtgggctgccacaagctgatcaaccaccacatcttcaccaacctgatcctggtgttcatcatgctgagcagcgccgccctggccgccgaggaccccatcagaagccacagcttcagaaacaccatcctgggctacttcgactacgccttcaccgccatcttcaccgtggagatcctgctgaagatgaccaccttcggcgccttcctgcacaagggcgccttctgcagaaactacttcaacctgctggacatgctggtggtgggcgtgagcctggtgagcttcggcatccagagcagcgccatcagcgtggtgaagatcctgagagtgctgagagtgctgagacccctgagagccatcaacagagccaagggcctgaagcacgtggtgcagtgcgtgttcgtggccatcagaaccatcggcaacatcatgatcgtgaccaccctgctgcagttcatgttcgcctgcatcggcgtgcagctgttcaagggcaagttctacagatgcaccgacgaggccaagagcaaccccgaggagtgcagaggcctgttcatcctgtacaaggacggcgacgtggacagccccgtggtgagagagagaatctggcagaacagcgacttcaacttcgacaacgtgctgagcgccatgatggccctgttcaccgtgagcaccttcgagggctggcccgccctgctgtacaaggccatcgacagcaacggcgagaacatcggccccatctacaaccacagagtggagatcagcatcttcttcatcatctacatcatcatcgtggccttcttcatgatgaacatcttcgtgggcttcgtgatcgtgaccttccaggagcagggcgagaaggagtacaagaactgcgagctggacaagaaccagagacagtgcgtggagtacgccctgaaggccagacccctgagaagatacatccccaagaacccctaccagtacaagttctggtacgtggtgaacagcagccccttcgagtacatgatgttcgtgctgatcatgctgaacaccctgtgcctggccatgcagcactacgagcagagcaagatgttcaacgacgccatggacatcctgaacatggtgttcaccggcgtgttcaccgtggagatggtgctgaaggtgatcgccttcaagcccaagggctacttcagcgacgcctggaacaccttcgacagcctgatcgtgatcggcagcatcatcgacgtggccctgagcgaggccgacaacagcgaggagagcaacagaatcagcatcaccttcttcagactgttcagagtgatgagactggtgaagctgctgagcagaggcgagggcatcagaaccctgctgtggaccttcatcaagagcttccaggccctgccctacgtggccctgctgatcgccatgctgttcttcatctacgccgtgatcggcatgcagatgttcggcaaggtggccatgagagacaacaaccagatcaacagaaacaacaacttccagaccttcccccaggccgtgctgctgctgttcagatgcgccaccggcgaggcctggcaggagatcatgctggcctgcctgcccggcaagctgtgcgaccccgagagcgactacaaccccggcgaggagtacacctgcggcagcaacttcgccatcgtgtacttcatcagcttctacatgctgtgcgccttcctgatcatcaacctgttcgtggccgtgatcatggacaacttcgactacctgaccagagactggagcatcctgggcccccaccacctggacgagttcaagagaatctggagcgagtacgaccccgaggccaagggcagaatcaagcacctggacgtggtgaccctgctgagaagaatccagccccccctgggcttcggcaagctgtgcccccacagagtggcctgcaagagactggtggccatgaacatgcccctgaacagcgacggcaccgtgatgttcaacgccaccctgttcgccctggtgagaaccgccctgaagatcaagaccgagggcaacctggagcaggccaacgaggagctgagagccgtgatcaagaagatctggaagaagaccagcatgaagctgctggaccaggtggtgccccccgccggcgacgacgaggtgaccgtgggcaagttctacgccaccttcctgatccaggactacttcagaaagttcaagaagagaaaggagcagggcctggtgggcaagtaccccgccaagaacaccaccatcgccctgcaggccggcctgagaaccctgcacgacatcggccccgagatcagaagagccatcagctgcgacctgcaggacgacgagcccgaggagaccaagagagaggaggaggacgacgtgttcaagagaaacggcgccctgctgggcaaccacgtgaaccacgtgaacagcgacagaagagacagcctgcagcagaccaacaccacccacagacccctgcacgtgcagagacccagcatcccccccgccagcgacaccgagaagcccctgttcccccccgccggcaacagcgtgtgccacaaccaccacaaccacaacagcatcggcaagcaggtgcccaccagcaccaacgccaacctgaacaacgccaacatgagcaaggccgcccacggcaagagacccagcatcggcaacctggagcacgtgagcgagaacggccaccacagcagccacaagcacgacagagagccccagagaagaagcagcgtgaagagaagcgacagcggcgacgagcagctgcccaccatctgcagagaggaccccgagatccacggctacttcagagacccccactgcctgggcgagcaggagtacttcagcagcgaggagtgctacgaggacgacagcagccccacctggagcagacagaactacggctactacagcagataccccggcagaaacatcgacagcgagagacccagaggctaccaccacccccagggcttcctggaggacgacgacagccccgtgtgctacgacagcagaagaagccccagaagaagactgctgccccccacccccgccagccacagaagaagcagcttcaacttcgagtgcctgagaagacagagcagccaggaggaggtgcccagcagccccatcttcccccacagaaccgccctgcccctgcacctgatgcagcagcagatcatggccgtggccggcctggacagcagcaaggcccagaagtacagccccagccacagcaccagaagctgggccaccccccccgccacccccccctacagagactggaccccctgctacacccccctgatccaggtggagcagagcgaggccctggaccaggtgaacggcagcctgcccagcctgcacagaagcagctggtacaccgacgagcccgacatcagctacagaaccttcacccccgccagcctgaccgtgcccagcagcttcagaaacaagaacagcgacaagcagagaagcgccgacagcctggtggaggccgtgctgatcagcgagggcctgggcagatacgccagagaccccaagttcgtgagcgccaccaagcacgagatcgccgacgcctgcgacctgaccatcgacgagatggagagcgccgccagcaccctgctgaacggcaacgtgagacccagagccaacggcgacgtgggccccctgagccacagacaggactacgagctgcaggacttcggccccggctacagcgacgaggagcccgaccccggcagagacgaggaggacctggccgacgagatgatctgcatcaccaccctgtag

SEQ ID NO: 75041 - DNA, 5565 bp, Artificial Sequence
  Description of Artificial Sequence: Synthetic coding sequence
gccaacggcaccgagtgcagaagcggctgggtgggccccaacggcggcatcaccaacttcgacaacttcgccttcgccatgctgaccgtgttccagtgcatcaccatggagggctggaccgacgtgctgtactggatgaacgacgccatgggcttcgagctgccctgggtgtacttcgtgagcctggtgatcttcggcagcttcttcgtgctgaacctggtgctgggcgtgctgagcggcgagttcagcaaggagagagagaaggccaaggccagaggcgacttccagaagctgagagagaagcagcagctggaggaggacctgaagggctacctggactggatcacccaggccgaggacatcgaccccgagaacgaggaggagggcggcgaggagggcaagagaaacaccagcatgcccaccagcgagaccgagagcgtgaacaccgagaacgtgagcggcgagggcgagaacagaggctgctgcggcagcctgtggtgctggtggagaagaagaggcgccgccaaggccggccccagcggctgcagaagatggggccaggccatcagcaagagcaagctgagcagaagatggagaagatggaacagattcaacagaagaagatgcagagccgccgtgaagagcgtgaccttctactggctggtgatcgtgctggtgttcctgaacaccctgaccatcagcagcgagcactacaaccagcccgactggctgacccagatccaggacatcgccaacaaggtgctgctggccctgttcacctgcgagatgctggtgaagatgtacagcctgggcctgcaggcctacttcgtgagcctgttcaacagattcgactgcttcgtggtgtgcggcggcatcaccgagaccatcctggtggagctggagatcatgagccccctgggcatcagcgtgttcagatgcgtgagactgctgagaatcttcaaggtgaccagacactggaccagcctgagcaacctggtggccagcctgctgaacagcatgaagagcatcgccagcctgctgctgctgctgttcctgttcatcatcatcttcagcctgctgggcatgcagctgttcggcggcaagttcaacttcgacgagacccagaccaagagaagcaccttcgacaacttcccccaggccctgctgaccgtgttccagatcctgaccggcgaggactggaacgccgtgatgtacgacggcatcatggcctacggcggccccagcagcagcggcatgatcgtgtgcatctacttcatcatcctgttcatctgcggcaactacatcctgctgaacgtgttcctggccatcgccgtggacaacctggccgacgccgagagcctgaacaccgcccagaaggaggaggccgaggagaaggagagaaagaagatcgccagaaaggagagcctggagaacaagaagaacaacaagcccgaggtgaaccagatcgccaacagcgacaacaaggtgaccatcgacgactacagagaggaggacgaggacaaggacccctaccccccctgcgacgtgcccgtgggcgaggaggaggaggaggaggaggaggacgagcccgaggtgcccgccggccccagacccagaagaatcagcgagctgaacatgaaggagaagatcgcccccatccccgagggcagcgccttcttcatcctgagcaagaccaaccccatcagagtgggctgccacaagctgatcaaccaccacatcttcaccaacctgatcctggtgttcatcatgctgagcagcgccgccctggccgccgaggaccccatcagaagccacagcttcagaaacaccatcctgggctacttcgactacgccttcaccgccatcttcaccgtggagatcctgctgaagatgaccaccttcggcgccttcctgcacaagggcgccttctgcagaaactacttcaacctgctggacatgctggtggtgggcgtgagcctggtgagcttcggcatccagagcagcgccatcagcgtggtgaagatcctgagagtgctgagagtgctgagacccctgagagccatcaacagagccaagggcctgaagcacgtggtgcagtgcgtgttcgtggccatcagaaccatcggcaacatcatgatcgtgaccaccctgctgcagttcatgttcgcctgcatcggcgtgcagctgttcaagggcaagttctacagatgcaccgacgaggccaagagcaaccccgaggagtgcagaggcctgttcatcctgtacaaggacggcgacgtggacagccccgtggtgagagagagaatctggcagaacagcgacttcaacttcgacaacgtgctgagcgccatgatggccctgttcaccgtgagcaccttcgagggctggcccgccctgctgtacaaggccatcgacagcaacggcgagaacatcggccccatctacaaccacagagtggagatcagcatcttcttcatcatctacatcatcatcgtggccttcttcatgatgaacatcttcgtgggcttcgtgatcgtgaccttccaggagcagggcgagaaggagtacaagaactgcgagctggacaagaaccagagacagtgcgtggagtacgccctgaaggccagacccctgagaagatacatccccaagaacccctaccagtacaagttctggtacgtggtgaacagcagccccttcgagtacatgatgttcgtgctgatcatgctgaacaccctgtgcctggccatgcagcactacgagcagagcaagatgttcaacgacgccatggacatcctgaacatggtgttcaccggcgtgttcaccgtggagatggtgctgaaggtgatcgccttcaagcccaagcactacttcaccgacgcctggaacaccttcgacgccctgatcgtggtgggcagcgtggtggacatcgccatcaccgaggtgaaccccaccgagagcgagaacgtgcccgtgcccaccgccacccccggcaacagcgaggagagcaacagaatcagcatcaccttcttcagactgttcagagtgatgagactggtgaagctgctgagcagaggcgagggcatcagaaccctgctgtggaccttcatcaagagcttccaggccctgccctacgtggccctgctgatcgccatgctgttcttcatctacgccgtgatcggcatgcagatgttcggcaaggtggccatgagagacaacaaccagatcaacagaaacaacaacttccagaccttcccccaggccgtgctgctgctgttcagatgcgccaccggcgaggcctggcaggagatcatgctggcctgcctgcccggcaagctgtgcgaccccgagagcgactacaaccccggcgaggagtacacctgcggcagcaacttcgccatcgtgtacttcatcagcttctacatgctgtgcgccttcctgatcatcaacctgttcgtggccgtgatcatggacaacttcgactacctgaccagagactggagcatcctgggcccccaccacctggacgagttcaagagaatctggagcgagtacgaccccgaggccaagggcagaatcaagcacctggacgtggtgaccctgctgagaagaatccagccccccctgggcttcggcaagctgtgcccccacagagtggcctgcaagagactggtggccatgaacatgcccctgaacagcgacggcaccgtgatgttcaacgccaccctgttcgccctggtgagaaccgccctgaagatcaagaccgagggcaacctggagcaggccaacgaggagctgagagccgtgatcaagaagatctggaagaagaccagcatgaagctgctggaccaggtggtgccccccgccggcgacgacgaggtgaccgtgggcaagttctacgccaccttcctgatccaggactacttcagaaagttcaagaagagaaaggagcagggcctggtgggcaagtaccccgccaagaacaccaccatcgccctgcaggccggcctgagaaccctgcacgacatcggccccgagatcagaagagccatcagctgcgacctgcaggacgacgagcccgaggagaccaagagagaggaggaggacgacgtgttcaagagaaacggcgccctgctgggcaaccacgtgaaccacgtgaacagcgacagaagagacagcctgcagcagaccaacaccacccacagacccctgcacgtgcagagacccagcatcccccccgccagcgacaccgagaagcccctgttcccccccgccggcaacagcgtgtgccacaaccaccacaaccacaacagcatcggcaagcaggtgcccaccagcaccaacgccaacctgaacaacgccaacatgagcaaggccgcccacggcaagagacccagcatcggcaacctggagcacgtgagcgagaacggccaccacagcagccacaagcacgacagagagccccagagaagaagcagcgtgaagagaaccagatactacgagacctacatcagaagcgacagcggcgacgagcagctgcccaccatctgcagagaggaccccgagatccacggctacttcagagacccccactgcctgggcgagcaggagtacttcagcagcgaggagtgctacgaggacgacagcagccccacctggagcagacagaactacggctactacagcagataccccggcagaaacatcgacagcgagagacccagaggctaccaccacccccagggcttcctggaggacgacgacagccccgtgtgctacgacagcagaagaagccccagaagaagactgctgccccccacccccgccagccacagaagaagcagcttcaacttcgagtgcctgagaagacagagcagccaggaggaggtgcccagcagccccatcttcccccacagaaccgccctgcccctgcacctgatgcagcagcagatcatggccgtggccggcctggacagcagcaaggcccagaagtacagccccagccacagcaccagaagctgggccaccccccccgccacccccccctacagagactggaccccctgctacacccccctgatccaggtggagcagagcgaggccctggaccaggtgaacggcagcctgcccagcctgcacagaagcagctggtacaccgacgagcccgacatcagctacagaaccttcacccccgccagcctgaccgtgcccagcagcttcagaaacaagaacagcgacaagcagagaagcgccgacagcctggtggaggccgtgctgatcagcgagggcctgggcagatacgccagagaccccaagttcgtgagcgccaccaagcacgagatcgccgacgcctgcgacctgaccatcgacgagatggagagcgccgccagcaccctgctgaacggcaacgtgagacccagagccaacggcgacgtgggccccctgagccacagacaggactacgagctgcaggacttcggccccggctacagcgacgaggagcccgaccccggcagagacgaggaggacctggccgacgagatgatctgcatcaccaccctgtag

SEQ ID NO: 75042 - DNA, 1620 bp, Artificial Sequence
  Description of Artificial Sequence: Synthetic coding sequence
atgggcgagacctggctgtgccccgccgccctgggcctgctgtacaaggccatcgacagcaacggcgagaacatcggccccatctacaaccacagagtggagatcagcatcttcttcatcatctacatcatcatcgtggccttcttcatgatgaacatcttcgtgggcttcgtgatcgtgaccttccaggagcagggcgagaaggagtacaagaactgcgagctggacaagaaccagagacagtgcgtggagtacgccctgaaggccagacccctgagaagatacatccccaagaacccctaccagtacaagttctggtacgtggtgaacagcagccccttcgagtacatgatgttcgtgctgatcatgctgaacaccctgtgcctggccatgcagcactacgagcagagcaagatgttcaacgacgccatggacatcctgaacatggtgttcaccggcgtgttcaccgtggagatggtgctgaaggtgatcgccttcaagcccaagggctacttcagcgacgcctggaacaccttcgacagcctgatcgtgatcggcagcatcatcgacgtggccctgagcgaggccgacaacagcgaggagagcaacagaatcagcatcaccttcttcagactgttcagagtgatgagactggtgaagctgctgagcagaggcgagggcatcagaaccctgctgtggaccttcatcaagagcttccaggccctgccctacgtggccctgctgatcgccatgctgttcttcatctacgccgtgatcggcatgcagatgttcggcaaggtggccatgagagacaacaaccagatcaacagaaacaacaacttccagaccttcccccaggccgtgctgctgctgttcagatgcgccaccggcgaggcctggcaggagatcatgctggcctgcctgcccggcaagctgtgcgaccccgagagcgactacaaccccggcgaggagtacacctgcggcagcaacttcgccatcgtgtacttcatcagcttctacatgctgtgcgccttcctgatcatcaacctgttcgtggccgtgatcatggacaacttcgactacctgaccagagactggagcatcctgggcccccaccacctggacgagttcaagagaatctggagcgagtacgaccccgaggccaagggcagaatcaagcacctggacgtggtgaccctgctgagaagaatccagccccccctgggcttcggcaagctgtgcccccacagagtggcctgcaagagactggtggccatgaacatgcccctgaacagcgacggcaccgtgatgttcaacgccaccctgttcgccctggtgagaaccgccctgaagatcaagaccgagggcaacctggagcaggccaacgaggagctgagagccgtgatcaagaagatctggaagaagaccagcatgaagctgctggaccaggtggtgccccccgccggcgacgacgaggtgaccgtgggcaagttctacgccaccttcctgatccaggactacttcagaaagttcaagaagagaaaggagcagggcctggtgggcaagtaccccgccaagaacaccaccatcgccctgcagatgctggagagaatgctgtag

SEQ ID NO: 75043 - DNA, 1056 bp, Artificial Sequence
  Description of Artificial Sequence: Synthetic coding sequence
atgaacggcctggcccagagcagactggagacctgcatcagctacctgcactgctacagcgccggcctgagaaccctgcacgacatcggccccgagatcagaagagccatcagctgcgacctgcaggacgacgagcccgaggagaccaagagagaggaggaggacgacgtgttcaagagaaacggcgccctgctgggcaaccacgtgaaccacgtgaacagcgacagaagagacagcctgcagcagaccaacaccacccacagacccctgcacgtgcagagacccagcatcccccccgccagcgacaccgagaagcccctgttcccccccgccggcaacagcgtgtgccacaaccaccacaaccacaacagcatcggcaagcaggtgcccaccagcaccaacgccaacctgaacaacgccaacatgagcaaggccgcccacggcaagagacccagcatcggcaacctggagcacgtgagcgagaacggccaccacagcagccacaagcacgacagagagccccagagaagaagcagcgtgaagagaaccagatactacgagacctacatcagaagcgacagcggcgacgagcagctgcccaccatctgcagagaggaccccgagatccacggctacttcagagacccccactgcctgggcgagcaggagtacttcagcagcgaggagtgctacgaggacgacagcagccccacctggagcagacagaactacggctactacagcagataccccggcagaaacatcgacagcgagagacccagaggctaccaccacccccagggcttcctggaggacgacgacagccccgtgtgctacgacagcagaagaagccccagaagaagactgctgccccccacccccgccagccacagaagaagcagcttcaacttcgagtgcctgagaagacagagcagccaggaggaggtgcccagcagccccatcttcccccacagaaccgccctgcccctgcacctgatgcagcagcagagccccctgagcagcgaccacggcagctgcagacccagattcaagtag

SEQ ID NO: 75044 - DNA, 5901 bp, Artificial Sequence
  Description of Artificial Sequence: Synthetic coding sequence
atgagcgagagcgagggcggcaaggacaccacccccgagcccagccccgccaacggcgccggccccggccccgagtggggcctgtgccccggcccccccgccgtggagggcgagagcagcggcgccagcggcctgggcacccccaagagaagaaaccagcacagcaagcacaagaccgtggccgtggccagcgcccagagaagccccagagccctgttctgcctgaccctggccaaccccctgagaagaagctgcatcagcatcgtggagtggaagcccttcgacatcctgatcctgctgaccatcttcgccaactgcgtggccctgggcgtgtacatccccttccccgaggacgacagcaacaccgccaaccacaacctggagcaggtggagtacgtgttcctggtgatcttcaccgtggagaccgtgctgaagatcgtggcctacggcctggtgctgcaccccagcgcctacatcagaaacggctggaacctgctggacttcatcatcgtggtggtgggcctgttcagcgtgctgctggagcagggccccggcagacccggcgacgccccccacaccggcggcaagcccggcggcttcgacgtgaaggccctgagagccttcagagtgctgagacccctgagactggtgagcggcgtgcccagcctgcacatcgtgctgaacagcatcatgaaggccctggtgcccctgctgcacatcgccctgctggtgctgttcgtgatcatcatctacgccatcatcggcctggagctgttcctgggcagaatgcacaagacctgctacttcctgggcagcgacatggaggccgaggaggaccccagcccctgcgccagcagcggcagcggcagagcctgcaccctgaaccagaccgagtgcagaggcagatggcccggccccaacggcggcatcaccaacttcgacaacttcttcttcgccatgctgaccgtgttccagtgcgtgaccatggagggctggaccgacgtgctgtactggatgcaggacgccatgggctacgagctgccctgggtgtacttcgtgagcctggtgatcttcggcagcttcttcgtgctgaacctggtgctgggcgtgctgagcggcgagttcagcaaggagagagagaaggccaaggccagaggcgacttccagaagcagagagagaagcagcagatggaggaggacctgagaggctacctggactggatcacccaggccgaggagctggacatggaggaccccagcgccgacgacaacctgggcccccagctggccgagctgaccaacagaagaagaggcagactgagatggttcagccacagcaccagaagcacccacagcaccagcagccacgccagcctgcccgccagcgacaccggcagcatgaccgagacccagggcgacgaggacgaggaggagggcgccctggccagctgcaccagatgcctgaacaagatcatgaagaccagagtgtgcagaagactgagaagagccaacagagtgctgagagccagatgcagaagagccgtgaagagcaacgcctgctactgggccgtgctgctgctggtgttcctgaacaccctgaccatcgccagcgagcaccacggccagcccgtgtggctgacccagatccaggagtacgccaacaaggtgctgctgtgcctgttcaccgtggagatgctgctgaagctgtacggcctgggccccagcgcctacgtgagcagcttcttcaacagattcgactgcttcgtggtgtgcggcggcatcctggagaccaccctggtggaggtgggcgccatgcagcccctgggcatcagcgtgctgagatgcgtgagactgctgagaatcttcaaggtgaccagacactgggccagcctgagcaacctggtggccagcctgctgaacagcatgaagagcatcgccagcctgctgctgctgctgttcctgttcatcatcatcttcagcctgctgggcatgcagctgttcggcggcaagttcaacttcgaccagacccacaccaagagaagcaccttcgacaccttcccccaggccctgctgaccgtgttccagatcctgaccggcgaggactggaacgtggtgatgtacgacggcatcatggcctacggcggccccttcttccccggcatgctggtgtgcatctacttcatcatcctgttcatctgcggcaactacatcctgctgaacgtgttcctggccatcgccgtggacaacctggccagcggcgacgccggcaccgccaaggacaagggcggcgagaagagcaacgagaaggacctgccccaggagaacgagggcctggtgcccggcgtggagaaggaggaggaggagggcgccagaagagagggcgccgacatggaggaggaggaggaggaggaggaggaggaggaggaggaggaggaggaggagggcgccggcggcgtggagctgctgcaggaggtggtgcccaaggagaaggtggtgcccatccccgagggcagcgccttcttctgcctgagccagaccaaccccctgagaaagggctgccacaccctgatccaccaccacgtgttcaccaacctgatcctggtgttcatcatcctgagcagcgtgagcctggccgccgaggaccccatcagagcccacagcttcagaaaccacatcctgggctacttcgactacgccttcaccagcatcttcaccgtggagatcctgctgaagatgaccgtgttcggcgccttcctgcacagaggcagcttctgcagaagctggttcaacatgctggacctgctggtggtgagcgtgagcctgatcagcttcggcatccacagcagcgccatcagcgtggtgaagatcctgagagtgctgagagtgctgagacccctgagagccatcaacagagccaagggcctgaagcacgtggtgcagtgcgtgttcgtggccatcagaaccatcggcaacatcatgatcgtgaccaccctgctgcagttcatgttcgcctgcatcggcgtgcagctgttcaagggcaagttctacacctgcaccgacgaggccaagcacaccccccaggagtgcaagggcagcttcctggtgtaccccgacggcgacgtgagcagacccctggtgagagagagactgtgggtgaacagcgacttcaacttcgacaacgtgctgagcgccatgatggccctgttcaccgtgagcaccttcgagggctggcccgccctgctgtacaaggccatcgacgcctacgccgaggaccacggccccatctacaactacagagtggagatcagcgtgttcttcatcgtgtacatcatcatcatcgccttcttcatgatgaacatcttcgtgggcttcgtgatcatcaccttcagagcccagggcgagcaggagtaccagaactgcgagctggacaagaaccagagacagtgcgtggagtacgccctgaaggcccagcccctgagaagatacatccccaagaacccccaccagtacagagtgtgggccaccgtgaacagcgccgccttcgagtacctgatgttcctgctgatcctgctgaacaccgtggccctggccatgcagcactacgagcagaccgcccccttcaactacgccatggacatcctgaacatggtgttcaccggcctgttcaccatcgagatggtgctgaagatcatcgccttcaagcccaagcactacttcaccgacgcctggaacaccttcgacgccctgatcgtggtgggcagcatcgtggacatcgccgtgaccgaggtgaacaacggcggccacctgggcgagagcagcgaggacagcagcagaatcagcatcaccttcttcagactgttcagagtgatgagactggtgaagctgctgagcaagggcgagggcatcagaaccctgctgtggaccttcatcaagagcttccaggccctgccctacgtggccctgctgatcgccatgatcttcttcatctacgccgtgatcggcatgcagatgttcggcaaggtggccctgcaggacggcacccagatcaacagaaacaacaacttccagaccttcccccaggccgtgctgctgctgttcagatgcgccaccggcgaggcctggcaggagatcatgctggccagcctgcccggcaacagatgcgaccccgagagcgacttcggccccggcgaggagttcacctgcggcagcaacttcgccatcgcctacttcatcagcttcttcatgctgtgcgccttcctgatcatcaacctgttcgtggccgtgatcatggacaacttcgactacctgaccagagactggagcatcctgggcccccaccacctggacgagttcaagagaatctggagcgagtacgaccccggcgccaagggcagaatcaagcacctggacgtggtggccctgctgagaagaatccagccccccctgggcttcggcaagctgtgcccccacagagtggcctgcaagagactggtggccatgaacatgcccctgaacagcgacggcaccgtgaccttcaacgccaccctgttcgccctggtgagaaccagcctgaagatcaagaccgagggcaacctggagcaggccaaccaggagctgagaatcgtgatcaagaagatctggaagagaatgaagcagaagctgctggacgaggtgatccccccccccgacgaggaggaggtgaccgtgggcaagttctacgccaccttcctgatccaggactacttcagaaagttcagaagaagaaaggagaagggcctgctgggcaacgacgccgcccccagcaccagcagcgccctgcaggccggcctgagaagcctgcaggacctgggccccgagatgagacaggccctgacctgcgacaccgaggaggaggaggaggagggccaggagggcgtggaggaggaggacgagaaggacctggagaccaacaaggccaccatggtgagccagcccagcgccagaagaggcagcggcatcagcgtgagcctgcccgtgggcgacagactgcccgacagcctgagcttcggccccagcgacgacgacagaggcacccccaccagcagccagcccagcgtgccccaggccggcagcaacacccacagaagaggcagcggcgccctgatcttcaccatccccgaggagggcaacagccagcccaagggcaccaagggccagaacaagcaggacgaggacgaggaggtgcccgacagactgagctacctggacgagcaggccggcacccccccctgcagcgtgctgctgcccccccacagagcccagagatacatggacggccacctggtgcccagaagaagactgctgccccccacccccgccggcagaaagcccagcttcaccatccagtgcctgcagagacagggcagctgcgaggacctgcccatccccggcacctaccacagaggcagaaacagcggccccaacagagcccagggcagctgggccacccccccccagagaggcagactgctgtacgcccccctgctgctggtggaggagggcgccgccggcgagggctacctgggcagaagcagcggccccctgagaaccttcacctgcctgcacgtgcccggcacccacagcgaccccagccacggcaagagaggcagcgccgacagcctggtggaggccgtgctgatcagcgagggcctgggcctgttcgccagagaccccagattcgtggccctggccaagcaggagatcgccgacgcctgcagactgaccctggacgagatggacaacgccgccagcgacctgctggcccagggcaccagcagcctgtacagcgacgaggagagcatcctgagcagattcgacgaggaggacctgggcgacgagatggcctgcgtgcacgccctgtag

SEQ ID NO: 75045 - DNA, 5739 bp, Artificial Sequence
  Description of Artificial Sequence: Synthetic coding sequence
atgagcgagagcgagggcggcaagggcgagagaatcctgcccagcctgcagaccctgggcgccagcatcgtggagtggaagcccttcgacatcctgatcctgctgaccatcttcgccaactgcgtggccctgggcgtgtacatccccttccccgaggacgacagcaacaccgccaaccacaacctggagcaggtggagtacgtgttcctggtgatcttcaccgtggagaccgtgctgaagatcgtggcctacggcctggtgctgcaccccagcgcctacatcagaaacggctggaacctgctggacttcatcatcgtggtggtgggcctgttcagcgtgctgctggagcagggccccggcagacccggcgacgccccccacaccggcggcaagcccggcggcttcgacgtgaaggccctgagagccttcagagtgctgagacccctgagactggtgagcggcgtgcccagcctgcacatcgtgctgaacagcatcatgaaggccctggtgcccctgctgcacatcgccctgctggtgctgttcgtgatcatcatctacgccatcatcggcctggagctgttcctgggcagaatgcacaagacctgctacttcctgggcagcgacatggaggccgaggaggaccccagcccctgcgccagcagcggcagcggcagagcctgcaccctgaaccagaccgagtgcagaggcagatggcccggccccaacggcggcatcaccaacttcgacaacttcttcttcgccatgctgaccgtgttccagtgcgtgaccatggagggctggaccgacgtgctgtactggatgcaggacgccatgggctacgagctgccctgggtgtacttcgtgagcctggtgatcttcggcagcttcttcgtgctgaacctggtgctgggcgtgctgagcggcgagttcagcaaggagagagagaaggccaaggccagaggcgacttccagaagcagagagagaagcagcagatggaggaggacctgagaggctacctggactggatcacccaggccgaggagctggacatggaggaccccagcgccgacgacaacctgggcagcatggccgaggagggcagagccggccacagaccccagctggccgagctgaccaacagaagaagaggcagactgagatggttcagccacagcaccagaagcacccacagcaccagcagccacgccagcctgcccgccagcgacaccggcagcatgaccgagacccagggcgacgaggacgaggaggagggcgccctggccagctgcaccagatgcctgaacaagatcatgaagaccagagtgtgcagaagactgagaagagccaacagagtgctgagagccagatgcagaagagccgtgaagagcaacgcctgctactgggccgtgctgctgctggtgttcctgaacaccctgaccatcgccagcgagcaccacggccagcccgtgtggctgacccagatccaggagtacgccaacaaggtgctgctgtgcctgttcaccgtggagatgctgctgaagctgtacggcctgggccccagcgcctacgtgagcagcttcttcaacagattcgactgcttcgtggtgtgcggcggcatcctggagaccaccctggtggaggtgggcgccatgcagcccctgggcatcagcgtgctgagatgcgtgagactgctgagaatcttcaaggtgaccagacactgggccagcctgagcaacctggtggccagcctgctgaacagcatgaagagcatcgccagcctgctgctgctgctgttcctgttcatcatcatcttcagcctgctgggcatgcagctgttcggcggcaagttcaacttcgaccagacccacaccaagagaagcaccttcgacaccttcccccaggccctgctgaccgtgttccagatcctgaccggcgaggactggaacgtggtgatgtacgacggcatcatggcctacggcggccccttcttccccggcatgctggtgtgcatctacttcatcatcctgttcatctgcggcaactacatcctgctgaacgtgttcctggccatcgccgtggacaacctggccagcggcgacgccggcaccgccaaggacaagggcggcgagaagagcaacgagaaggacctgccccaggagaacgagggcctggtgcccggcgtggagaaggaggaggaggagggcgccagaagagagggcgccgacatggaggaggaggaggaggaggaggaggaggaggaggaggaggaggaggaggagggcgccggcggcgtggagctgctgcaggaggtggtgcccaaggagaaggtggtgcccatccccgagggcagcgccttcttctgcctgagccagaccaaccccctgagaaagggctgccacaccctgatccaccaccacgtgttcaccaacctgatcctggtgttcatcatcctgagcagcgtgagcctggccgccgaggaccccatcagagcccacagcttcagaaaccacatcctgggctacttcgactacgccttcaccagcatcttcaccgtggagatcctgctgaagatgaccgtgttcggcgccttcctgcacagaggcagcttctgcagaagctggttcaacatgctggacctgctggtggtgagcgtgagcctgatcagcttcggcatccacagcagcgccatcagcgtggtgaagatcctgagagtgctgagagtgctgagacccctgagagccatcaacagagccaagggcctgaagcacgtggtgcagtgcgtgttcgtggccatcagaaccatcggcaacatcatgatcgtgaccaccctgctgcagttcatgttcgcctgcatcggcgtgcagctgttcaagggcaagttctacacctgcaccgacgaggccaagcacaccccccaggagtgcaagggcagcttcctggtgtaccccgacggcgacgtgagcagacccctggtgagagagagactgtgggtgaacagcgacttcaacttcgacaacgtgctgagcgccatgatggccctgttcaccgtgagcaccttcgagggctggcccgccctgctgtacaaggccatcgacgcctacgccgaggaccacggccccatctacaactacagagtggagatcagcgtgttcttcatcgtgtacatcatcatcatcgccttcttcatgatgaacatcttcgtgggcttcgtgatcatcaccttcagagcccagggcgagcaggagtaccagaactgcgagctggacaagaaccagagacagtgcgtggagtacgccctgaaggcccagcccctgagaagatacatccccaagaacccccaccagtacagagtgtgggccaccgtgaacagcgccgccttcgagtacctgatgttcctgctgatcctgctgaacaccgtggccctggccatgcagcactacgagcagaccgcccccttcaactacgccatggacatcctgaacatggtgttcaccggcctgttcaccatcgagatggtgctgaagatcatcgccttcaagcccaagcactacttcaccgacgcctggaacaccttcgacgccctgatcgtggtgggcagcatcgtggacatcgccgtgaccgaggtgaacaacggcggccacctgggcgagagcagcgaggacagcagcagaatcagcatcaccttcttcagactgttcagagtgatgagactggtgaagctgctgagcaagggcgagggcatcagaaccctgctgtggaccttcatcaagagcttccaggccctgccctacgtggccctgctgatcgccatgatcttcttcatctacgccgtgatcggcatgcagatgttcggcaaggtggccctgcaggacggcacccagatcaacagaaacaacaacttccagaccttcccccaggccgtgctgctgctgttcagatgcgccaccggcgaggcctggcaggagatcatgctggccagcctgcccggcaacagatgcgaccccgagagcgacttcggccccggcgaggagttcacctgcggcagcaacttcgccatcgcctacttcatcagcttcttcatgctgtgcgccttcctgatcatcaacctgttcgtggccgtgatcatggacaacttcgactacctgaccagagactggagcatcctgggcccccaccacctggacgagttcaagagaatctggagcgagtacgaccccggcgccaagggcagaatcaagcacctggacgtggtggccctgctgagaagaatccagccccccctgggcttcggcaagctgtgcccccacagagtggcctgcaagagactggtggccatgaacatgcccctgaacagcgacggcaccgtgaccttcaacgccaccctgttcgccctggtgagaaccagcctgaagatcaagaccgagggcaacctggagcaggccaaccaggagctgagaatcgtgatcaagaagatctggaagagaatgaagcagaagctgctggacgaggtgatccccccccccgacgaggaggaggtgaccgtgggcaagttctacgccaccttcctgatccaggactacttcagaaagttcagaagaagaaaggagaagggcctgctgggcaacgacgccgcccccagcaccagcagcgccctgcaggccggcctgagaagcctgcaggacctgggccccgagatgagacaggccctgacctgcgacaccgaggaggaggaggaggagggccaggagggcgtggaggaggaggacgagaaggacctggagaccaacaaggccaccatggtgagccagcccagcgccagaagaggcagcggcatcagcgtgagcctgcccgtgggcgacagactgcccgacagcctgagcttcggccccagcgacgacgacagaggcacccccaccagcagccagcccagcgtgccccaggccggcagcaacacccacagaagaggcagcggcgccctgatcttcaccatccccgaggagggcaacagccagcccaagggcaccaagggccagaacaagcaggacgaggacgaggaggtgcccgacagactgagctacctggacgagcaggccggcacccccccctgcagcgtgctgctgcccccccacagagcccagagatacatggacggccacctggtgcccagaagaagactgctgccccccacccccgccggcagaaagcccagcttcaccatccagtgcctgcagagacagggcagctgcgaggacctgcccatccccggcacctaccacagaggcagaaacagcggccccaacagagcccagggcagctgggccacccccccccagagaggcagactgctgtacgcccccctgctgctggtggaggagggcgccgccggcgagggctacctgggcagaagcagcggccccctgagaaccttcacctgcctgcacgtgcccggcacccacagcgaccccagccacggcaagagaggcagcgccgacagcctggtggaggccgtgctgatcagcgagggcctgggcctgttcgccagagaccccagattcgtggccctggccaagcaggagatcgccgacgcctgcagactgaccctggacgagatggacaacgccgccagcgacctgctggcccagggcaccagcagcctgtacagcgacgaggagagcatcctgagcagattcgacgaggaggacctgggcgacgagatggcctgcgtgcacgccctgtag

SEQ ID NO: 75046 - DNA, 5934 bp, Artificial Sequence
  Description of Artificial Sequence: Synthetic coding sequence
atgagcgagagcgagggcggcaaggacaccacccccgagcccagccccgccaacggcgccggccccggccccgagtggggcctgtgccccggcccccccgccgtggagggcgagagcagcggcgccagcggcctgggcacccccaagagaagaaaccagcacagcaagcacaagaccgtggccgtggccagcgcccagagaagccccagagccctgttctgcctgaccctggccaaccccctgagaagaagctgcatcagcatcgtggagtggaagcccttcgacatcctgatcctgctgaccatcttcgccaactgcgtggccctgggcgtgtacatccccttccccgaggacgacagcaacaccgccaaccacaacctggagcaggtggagtacgtgttcctggtgatcttcaccgtggagaccgtgctgaagatcgtggcctacggcctggtgctgcaccccagcgcctacatcagaaacggctggaacctgctggacttcatcatcgtggtggtgggcctgttcagcgtgctgctggagcagggccccggcagacccggcgacgccccccacaccggcggcaagcccggcggcttcgacgtgaaggccctgagagccttcagagtgctgagacccctgagactggtgagcggcgtgcccagcctgcacatcgtgctgaacagcatcatgaaggccctggtgcccctgctgcacatcgccctgctggtgctgttcgtgatcatcatctacgccatcatcggcctggagctgttcctgggcagaatgcacaagacctgctacttcctgggcagcgacatggaggccgaggaggaccccagcccctgcgccagcagcggcagcggcagagcctgcaccctgaaccagaccgagtgcagaggcagatggcccggccccaacggcggcatcaccaacttcgacaacttcttcttcgccatgctgaccgtgttccagtgcgtgaccatggagggctggaccgacgtgctgtactggatgcaggacgccatgggctacgagctgccctgggtgtacttcgtgagcctggtgatcttcggcagcttcttcgtgctgaacctggtgctgggcgtgctgagcggcgagttcagcaaggagagagagaaggccaaggccagaggcgacttccagaagcagagagagaagcagcagatggaggaggacctgagaggctacctggactggatcacccaggccgaggagctggacatggaggaccccagcgccgacgacaacctgggcagcatggccgaggagggcagagccggccacagaccccagctggccgagctgaccaacagaagaagaggcagactgagatggttcagccacagcaccagaagcacccacagcaccagcagccacgccagcctgcccgccagcgacaccggcagcatgaccgagacccagggcgacgaggacgaggaggagggcgccctggccagctgcaccagatgcctgaacaagatcatgaagaccagagtgtgcagaagactgagaagagccaacagagtgctgagagccagatgcagaagagccgtgaagagcaacgcctgctactgggccgtgctgctgctggtgttcctgaacaccctgaccatcgccagcgagcaccacggccagcccgtgtggctgacccagatccaggagtacgccaacaaggtgctgctgtgcctgttcaccgtggagatgctgctgaagctgtacggcctgggccccagcgcctacgtgagcagcttcttcaacagattcgactgcttcgtggtgtgcggcggcatcctggagaccaccctggtggaggtgggcgccatgcagcccctgggcatcagcgtgctgagatgcgtgagactgctgagaatcttcaaggtgaccagacactgggccagcctgagcaacctggtggccagcctgctgaacagcatgaagagcatcgccagcctgctgctgctgctgttcctgttcatcatcatcttcagcctgctgggcatgcagctgttcggcggcaagttcaacttcgaccagacccacaccaagagaagcaccttcgacaccttcccccaggccctgctgaccgtgttccagatcctgaccggcgaggactggaacgtggtgatgtacgacggcatcatggcctacggcggccccttcttccccggcatgctggtgtgcatctacttcatcatcctgttcatctgcggcaactacatcctgctgaacgtgttcctggccatcgccgtggacaacctggccagcggcgacgccggcaccgccaaggacaagggcggcgagaagagcaacgagaaggacctgccccaggagaacgagggcctggtgcccggcgtggagaaggaggaggaggagggcgccagaagagagggcgccgacatggaggaggaggaggaggaggaggaggaggaggaggaggaggaggaggaggagggcgccggcggcgtggagctgctgcaggaggtggtgcccaaggagaaggtggtgcccatccccgagggcagcgccttcttctgcctgagccagaccaaccccctgagaaagggctgccacaccctgatccaccaccacgtgttcaccaacctgatcctggtgttcatcatcctgagcagcgtgagcctggccgccgaggaccccatcagagcccacagcttcagaaaccacatcctgggctacttcgactacgccttcaccagcatcttcaccgtggagatcctgctgaagatgaccgtgttcggcgccttcctgcacagaggcagcttctgcagaagctggttcaacatgctggacctgctggtggtgagcgtgagcctgatcagcttcggcatccacagcagcgccatcagcgtggtgaagatcctgagagtgctgagagtgctgagacccctgagagccatcaacagagccaagggcctgaagcacgtggtgcagtgcgtgttcgtggccatcagaaccatcggcaacatcatgatcgtgaccaccctgctgcagttcatgttcgcctgcatcggcgtgcagctgttcaagggcaagttctacacctgcaccgacgaggccaagcacaccccccaggagtgcaagggcagcttcctggtgtaccccgacggcgacgtgagcagacccctggtgagagagagactgtgggtgaacagcgacttcaacttcgacaacgtgctgagcgccatgatggccctgttcaccgtgagcaccttcgagggctggcccgccctgctgtacaaggccatcgacgcctacgccgaggaccacggccccatctacaactacagagtggagatcagcgtgttcttcatcgtgtacatcatcatcatcgccttcttcatgatgaacatcttcgtgggcttcgtgatcatcaccttcagagcccagggcgagcaggagtaccagaactgcgagctggacaagaaccagagacagtgcgtggagtacgccctgaaggcccagcccctgagaagatacatccccaagaacccccaccagtacagagtgtgggccaccgtgaacagcgccgccttcgagtacctgatgttcctgctgatcctgctgaacaccgtggccctggccatgcagcactacgagcagaccgcccccttcaactacgccatggacatcctgaacatggtgttcaccggcctgttcaccatcgagatggtgctgaagatcatcgccttcaagcccaagcactacttcaccgacgcctggaacaccttcgacgccctgatcgtggtgggcagcatcgtggacatcgccgtgaccgaggtgaacaacggcggccacctgggcgagagcagcgaggacagcagcagaatcagcatcaccttcttcagactgttcagagtgatgagactggtgaagctgctgagcaagggcgagggcatcagaaccctgctgtggaccttcatcaagagcttccaggccctgccctacgtggccctgctgatcgccatgatcttcttcatctacgccgtgatcggcatgcagatgttcggcaaggtggccctgcaggacggcacccagatcaacagaaacaacaacttccagaccttcccccaggccgtgctgctgctgttcagatgcgccaccggcgaggcctggcaggagatcatgctggccagcctgcccggcaacagatgcgaccccgagagcgacttcggccccggcgaggagttcacctgcggcagcaacttcgccatcgcctacttcatcagcttcttcatgctgtgcgccttcctgatcatcaacctgttcgtggccgtgatcatggacaacttcgactacctgaccagagactggagcatcctgggcccccaccacctggacgagttcaagagaatctggagcgagtacgaccccggcgccaagggcagaatcaagcacctggacgtggtggccctgctgagaagaatccagccccccctgggcttcggcaagctgtgcccccacagagtggcctgcaagagactggtggccatgaacatgcccctgaacagcgacggcaccgtgaccttcaacgccaccctgttcgccctggtgagaaccagcctgaagatcaagaccgagggcaacctggagcaggccaaccaggagctgagaatcgtgatcaagaagatctggaagagaatgaagcagaagctgctggacgaggtgatccccccccccgacgaggaggaggtgaccgtgggcaagttctacgccaccttcctgatccaggactacttcagaaagttcagaagaagaaaggagaagggcctgctgggcaacgacgccgcccccagcaccagcagcgccctgcaggccggcctgagaagcctgcaggacctgggccccgagatgagacaggccctgacctgcgacaccgaggaggaggaggaggagggccaggagggcgtggaggaggaggacgagaaggacctggagaccaacaaggccaccatggtgagccagcccagcgccagaagaggcagcggcatcagcgtgagcctgcccgtgggcgacagactgcccgacagcctgagcttcggccccagcgacgacgacagaggcacccccaccagcagccagcccagcgtgccccaggccggcagcaacacccacagaagaggcagcggcgccctgatcttcaccatccccgaggagggcaacagccagcccaagggcaccaagggccagaacaagcaggacgaggacgaggaggtgcccgacagactgagctacctggacgagcaggccggcacccccccctgcagcgtgctgctgcccccccacagagcccagagatacatggacggccacctggtgcccagaagaagactgctgccccccacccccgccggcagaaagcccagcttcaccatccagtgcctgcagagacagggcagctgcgaggacctgcccatccccggcacctaccacagaggcagaaacagcggccccaacagagcccagggcagctgggccacccccccccagagaggcagactgctgtacgcccccctgctgctggtggaggagggcgccgccggcgagggctacctgggcagaagcagcggccccctgagaaccttcacctgcctgcacgtgcccggcacccacagcgaccccagccacggcaagagaggcagcgccgacagcctggtggaggccgtgctgatcagcgagggcctgggcctgttcgccagagaccccagattcgtggccctggccaagcaggagatcgccgacgcctgcagactgaccctggacgagatggacaacgccgccagcgacctgctggcccagggcaccagcagcctgtacagcgacgaggagagcatcctgagcagattcgacgaggaggacctgggcgacgagatggcctgcgtgcacgccctgtag

SEQ ID NO: 75047 - DNA, 5622 bp, Artificial Sequence
  Description of Artificial Sequence: Synthetic coding sequence
atggagcccagcagcccccaggacgagggcctgagaaagaagcagcccaagaagcccgtgcccgagatcctgcccagaccccccagagccctgttctgcctgaccctggagaaccccctgagaaaggcctgcatcagcatcgtggagtggaagcccttcgagaccatcatcctgctgaccatcttcgccaactgcgtggccctggccgtgtacctgcccatgcccgaggacgacaacaacagcctgaacctgggcctggagaagctggagtacttcttcctgatcgtgttcagcatcgaggccgccatgaagatcatcgcctacggcttcctgttccaccaggacgcctacctgagaagcggctggaacgtgctggacttcaccatcgtgttcctgggcgtgttcaccgtgatcctggagcaggtgaacgtgatccagagccacaccgcccccatgagcagcaagggcgccggcctggacgtgaaggccctgagagccttcagagtgctgagacccctgagactggtgagcggcgtgcccagcctgcaggtggtgctgaacagcatcttcaaggccatgctgcccctgttccacatcgccctgctggtgctgttcatggtgatcatctacgccatcatcggcctggagctgttcaagggcaagatgcacaagacctgctacttcatcggcaccgacatcgtggccaccgtggagaacgaggagcccagcccctgcgccagaaccggcagcggcagaagatgcaccatcaacggcagcgagtgcagaggcggctggcccggccccaaccacggcatcacccacttcgacaacttcggcttcagcatgctgaccgtgtaccagtgcatcaccatggagggctggaccgacgtgctgtactgggtgaacgacgccatcggcaacgagtggccctggatctacttcgtgaccctgatcctgctgggcagcttcttcatcctgaacctggtgctgggcgtgctgagcggcgagttcaccaaggagagagagaaggccaagagcagaggcaccttccagaagctgagagagaagcagcagctggacgaggacctgagaggctacatgagctggatcacccagggcgaggtgatggacgtggaggacttcagagagggcaagctgagcctggacgagggcggcagcgacaccgagagcctgtacgagatcgccggcctgaacaagatcatccagttcatcagacactggagacagtggaacagaatcttcagatggaagtgccacgacatcgtgaagagcaaggtgttctactggctggtgatcctgatcgtggccctgaacaccctgagcatcgccagcgagcaccacaaccagcccctgtggctgaccagactgcaggacatcgccaacagagtgctgctgagcctgttcaccaccgagatgctgatgaagatgtacggcctgggcctgagacagtacttcatgagcatcttcaacagattcgactgcttcgtggtgtgcagcggcatcctggagatcctgctggtggagagcggcgccatgacccccctgggcatcagcgtgctgagatgcatcagactgctgagaatcttcaagatcaccaagtactggaccagcctgagcaacctggtggccagcctgctgaacagcatcagaagcatcgccagcctgctgctgctgctgttcctgttcatcgtgatcttcgccctgctgggcatgcagctgttcggcggcagatacgacttcgaggacaccgaggtgagaagaagcaacttcgacaacttcccccaggccctgatcagcgtgttccaggtgctgaccggcgaggactggaccagcatgatgtacaacggcatcatggcctacggcggccccagctaccccggcatgctggtgtgcatctacttcatcatcctgttcgtgtgcggcaactacatcctgctgaacgtgttcctggccatcgccgtggacaacctggccgaggccgagagcctgaccagcgcccagaaggccaaggccgaggagaagaagagaagaaagatgagcaagggcctgcccgacaagagcgaggaggagaagagcaccatggccaagaagctggagcagaagcccaagggcgagggcatccccaccaccgccaagctgaagatcgacgagttcgagagcaacgtgaacgaggtgaaggacccctaccccagcgccgacttccccggcgacgacgaggaggacgagcccgagatccccctgagccccagacccagacccctggccgagctgcagctgaaggagaaggccgtgcccatccccgaggccagcagcttcttcatcttcagccccaccaacaagatcagagtgctgtgccacagaatcgtgaacgccacctggttcaccaacttcatcctgctgttcatcctgctgagcagcgccgccctggccgccgaggaccccatcagagccgacagcatgagaaaccagatcctgaagcacttcgacatcggcttcaccagcgtgttcaccgtggagatcgtgctgaagatgaccacctacggcgccttcctgcacaagggcagcttctgcagaaactacttcaacatgctggacctgctggtggtggccgtgagcctgatcagcatgggcctggagagcagcgccatcagcgtggtgaagatcctgagagtgctgagagtgctgagacccctgagagccatcaacagagccaagggcctgaagcacgtggtgcagtgcatgttcgtggccatcagcaccatcggcaacatcgtgctggtgaccaccctgctgcagttcatgttcgcctgcatcggcgtgcagctgttcaagggcaagttcttcagatgcaccgacctgagcaagatgaccgaggaggagtgcagaggctactactacgtgtacaaggacggcgaccccatgcagatcgagctgagacacagagagtgggtgcacagcgacttccacttcgacaacgtgctgagcgccatgatgagcctgttcaccgtgagcaccttcgagggctggccccagctgctgtacaaggccatcgacagcaacgccgaggacgtgggccccatctacaacaacagagtggagatggccatcttcttcatcatctacatcatcctgatcgccttcttcatgatgaacatcttcgtgggcttcgtgatcgtgaccttccaggagcagggcgagaccgagtacaagaactgcgagctggacaagaaccagagacagtgcgtgcagtacgccctgaaggccagacccctgagatgctacatccccaagaacccctaccagtaccaggtgtggtacatcgtgaccagcagctacttcgagtacctgatgttcgccctgatcatgctgaacaccatctgcctgggcatgcagcactacaaccagagcgagcagatgaaccacatcagcgacatcctgaacgtggccttcaccatcatcttcaccctggagatgatcctgaagctgatggccttcaaggccagaggctacttcggcgacccctggaacgtgttcgacttcctgatcgtgatcggcagcatcatcgacgtgatcctgagcgagatcgacaccttcctggccagcagcggcggcctgtactgcctgggcggcggctgcggcaacgtggaccccgacgagagcgccagaatcagcagcgccttcttcagactgttcagagtgatgagactgatcaagctgctgagcagagccgagggcgtgagaaccctgctgtggaccttcatcaagagcttccaggccctgccctacgtggccctgctgatcgtgatgctgttcttcatctacgccgtgatcggcatgcagatgttcggcaagatcgccctggtggacggcacccagatcaacagaaacaacaacttccagaccttcccccaggccgtgctgctgctgttcagatgcgccaccggcgaggcctggcaggagatcctgctggcctgcagctacggcaagctgtgcgaccccgagagcgactacgcccccggcgaggagtacacctgcggcaccaacttcgcctactactacttcatcagcttctacatgctgtgcgccttcctggtgatcaacctgttcgtggccgtgatcatggacaacttcgactacctgaccagagactggagcatcctgggcccccaccacctggacgagttcaaggccatctgggccgagtacgaccccgaggccaagggcagaatcaagcacctggacgtggtgaccctgctgagaagaatccagccccccctgggcttcggcaagttctgcccccacagagtggcctgcaagagactggtgggcatgaacatgcccctgaacagcgacggcaccgtgaccttcaacgccaccctgttcgccctggtgagaaccgccctgaagatcaagaccgagggcaacttcgagcaggccaacgaggagctgagagccatcatcaagaagatctggaagagaaccagcatgaagctgctggaccaggtgatcccccccatcggcgacgacgaggtgaccgtgggcaagttctacgccaccttcctgatccaggagcacttcagaaagttcatgaagagacaggaggagtactacggctacagacccaagaaggacatcgtgcagatccaggccggcctgagaaccatcgaggaggaggccgcccccgagatctgcagaaccgtgagcggcgacctggccgccgaggaggagctggagagagccatggtggaggccgccatggaggagggcatcttcagaagaaccggcggcctgttcggccaggtggacaacttcctggagagaaccaacagcctgccccccgtgatggccaaccagagacccctgcagttcgccgagatcgagatggaggagatggagagccccgtgttcctggaggacttcccccaggaccccagaaccaaccccctggccagagccaacaccaacaacgccaacgccaacgtggcctacggcaacagcaaccacagcaacagccacgtgttcagcagcgtgcactacgagagagagttccccgaggagaccgagacccccgccaccagaggcagagccctgggccagccctgcagagtgctgggcccccacagcaagccctgcgtggagatgctgaagggcctgctgacccagagagccatgcccagaggccaggccccccccgccccctgccagtgccccagagtggagagcagcatgcccgaggacagaaagagcagcacccccggcagcctgcacgaggagaccccccacagcagaagcaccagagagaacaccagcagatgcagcgcccccgccaccgccctgctgatccagaaggccctggtgagaggcggcctgggcaccctggccgccgacgccaacttcatcatggccaccggccaggccctggccgacgcctgccagatggagcccgaggaggtggagatcatggccaccgagctgctgaagggcagagaggcccccgagggcatggccagcagcctgggctgcctgaacctgggcagcagcctgggcagcctggaccagcaccagggcagccaggagaccctgatcccccccagactgtag

SEQ ID NO: 75048 - DNA, 5565 bp, Artificial Sequence
  Description of Artificial Sequence: Synthetic coding sequence
atggagcccagcagcccccaggacgagggcctgagaaagaagcagcccaagaagcccgtgcccgagatcctgcccagaccccccagagccctgttctgcctgaccctggagaaccccctgagaaaggcctgcatcagcatcgtggagtggaagcccttcgagaccatcatcctgctgaccatcttcgccaactgcgtggccctggccgtgtacctgcccatgcccgaggacgacaacaacagcctgaacctgggcctggagaagctggagtacttcttcctgatcgtgttcagcatcgaggccgccatgaagatcatcgcctacggcttcctgttccaccaggacgcctacctgagaagcggctggaacgtgctggacttcaccatcgtgttcctgggcgtgttcaccgtgatcctggagcaggtgaacgtgatccagagccacaccgcccccatgagcagcaagggcgccggcctggacgtgaaggccctgagagccttcagagtgctgagacccctgagactggtgagcggcgtgcccagcctgcaggtggtgctgaacagcatcttcaaggccatgctgcccctgttccacatcgccctgctggtgctgttcatggtgatcatctacgccatcatcggcctggagctgttcaagggcaagatgcacaagacctgctacttcatcggcaccgacatcgtggccaccgtggagaacgaggagcccagcccctgcgccagaaccggcagcggcagaagatgcaccatcaacggcagcgagtgcagaggcggctggcccggccccaaccacggcatcacccacttcgacaacttcggcttcagcatgctgaccgtgtaccagtgcatcaccatggagggctggaccgacgtgctgtactgggtgaacgacgccatcggcaacgagtggccctggatctacttcgtgaccctgatcctgctgggcagcttcttcatcctgaacctggtgctgggcgtgctgagcggcgagttcaccaaggagagagagaaggccaagagcagaggcaccttccagaagctgagagagaagcagcagctggacgaggacctgagaggctacatgagctggatcacccagggcgaggtgatggacgtggaggacttcagagagggcaagctgagcctggacgagggcggcagcgacaccgagagcctgtacgagatcgccggcctgaacaagatcatccagttcatcagacactggagacagtggaacagaatcttcagatggaagtgccacgacatcgtgaagagcaaggtgttctactggctggtgatcctgatcgtggccctgaacaccctgagcatcgccagcgagcaccacaaccagcccctgtggctgaccagactgcaggacatcgccaacagagtgctgctgagcctgttcaccaccgagatgctgatgaagatgtacggcctgggcctgagacagtacttcatgagcatcttcaacagattcgactgcttcgtggtgtgcagcggcatcctggagatcctgctggtggagagcggcgccatgacccccctgggcatcagcgtgctgagatgcatcagactgctgagaatcttcaagatcaccaagtactggaccagcctgagcaacctggtggccagcctgctgaacagcatcagaagcatcgccagcctgctgctgctgctgttcctgttcatcgtgatcttcgccctgctgggcatgcagctgttcggcggcagatacgacttcgaggacaccgaggtgagaagaagcaacttcgacaacttcccccaggccctgatcagcgtgttccaggtgctgaccggcgaggactggaccagcatgatgtacaacggcatcatggcctacggcggccccagctaccccggcatgctggtgtgcatctacttcatcatcctgttcgtgtgcggcaactacatcctgctgaacgtgttcctggccatcgccgtggacaacctggccgaggccgagagcctgaccagcgcccagaaggccaaggccgaggagaagaagagaagaaagatgagcaagggcctgcccgacaagagcgaggaggagaagagcaccatggccaagaagctggagcagaagcccaagggcgagggcatccccaccaccgccaagctgaagatcgacgagttcgagagcaacgtgaacgaggtgaaggacccctaccccagcgccgacttccccggcgacgacgaggaggacgagcccgagatccccctgagccccagacccagacccctggccgagctgcagctgaaggagaaggccgtgcccatccccgaggccagcagcttcttcatcttcagccccaccaacaagatcagagtgctgtgccacagaatcgtgaacgccacctggttcaccaacttcatcctgctgttcatcctgctgagcagcgccgccctggccgccgaggaccccatcagagccgacagcatgagaaaccagatcctgaagcacttcgacatcggcttcaccagcgtgttcaccgtggagatcgtgctgaagatgaccacctacggcgccttcctgcacaagggcagcttctgcagaaactacttcaacatgctggacctgctggtggtggccgtgagcctgatcagcatgggcctggagagcagcgccatcagcgtggtgaagatcctgagagtgctgagagtgctgagacccctgagagccatcaacagagccaagggcctgaagcacgtggtgcagtgcatgttcgtggccatcagcaccatcggcaacatcgtgctggtgaccaccctgctgcagttcatgttcgcctgcatcggcgtgcagctgttcaagggcaagttcttcagatgcaccgacctgagcaagatgaccgaggaggagtgcagaggctactactacgtgtacaaggacggcgaccccatgcagatcgagctgagacacagagagtgggtgcacagcgacttccacttcgacaacgtgctgagcgccatgatgagcctgttcaccgtgagcaccttcgagggctggccccagctgctgtacaaggccatcgacagcaacgccgaggacgtgggccccatctacaacaacagagtggagatggccatcttcttcatcatctacatcatcctgatcgccttcttcatgatgaacatcttcgtgggcttcgtgatcgtgaccttccaggagcagggcgagaccgagtacaagaactgcgagctggacaagaaccagagacagtgcgtgcagtacgccctgaaggccagacccctgagatgctacatccccaagaacccctaccagtaccaggtgtggtacatcgtgaccagcagctacttcgagtacctgatgttcgccctgatcatgctgaacaccatctgcctgggcatgcagcactacaaccagagcgagcagatgaaccacatcagcgacatcctgaacgtggccttcaccatcatcttcaccctggagatgatcctgaagctgatggccttcaaggccagaggctacttcggcgacccctggaacgtgttcgacttcctgatcgtgatcggcagcatcatcgacgtgatcctgagcgagatcgacgaccccgacgagagcgccagaatcagcagcgccttcttcagactgttcagagtgatgagactgatcaagctgctgagcagagccgagggcgtgagaaccctgctgtggaccttcatcaagagcttccaggccctgccctacgtggccctgctgatcgtgatgctgttcttcatctacgccgtgatcggcatgcagatgttcggcaagatcgccctggtggacggcacccagatcaacagaaacaacaacttccagaccttcccccaggccgtgctgctgctgttcagatgcgccaccggcgaggcctggcaggagatcctgctggcctgcagctacggcaagctgtgcgaccccgagagcgactacgcccccggcgaggagtacacctgcggcaccaacttcgcctactactacttcatcagcttctacatgctgtgcgccttcctggtgatcaacctgttcgtggccgtgatcatggacaacttcgactacctgaccagagactggagcatcctgggcccccaccacctggacgagttcaaggccatctgggccgagtacgaccccgaggccaagggcagaatcaagcacctggacgtggtgaccctgctgagaagaatccagccccccctgggcttcggcaagttctgcccccacagagtggcctgcaagagactggtgggcatgaacatgcccctgaacagcgacggcaccgtgaccttcaacgccaccctgttcgccctggtgagaaccgccctgaagatcaagaccgagggcaacttcgagcaggccaacgaggagctgagagccatcatcaagaagatctggaagagaaccagcatgaagctgctggaccaggtgatcccccccatcggcgacgacgaggtgaccgtgggcaagttctacgccaccttcctgatccaggagcacttcagaaagttcatgaagagacaggaggagtactacggctacagacccaagaaggacatcgtgcagatccaggccggcctgagaaccatcgaggaggaggccgcccccgagatctgcagaaccgtgagcggcgacctggccgccgaggaggagctggagagagccatggtggaggccgccatggaggagggcatcttcagaagaaccggcggcctgttcggccaggtggacaacttcctggagagaaccaacagcctgccccccgtgatggccaaccagagacccctgcagttcgccgagatcgagatggaggagatggagagccccgtgttcctggaggacttcccccaggaccccagaaccaaccccctggccagagccaacaccaacaacgccaacgccaacgtggcctacggcaacagcaaccacagcaacagccacgtgttcagcagcgtgcactacgagagagagttccccgaggagaccgagacccccgccaccagaggcagagccctgggccagccctgcagagtgctgggcccccacagcaagccctgcgtggagatgctgaagggcctgctgacccagagagccatgcccagaggccaggccccccccgccccctgccagtgccccagagtggagagcagcatgcccgaggacagaaagagcagcacccccggcagcctgcacgaggagaccccccacagcagaagcaccagagagaacaccagcagatgcagcgcccccgccaccgccctgctgatccagaaggccctggtgagaggcggcctgggcaccctggccgccgacgccaacttcatcatggccaccggccaggccctggccgacgcctgccagatggagcccgaggaggtggagatcatggccaccgagctgctgaagggcagagaggcccccgagggcatggccagcagcctgggctgcctgaacctgggcagcagcctgggcagcctggaccagcaccagggcagccaggagaccctgatcccccccagactgtag

SEQ ID NO: 75049 - DNA, 4602 bp, Artificial Sequence
  Description of Artificial Sequence: Synthetic coding sequence
atgaagacccacctggacagacccctggtggtggagctgggcagagacggcgccagaggccccgtgggcggcaaggccagacccgaggccgccgaggcccccgagggcgtggacccccccagaagacaccacagacacagagacaaggacaagacccccgccgccggcgaccaggacagagccgaggcccccaaggccgagagcggcgagcccggcgccagagaggagagacccagaccccacagaagccacagcaaggaggccgccggcccccccgaggccagaagcgagagaggcagaggccccggccccgagggcggcagaagacaccacagaagaggcagccccgaggaggccgccgagagagagcccagaagacacagagcccacagacaccaggaccccagcaaggagtgcgccggcgccaagggcgagagaagagccagacacagaggcggccccagagccggccccagagaggccgagagcggcgaggagcccgccagaagacacagagccagacacaaggcccagcccgcccacgaggccgtggagaaggagaccaccgagaaggaggccaccgagaaggaggccgagatcgtggaggccgacaaggagaaggagctgagaaaccaccagcccagagagccccactgcgacctggagaccagcggcaccgtgaccgtgggccccatgcacaccctgcccagcacctgcctgcagaaggtggaggagcagcccgaggacgccgacaaccagagaaacgtgaccagaatgggcagccagccccccgaccccaacaccatcgtgcacatccccgtgatgctgaccggccccctgggcgaggccaccgtggtgcccagcggcaacgtggacctggagagccaggccgagggcaagaaggaggtggaggccgacgacgtgatgagaagcggccccagacccatcgtgccctacagcagcatgttctgcctgagccccaccaacctgctgagaagattctgccactacatcgtgaccatgagatacttcgaggtggtgatcctggtggtgatcgccctgagcagcatcgccctggccgccgaggaccccgtgagaaccgacagccccagaaacaacgccctgaagtacctggactacatcttcaccggcgtgttcaccttcgagatggtgatcaagatgatcgacctgggcctgctgctgcaccccggcgcctacttcagagacctgtggaacatcctggacttcatcgtggtgagcggcgccctggtggccttcgccttcagcagcttcgtgggcggcagcaagggcaaggacatcaacaccatcaagagcctgagagtgctgagagtgctgagacccctgaagaccatcaagagactgcccaagctgaaggccgtgttcgactgcgtggtgaacagcctgaagaacgtgctgaacatcctgatcgtgtacatgctgttcatgttcatcttcgccgtgatcgccgtgcagctgttcaagggcaagttcttctactgcaccgacgagagcaaggagctggagagagactgcagaggccagtacctggactacgagaaggaggaggtggaggcccagcccagacagtggaagaagtacgacttccactacgacaacgtgctgtgggccctgctgaccctgttcaccgtgagcaccggcgagggctggcccatggtgctgaagcacagcgtggacgccacctacgaggagcagggccccagccccggctacagaatggagctgagcatcttctacgtggtgtacttcgtggtgttccccttcttcttcgtgaacatcttcgtggccctgatcatcatcaccttccaggagcagggcgacaaggtgatgagcgagtgcagcctggagaagaacgagagagcctgcatcgacttcgccatcagcgccaagcccctgaccagatacatgccccagaacagacagagcttccagtacaagacctggaccttcgtggtgagcccccccttcgagtacttcatcatggccatgatcgccctgaacaccgtggtgctgatgatgaagttctacgacgccccctacgagtacgagctgatgctgaagtgcctgaacatcgtgttcaccagcatgttcagcatggagtgcgtgctgaagatcatcgccttcggcgtgctgaactacttcagagacgcctggaacgtgttcgacttcgtgaccgtgctgggcagcatcaccgacatcctggtgaccgagatcgccaacaacttcatcaacctgagcttcctgagactgttcagagccgccagactgatcaagctgctgagacagggctacaccatcagaatcctgctgtggaccttcgtgcagagcttcaaggccctgccctacgtgtgcctgctgatcgccatgctgttcttcatctacgccatcatcggcatgcaggtgttcggcaacatcgccctggacgacgacaccagcatcaacagacacaacaacttcagaaccttcctgcaggccctgatgctgctgttcagaagcgccaccggcgaggcctggcacgagatcatgctgagctgcctgagcaaccaggcctgcgacgagcaggccaacgccaccgagtgcggcagcgacttcgcctacttctacttcgtgagcttcatcttcctgtgcagcttcctgatgctgaacctgttcgtggccgtgatcatggacaacttcgagtacctgaccagagacagcagcatcctgggcccccaccacctggacgagttcatcagagtgtgggccgagtacgaccccgccgcctgcggcagaatcagctacaacgacatgttcgagatgctgaagcacatgagcccccccctgggcctgggcaagaagtgccccgccagagtggcctacaagagactggtgagaatgaacatgcccatcagcaacgaggacatgaccgtgcacttcaccagcaccctgatggccctgatcagaaccgccctggagatcaagctggcccccgccggcaccaagcagcaccagtgcgacgccgagctgagaaaggagatcagcgtggtgtgggccaacctgccccagaagaccctggacctgctggtgcccccccacaagcccgacgagatgaccgtgggcaaggtgtacgccgccctgatgatcttcgacttctacaagcagaacaagaccaccagagaccagatgcagcaggcccccggcggcctgagccagatgggccccgtgagcctgttccaccccctgaaggccaccctggagcagacccagcccgccgtgctgagaggcgccagagtgttcctgagacagaagagcagcaccagcctgagcaacggcggcgccatccagaaccaggagagcggcatcaaggagagcgtgagctggggcacccagagaacccaggacgccccccacgaggccagaccccccctggagagaggccacagcaccgagatccccgtgggcagaagcggcgccctggccgtggacgtgcagatgcagagcatcaccagaagaggccccgacggcgagccccagcccggcctggagagccagggcagagccgccagcatgcccagactggccgccgagacccagcccgtgaccgacgccagccccatgaagagaagcatcagcaccctggcccagagacccagaggcacccacctgtgcagcaccacccccgacagacccccccccagccaggccagcagccaccaccaccaccacagatgccacagaagaagagacagaaagcagagaagcctggagaagggccccagcctgagcgccgacatggacggcgcccccagcagcgccgtgggccccggcctgccccccggcgagggccccaccggctgcagaagagagagagagagaagacaggagagaggcagaagccaggagagaagacagcccagcagcagcagcagcgagaagcagagattctacagctgcgacagattcggcggcagagagccccccaagcccaagcccagcctgagcagccaccccaccagccccaccgccggccaggagcccggcccccacccccagggcagcggcagcgtgaacggcagccccctgctgagcaccagcggcgccagcacccccggcagaggcggcagaagacagctgccccagacccccctgacccccagacccagcatcacctacaagaccgccaacagcagccccatccacttcgccggcgcccagaccagcctgcccgccttcagccccggcagactgagcagaggcctgagcgagcacaacgccctgctgcagagagaccccctgagccagcccctggcccccggcagcagaatcggcagcgacccctacctgggccagagactggacagcgaggccagcgtgcacgccctgcccgaggacaccctgaccttcgaggaggccgtggccaccaacagcggcagaagcagcagaaccagctacgtgagcagcctgaccagccagagccaccccctgagaagagtgcccaacggctaccactgcaccctgggcctgagcagcggcggcagagccagacacagctaccaccaccccgaccaggaccactggtgctag

SEQ ID NO: 75050 - DNA, 306 bp, Artificial Sequence
  Description of Artificial Sequence: Synthetic coding sequence
gacaacctggccaacgcccaggagctgaccaaggacgaggaggagatggaggaggccgccaaccagaagctggccctgcagaaggccaaggaggtggccgaggtgagccccatgagcgccgccaacatcagcatcgccgccttcgtgaagcaggccagaggcaccgtgagcagaagcagcagcgtgagcagcgtgaacagccccagacagcagaacagcgccaaggccagaagcgtgtgggagcagagagccagccagctgagactgcagaacctgagagccagctgcgaggccctgtacagctag

SEQ ID NO: 75051 - DNA, 6714 bp, Artificial Sequence
  Description of Artificial Sequence: Synthetic coding sequence
atggtgagattcggcgacgagctgggcggcagatacggcggccccggcggcggcgagagagccagaggcggcggcgccggcggcgccggcggccccggccccggcggcctgcagcccggccagagagtgctgtacaagcagagcatcgcccagagagccagaaccatggccctgtacaaccccatccccgtgaagcagaactgcttcaccgtgaacagaagcctgttcgtgttcagcgaggacaacgtggtgagaaagtacgccaagagaatcaccgagtggccccccttcgagtacatgatcctggccaccatcatcgccaactgcatcgtgctggccctggagcagcacctgcccgacggcgacaagacccccatgagcgagagactggacgacaccgagccctacttcatcggcatcttctgcttcgaggccggcatcaagatcatcgccctgggcttcgtgttccacaagggcagctacctgagaaacggctggaacgtgatggacttcgtggtggtgctgaccggcatcctggccaccgccggcaccgacttcgacctgagaaccctgagagccgtgagagtgctgagacccctgaagctggtgagcggcatccccagcctgcaggtggtgctgaagagcatcatgaaggccatggtgcccctgctgcagatcggcctgctgctgttcttcgccatcctgatgttcgccatcatcggcctggagttctacatgggcaagttccacaaggcctgcttccccaacagcaccgacgccgagcccgtgggcgacttcccctgcggcaaggaggcccccgccagactgtgcgagggcgacaccgagtgcagagagtactggcccggccccaacttcggcatcaccaacttcgacaacatcctgttcgccatcctgaccgtgttccagtgcatcaccatggagggctggaccgacatcctgtacaacaccaacgacgccgccggcaacacctggaactggctgtacttcatccccctgatcatcatcggcagcttcttcatgctgaacctggtgctgggcgtgctgagcggcgagttcgccaaggagagagagagagtggagaacagaagagccttcctgaagctgagaagacagcagcagatcgagagagagctgaacggctacctggagtggatcttcaaggccgaggaggtgatgctggccgaggaggacagaaacgccgaggagaagagccccctggacgtgctgaagagagccgccaccaagaagagcagaaacgacctgatccacgccgaggagggcgaggacagattcgccgacctgtgcgccgtgggcagccccttcgccagagccagcctgaagagcggcaagaccgagagcagcagctacttcagaagaaaggagaagatgttcagattcttcatcagaagaatggtgaaggcccagagcttctactgggtggtgctgtgcgtggtggccctgaacaccctgtgcgtggccatggtgcactacaaccagcccagaagactgaccaccaccctgtacttcgccgagttcgtgttcctgggcctgttcctgaccgagatgagcctgaagatgtacggcctgggccccagaagctacttcagaagcagcttcaactgcttcgacttcggcgtgatcgtgggcagcgtgttcgaggtggtgtgggccgccatcaagcccggcagcagcttcggcatcagcgtgctgagagccctgagactgctgagaatcttcaaggtgaccaagtactggagcagcctgagaaacctggtggtgagcctgctgaacagcatgaagagcatcatcagcctgctgttcctgctgttcctgttcatcgtggtgttcgccctgctgggcatgcagctgttcggcggccagttcaacttccaggacgagacccccaccaccaacttcgacaccttccccgccgccatcctgaccgtgttccagatcctgaccggcgaggactggaacgccgtgatgtaccacggcatcgagagccagggcggcgtgagcaagggcatgttcagcagcttctacttcatcgtgctgaccctgttcggcaactacaccctgctgaacgtgttcctggccatcgccgtggacaacctggccaacgcccaggagctgaccaaggacgaggaggagatggaggaggccgccaaccagaagctggccctgcagaaggccaaggaggtggccgaggtgagccccatgagcgccgccaacatcagcatcgccgccagacagcagaacagcgccaaggccagaagcgtgtgggagcagagagccagccagctgagactgcagaacctgagagccagctgcgaggccctgtacagcgagatggaccccgaggagagactgagattcgccaccaccagacacctgagacccgacatgaagacccacctggacagacccctggtggtggagctgggcagagacggcgccagaggccccgtgggcggcaaggccagacccgaggccgccgaggcccccgagggcgtggacccccccagaagacaccacagacacagagacaaggacaagacccccgccgccggcgaccaggacagagccgaggcccccaaggccgagagcggcgagcccggcgccagagaggagagacccagaccccacagaagccacagcaaggaggccgccggcccccccgaggccagaagcgagagaggcagaggccccggccccgagggcggcagaagacaccacagaagaggcagccccgaggaggccgccgagagagagcccagaagacacagagcccacagacaccaggaccccagcaaggagtgcgccggcgccaagggcgagagaagagccagacacagaggcggccccagagccggccccagagaggccgagagcggcgaggagcccgccagaagacacagagccagacacaaggcccagcccgcccacgaggccgtggagaaggagaccaccgagaaggaggccaccgagaaggaggccgagatcgtggaggccgacaaggagaaggagctgagaaaccaccagcccagagagccccactgcgacctggagaccagcggcaccgtgaccgtgggccccatgcacaccctgcccagcacctgcctgcagaaggtggaggagcagcccgaggacgccgacaaccagagaaacgtgaccagaatgggcagccagccccccgaccccaacaccatcgtgcacatccccgtgatgctgaccggccccctgggcgaggccaccgtggtgcccagcggcaacgtggacctggagagccaggccgagggcaagaaggaggtggaggccgacgacgtgatgagaagcggccccagacccatcgtgccctacagcagcatgttctgcctgagccccaccaacctgctgagaagattctgccactacatcgtgaccatgagatacttcgaggtggtgatcctggtggtgatcgccctgagcagcatcgccctggccgccgaggaccccgtgagaaccgacagccccagaaacaacgccctgaagtacctggactacatcttcaccggcgtgttcaccttcgagatggtgatcaagatgatcgacctgggcctgctgctgcaccccggcgcctacttcagagacctgtggaacatcctggacttcatcgtggtgagcggcgccctggtggccttcgccttcagcggcagcaagggcaaggacatcaacaccatcaagagcctgagagtgctgagagtgctgagacccctgaagaccatcaagagactgcccaagctgaaggccgtgttcgactgcgtggtgaacagcctgaagaacgtgctgaacatcctgatcgtgtacatgctgttcatgttcatcttcgccgtgatcgccgtgcagctgttcaagggcaagttcttctactgcaccgacgagagcaaggagctggagagagactgcagaggccagtacctggactacgagaaggaggaggtggaggcccagcccagacagtggaagaagtacgacttccactacgacaacgtgctgtgggccctgctgaccctgttcaccgtgagcaccggcgagggctggcccatggtgctgaagcacagcgtggacgccacctacgaggagcagggccccagccccggctacagaatggagctgagcatcttctacgtggtgtacttcgtggtgttccccttcttcttcgtgaacatcttcgtggccctgatcatcatcaccttccaggagcagggcgacaaggtgatgagcgagtgcagcctggagaagaacgagagagcctgcatcgacttcgccatcagcgccaagcccctgaccagatacatgccccagaacagacagagcttccagtacaagacctggaccttcgtggtgagcccccccttcgagtacttcatcatggccatgatcgccctgaacaccgtggtgctgatgatgaagttctacgacgccccctacgagtacgagctgatgctgaagtgcctgaacatcgtgttcaccagcatgttcagcatggagtgcgtgctgaagatcatcgccttcggcgtgctgaactacttcagagacgcctggaacgtgttcgacttcgtgaccgtgctgggcagcatcaccgacatcctggtgaccgagatcgccgagaccaacaacttcatcaacctgagcttcctgagactgttcagagccgccagactgatcaagctgctgagacagggctacaccatcagaatcctgctgtggaccttcgtgcagagcttcaaggccctgccctacgtgtgcctgctgatcgccatgctgttcttcatctacgccatcatcggcatgcaggtgttcggcaacatcgccctggacgacgacaccagcatcaacagacacaacaacttcagaaccttcctgcaggccctgatgctgctgttcagaagcgccaccggcgaggcctggcacgagatcatgctgagctgcctgagcaaccaggcctgcgacgagcaggccaacgccaccgagtgcggcagcgacttcgcctacttctacttcgtgagcttcatcttcctgtgcagcttcctgatgctgaacctgttcgtggccgtgatcatggacaacttcgagtacctgaccagagacagcagcatcctgggcccccaccacctggacgagttcatcagagtgtgggccgagtacgaccccgccgcctgcggcagaatcagctacaacgacatgttcgagatgctgaagcacatgagcccccccctgggcctgggcaagaagtgccccgccagagtggcctacaagagactggtgagaatgaacatgcccatcagcaacgaggacatgaccgtgcacttcaccagcaccctgatggccctgatcagaaccgccctggagatcaagctggcccccgccggcaccaagcagcaccagtgcgacgccgagctgagaaaggagatcagcgtggtgtgggccaacctgccccagaagaccctggacctgctggtgcccccccacaagcccgacgagatgaccgtgggcaaggtgtacgccgccctgatgatcttcgacttctacaagcagaacaagaccaccagagaccagatgcagcaggcccccggcggcctgagccagatgggccccgtgagcctgttccaccccctgaaggccaccctggagcagacccagcccgccgtgctgagaggcgccagagtgttcctgagacagaagagcagcaccagcctgagcaacggcggcgccatccagaaccaggagagcggcatcaaggagagcgtgagctggggcacccagagaacccaggacgccccccacgaggccagaccccccctggagagaggccacagcaccgagatccccgtgggcagaagcggcgccctggccgtggacgtgcagatgcagagcatcaccagaagaggccccgacggcgagccccagcccggcctggagagccagggcagagccgccagcatgcccagactggccgccgagacccagcccgtgaccgacgccagccccatgaagagaagcatcagcaccctggcccagagacccagaggcacccacctgtgcagcaccacccccgacagacccccccccagccaggccagcagccaccaccaccaccacagatgccacagaagaagagacagaaagcagagaagcctggagaagggccccagcctgagcgccgacatggacggcgcccccagcagcgccgtgggccccggcctgccccccggcgagggccccaccggctgcagaagagagagagagagaagacaggagagaggcagaagccaggagagaagacagcccagcagcagcagcagcgagaagcagagattctacagctgcgacagattcggcggcagagagccccccaagcccaagcccagcctgagcagccaccccaccagccccaccgccggccaggagcccggcccccacccccaggccggcagcgccgtgggcttccccaacaccaccccctgctgcagagagacccccagcgccagcccctggcccctggccctggagctggccctgaccctgacctggggcagcgtgtggaccgtgagacccctgagcaccccctgcctgagaaccctgagcctgagcagaagactgtggccccccaccagagccgccccccccggcctgcccacctgccccccctag

SEQ ID NO: 75052 - DNA, 7023 bp, Artificial Sequence
  Description of Artificial Sequence: Synthetic coding sequence
atggtgagattcggcgacgagctgggcggcagatacggcggccccggcggcggcgagagagccagaggcggcggcgccggcggcgccggcggccccggccccggcggcctgcagcccggccagagagtgctgtacaagcagagcatcgcccagagagccagaaccatggccctgtacaaccccatccccgtgaagcagaactgcttcaccgtgaacagaagcctgttcgtgttcagcgaggacaacgtggtgagaaagtacgccaagagaatcaccgagtggccccccttcgagtacatgatcctggccaccatcatcgccaactgcatcgtgctggccctggagcagcacctgcccgacggcgacaagacccccatgagcgagagactggacgacaccgagccctacttcatcggcatcttctgcttcgaggccggcatcaagatcatcgccctgggcttcgtgttccacaagggcagctacctgagaaacggctggaacgtgatggacttcgtggtggtgctgaccggcatcctggccaccgccggcaccgacttcgacctgagaaccctgagagccgtgagagtgctgagacccctgaagctggtgagcggcatccccagcctgcaggtggtgctgaagagcatcatgaaggccatggtgcccctgctgcagatcggcctgctgctgttcttcgccatcctgatgttcgccatcatcggcctggagttctacatgggcaagttccacaaggcctgcttccccaacagcaccgacgccgagcccgtgggcgacttcccctgcggcaaggaggcccccgccagactgtgcgagggcgacaccgagtgcagagagtactggcccggccccaacttcggcatcaccaacttcgacaacatcctgttcgccatcctgaccgtgttccagtgcatcaccatggagggctggaccgacatcctgtacaacaccaacgacgccgccggcaacacctggaactggctgtacttcatccccctgatcatcatcggcagcttcttcatgctgaacctggtgctgggcgtgctgagcggcgagttcgccaaggagagagagagagtggagaacagaagagccttcctgaagctgagaagacagcagcagatcgagagagagctgaacggctacctggagtggatcttcaaggccgaggaggtgatgctggccgaggaggacagaaacgccgaggagaagagccccctggacgccgtgctgaagagagccgccaccaagaagagcagaaacgacctgatccacgccgaggagggcgaggacagattcgccgacctgtgcgccgtgggcagccccttcgccagagccagcctgaagagcggcaagaccgagagcagcagctacttcagaagaaaggagaagatgttcagattcttcatcagaagaatggtgaaggcccagagcttctactgggtggtgctgtgcgtggtggccctgaacaccctgtgcgtggccatggtgcactacaaccagcccagaagactgaccaccaccctgtacttcgccgagttcgtgttcctgggcctgttcctgaccgagatgagcctgaagatgtacggcctgggccccagaagctacttcagaagcagcttcaactgcttcgacttcggcgtgatcgtgggcagcgtgttcgaggtggtgtgggccgccatcaagcccggcagcagcttcggcatcagcgtgctgagagccctgagactgctgagaatcttcaaggtgaccaagtactggagcagcctgagaaacctggtggtgagcctgctgaacagcatgaagagcatcatcagcctgctgttcctgctgttcctgttcatcgtggtgttcgccctgctgggcatgcagctgttcggcggccagttcaacttccaggacgagacccccaccaccaacttcgacaccttccccgccgccatcctgaccgtgttccagatcctgaccggcgaggactggaacgccgtgatgtaccacggcatcgagagccagggcggcgtgagcaagggcatgttcagcagcttctacttcatcgtgctgaccctgttcggcaactacaccctgctgaacgtgttcctggccatcgccgtggacaacctggccaacgcccaggagctgaccaaggacgaggaggagatggaggaggccgccaaccagaagctggccctgcagaaggccaaggaggtggccgaggtgagccccatgagcgccgccaacatcagcatcgccgccagacagcagaacagcgccaaggccagaagcgtgtgggagcagagagccagccagctgagactgcagaacctgagagccagctgcgaggccctgtacagcgagatggaccccgaggagagactgagattcgccaccaccagacacctgagacccgacatgaagacccacctggacagacccctggtggtggagctgggcagagacggcgccagaggccccgtgggcggcaaggccagacccgaggccgccgaggcccccgagggcgtggacccccccagaagacaccacagacacagagacaaggacaagacccccgccgccggcgaccaggacagagccgaggcccccaaggccgagagcggcgagcccggcgccagagaggagagacccagaccccacagaagccacagcaaggaggccgccggcccccccgaggccagaagcgagagaggcagaggccccggccccgagggcggcagaagacaccacagaagaggcagccccgaggaggccgccgagagagagcccagaagacacagagcccacagacaccaggaccccagcaaggagtgcgccggcgccaagggcgagagaagagccagacacagaggcggccccagagccggccccagagaggccgagagcggcgaggagcccgccagaagacacagagccagacacaaggcccagcccgcccacgaggccgtggagaaggagaccaccgagaaggaggccaccgagaaggaggccgagatcgtggaggccgacaaggagaaggagctgagaaaccaccagcccagagagccccactgcgacctggagaccagcggcaccgtgaccgtgggccccatgcacaccctgcccagcacctgcctgcagaaggtggaggagcagcccgaggacgccgacaaccagagaaacgtgaccagaatgggcagccagccccccgaccccaacaccatcgtgcacatccccgtgatgctgaccggccccctgggcgaggccaccgtggtgcccagcggcaacgtggacctggagagccaggccgagggcaagaaggaggtggaggccgacgacgtgatgagaagcggccccagacccatcgtgccctacagcagcatgttctgcctgagccccaccaacctgctgagaagattctgccactacatcgtgaccatgagatacttcgaggtggtgatcctggtggtgatcgccctgagcagcatcgccctggccgccgaggaccccgtgagaaccgacagccccagaaacaacgccctgaagtacctggactacatcttcaccggcgtgttcaccttcgagatggtgatcaagatgatcgacctgggcctgctgctgcaccccggcgcctacttcagagacctgtggaacatcctggacttcatcgtggtgagcggcgccctggtggccttcgccttcagcggcagcaagggcaaggacatcaacaccatcaagagcctgagagtgctgagagtgctgagacccctgaagaccatcaagagactgcccaagctgaaggccgtgttcgactgcgtggtgaacagcctgaagaacgtgctgaacatcctgatcgtgtacatgctgttcatgttcatcttcgccgtgatcgccgtgcagctgttcaagggcaagttcttctactgcaccgacgagagcaaggagctggagagagactgcagaggccagtacctggactacgagaaggaggaggtggaggcccagcccagacagtggaagaagtacgacttccactacgacaacgtgctgtgggccctgctgaccctgttcaccgtgagcaccggcgagggctggcccatggtgctgaagcacagcgtggacgccacctacgaggagcagggccccagccccggctacagaatggagctgagcatcttctacgtggtgtacttcgtggtgttccccttcttcttcgtgaacatcttcgtggccctgatcatcatcaccttccaggagcagggcgacaaggtgatgagcgagtgcagcctggagaagaacgagagagcctgcatcgacttcgccatcagcgccaagcccctgaccagatacatgccccagaacagacagagcttccagtacaagacctggaccttcgtggtgagcccccccttcgagtacttcatcatggccatgatcgccctgaacaccgtggtgctgatgatgaagttctacgacgccccctacgagtacgagctgatgctgaagtgcctgaacatcgtgttcaccagcatgttcagcatggagtgcgtgctgaagatcatcgccttcggcgtgctgaactacttcagagacgcctggaacgtgttcgacttcgtgaccgtgctgggcagcatcaccgacatcctggtgaccgagatcgccgagaccaacaacttcatcaacctgagcttcctgagactgttcagagccgccagactgatcaagctgctgagacagggctacaccatcagaatcctgctgtggaccttcgtgcagagcttcaaggccctgccctacgtgtgcctgctgatcgccatgctgttcttcatctacgccatcatcggcatgcaggtgttcggcaacatcgccctggacgacgacaccagcatcaacagacacaacaacttcagaaccttcctgcaggccctgatgctgctgttcagaagcgccaccggcgaggcctggcacgagatcatgctgagctgcctgagcaaccaggcctgcgacgagcaggccaacgccaccgagtgcggcagcgacttcgcctacttctacttcgtgagcttcatcttcctgtgcagcttcctgatgctgaacctgttcgtggccgtgatcatggacaacttcgagtacctgaccagagacagcagcatcctgggcccccaccacctggacgagttcatcagagtgtgggccgagtacgaccccgccgcctgcggcagaatcagctacaacgacatgttcgagatgctgaagcacatgagcccccccctgggcctgggcaagaagtgccccgccagagtggcctacaagagactggtgagaatgaacatgcccatcagcaacgaggacatgaccgtgcacttcaccagcaccctgatggccctgatcagaaccgccctggagatcaagctggcccccgccggcaccaagcagcaccagtgcgacgccgagctgagaaaggagatcagcgtggtgtgggccaacctgccccagaagaccctggacctgctggtgcccccccacaagcccgacgagatgaccgtgggcaaggtgtacgccgccctgatgatcttcgacttctacaagcagaacaagaccaccagagaccagatgcagcaggcccccggcggcctgagccagatgggccccgtgagcctgttccaccccctgaaggccaccctggagcagacccagcccgccgtgctgagaggcgccagagtgttcctgagacagaagagcagcaccagcctgagcaacggcggcgccatccagaaccaggagagcggcatcaaggagagcgtgagctggggcacccagagaacccaggacgccccccacgaggccagaccccccctggagagaggccacagcaccgagatccccgtgggcagaagcggcgccctggccgtggacgtgcagatgcagagcatcaccagaagaggccccgacggcgagccccagcccggcctggagagccagggcagagccgccagcatgcccagactggccgccgagacccagcccgtgaccgacgccagccccatgaagagaagcatcagcaccctggcccagagacccagaggcacccacctgtgcagcaccacccccgacagacccccccccagccaggccagcagccaccaccaccaccacagatgccacagaagaagagacagaaagcagagaagcctggagaagggccccagcctgagcgccgacatggacggcgcccccagcagcgccgtgggccccggcctgccccccggcgagggccccaccggctgcagaagagagagagagagaagacaggagagaggcagaagccaggagagaagacagcccagcagcagcagcagcgagaagcagagattctacagctgcgacagattcggcggcagagagccccccaagcccaagcccagcctgagcagccaccccaccagccccaccgccggccaggagcccggcccccacccccagggcagcggcagcgtgaacggcagccccctgctgagcaccagcggcgccagcacccccggcagaggcggcagaagacagctgccccagacccccctgacccccagacccagcatcacctacaagaccgccaacagcagccccatccacttcgccggcgcccagaccagcctgcccgccttcagccccggcagactgagcagaggcctgagcgagcacaacgccctgctgcagagagaccccctgagccagcccctggcccccggcagcagaatcggcagcgacccctacctgggccagagactggacagcgaggccagcgtgcacgccctgcccgaggacaccctgaccttcgaggaggccgtggccaccaacagcggcagaagcagcagaaccagctacgtgagcagcctgaccagccagagccaccccctgagaagagtgcccaacggctaccactgcaccctgggcctgagcagcggcggcagagccagacacagctaccaccaccccgaccaggaccactggtgctag

SEQ ID NO: 75053 - DNA, 7017 bp, Artificial Sequence
  Description of Artificial Sequence: Synthetic coding sequence
atggtgagattcggcgacgagctgggcggcagatacggcggccccggcggcggcgagagagccagaggcggcggcgccggcggcgccggcggccccggccccggcggcctgcagcccggccagagagtgctgtacaagcagagcatcgcccagagagccagaaccatggccctgtacaaccccatccccgtgaagcagaactgcttcaccgtgaacagaagcctgttcgtgttcagcgaggacaacgtggtgagaaagtacgccaagagaatcaccgagtggccccccttcgagtacatgatcctggccaccatcatcgccaactgcatcgtgctggccctggagcagcacctgcccgacggcgacaagacccccatgagcgagagactggacgacaccgagccctacttcatcggcatcttctgcttcgaggccggcatcaagatcatcgccctgggcttcgtgttccacaagggcagctacctgagaaacggctggaacgtgatggacttcgtggtggtgctgaccggcatcctggccaccgccggcaccgacttcgacctgagaaccctgagagccgtgagagtgctgagacccctgaagctggtgagcggcatccccagcctgcaggtggtgctgaagagcatcatgaaggccatggtgcccctgctgcagatcggcctgctgctgttcttcgccatcctgatgttcgccatcatcggcctggagttctacatgggcaagttccacaaggcctgcttccccaacagcaccgacgccgagcccgtgggcgacttcccctgcggcaaggaggcccccgccagactgtgcgagggcgacaccgagtgcagagagtactggcccggccccaacttcggcatcaccaacttcgacaacatcctgttcgccatcctgaccgtgttccagtgcatcaccatggagggctggaccgacatcctgtacaacaccaacgacgccgccggcaacacctggaactggctgtacttcatccccctgatcatcatcggcagcttcttcatgctgaacctggtgctgggcgtgctgagcggcgagttcgccaaggagagagagagagtggagaacagaagagccttcctgaagctgagaagacagcagcagatcgagagagagctgaacggctacctggagtggatcttcaaggccgaggaggtgatgctggccgaggaggacagaaacgccgaggagaagagccccctggacgccgtgctgaagagagccgccaccaagaagagcagaaacgacctgatccacgccgaggagggcgaggacagattcgccgacctgtgcgccgtgggcagccccttcgccagagccagcctgaagagcggcaagaccgagagcagcagctacttcagaagaaaggagaagatgttcagattcttcatcagaagaatggtgaaggcccagagcttctactgggtggtgctgtgcgtggtggccctgaacaccctgtgcgtggccatggtgcactacaaccagcccagaagactgaccaccaccctgtacttcgccgagttcgtgttcctgggcctgttcctgaccgagatgagcctgaagatgtacggcctgggccccagaagctacttcagaagcagcttcaactgcttcgacttcggcgtgatcgtgggcagcgtgttcgaggtggtgtgggccgccatcaagcccggcagcagcttcggcatcagcgtgctgagagccctgagactgctgagaatcttcaaggtgaccaagtactggagcagcctgagaaacctggtggtgagcctgctgaacagcatgaagagcatcatcagcctgctgttcctgctgttcctgttcatcgtggtgttcgccctgctgggcatgcagctgttcggcggccagttcaacttccaggacgagacccccaccaccaacttcgacaccttccccgccgccatcctgaccgtgttccagatcctgaccggcgaggactggaacgccgtgatgtaccacggcatcgagagccagggcggcgtgagcaagggcatgttcagcagcttctacttcatcgtgctgaccctgttcggcaactacaccctgctgaacgtgttcctggccatcgccgtggacaacctggccaacgcccaggagctgaccaaggacgaggaggagatggaggaggccgccaaccagaagctggccctgcagaaggccaaggaggtggccgaggtgagccccatgagcgccgccaacatcagcatcgccgccagacagcagaacagcgccaaggccagaagcgtgtgggagcagagagccagccagctgagactgcagaacctgagagccagctgcgaggccctgtacagcgagatggaccccgaggagagactgagattcgccaccaccagacacctgagacccgacatgaagacccacctggacagacccctggtggtggagctgggcagagacggcgccagaggccccgtgggcggcaaggccagacccgaggccgccgaggcccccgagggcgtggacccccccagaagacaccacagacacagagacaaggacaagacccccgccgccggcgaccaggacagagccgaggcccccaaggccgagagcggcgagcccggcgccagagaggagagacccagaccccacagaagccacagcaaggaggccgccggcccccccgaggccagaagcgagagaggcagaggccccggccccgagggcggcagaagacaccacagaagaggcagccccgaggaggccgccgagagagagcccagaagacacagagcccacagacaccaggaccccagcaaggagtgcgccggcgccaagggcgagagaagagccagacacagaggcggccccagagccggccccagagaggccgagagcggcgaggagcccgccagaagacacagagccagacacaaggcccagcccgcccacgaggccgtggagaaggagaccaccgagaaggaggccaccgagaaggaggccgagatcgtggaggccgacaaggagaaggagctgagaaaccaccagcccagagagccccactgcgacctggagaccagcggcaccgtgaccgtgggccccatgcacaccctgcccagcacctgcctgcagaaggtggaggagcagcccgaggacgccgacaaccagagaaacgtgaccagaatgggcagccagccccccgaccccaacaccatcgtgcacatccccgtgatgctgaccggccccctgggcgaggccaccgtggtgcccagcggcaacgtggacctggagagccaggccgagggcaagaaggaggtggaggccgacgacgtgatgagaagcggccccagacccatcgtgccctacagcagcatgttctgcctgagccccaccaacctgctgagaagattctgccactacatcgtgaccatgagatacttcgaggtggtgatcctggtggtgatcgccctgagcagcatcgccctggccgccgaggaccccgtgagaaccgacagccccagaaacaacgccctgaagtacctggactacatcttcaccggcgtgttcaccttcgagatggtgatcaagatgatcgacctgggcctgctgctgcaccccggcgcctacttcagagacctgtggaacatcctggacttcatcgtggtgagcggcgccctggtggccttcgccttcagcggcagcaagggcaaggacatcaacaccatcaagagcctgagagtgctgagagtgctgagacccctgaagaccatcaagagactgcccaagctgaaggccgtgttcgactgcgtggtgaacagcctgaagaacgtgctgaacatcctgatcgtgtacatgctgttcatgttcatcttcgccgtgatcgccgtgcagctgttcaagggcaagttcttctactgcaccgacgagagcaaggagctggagagagactgcagaggccagtacctggactacgagaaggaggaggtggaggcccagcccagacagtggaagaagtacgacttccactacgacaacgtgctgtgggccctgctgaccctgttcaccgtgagcaccggcgagggctggcccatggtgctgaagcacagcgtggacgccacctacgaggagcagggccccagccccggctacagaatggagctgagcatcttctacgtggtgtacttcgtggtgttccccttcttcttcgtgaacatcttcgtggccctgatcatcatcaccttccaggagcagggcgacaaggtgatgagcgagtgcagcctggagaagaacgagagagcctgcatcgacttcgccatcagcgccaagcccctgaccagatacatgccccagaacagacagagcttccagtacaagacctggaccttcgtggtgagcccccccttcgagtacttcatcatggccatgatcgccctgaacaccgtggtgctgatgatgaagttctacgacgccccctacgagtacgagctgatgctgaagtgcctgaacatcgtgttcaccagcatgttcagcatggagtgcgtgctgaagatcatcgccttcggcgtgctgaactacttcagagacgcctggaacgtgttcgacttcgtgaccgtgctgggcagcatcaccgacatcctggtgaccgagatcgccaacaacttcatcaacctgagcttcctgagactgttcagagccgccagactgatcaagctgctgagacagggctacaccatcagaatcctgctgtggaccttcgtgcagagcttcaaggccctgccctacgtgtgcctgctgatcgccatgctgttcttcatctacgccatcatcggcatgcaggtgttcggcaacatcgccctggacgacgacaccagcatcaacagacacaacaacttcagaaccttcctgcaggccctgatgctgctgttcagaagcgccaccggcgaggcctggcacgagatcatgctgagctgcctgagcaaccaggcctgcgacgagcaggccaacgccaccgagtgcggcagcgacttcgcctacttctacttcgtgagcttcatcttcctgtgcagcttcctgatgctgaacctgttcgtggccgtgatcatggacaacttcgagtacctgaccagagacagcagcatcctgggcccccaccacctggacgagttcatcagagtgtgggccgagtacgaccccgccgcctgcggcagaatcagctacaacgacatgttcgagatgctgaagcacatgagcccccccctgggcctgggcaagaagtgccccgccagagtggcctacaagagactggtgagaatgaacatgcccatcagcaacgaggacatgaccgtgcacttcaccagcaccctgatggccctgatcagaaccgccctggagatcaagctggcccccgccggcaccaagcagcaccagtgcgacgccgagctgagaaaggagatcagcgtggtgtgggccaacctgccccagaagaccctggacctgctggtgcccccccacaagcccgacgagatgaccgtgggcaaggtgtacgccgccctgatgatcttcgacttctacaagcagaacaagaccaccagagaccagatgcagcaggcccccggcggcctgagccagatgggccccgtgagcctgttccaccccctgaaggccaccctggagcagacccagcccgccgtgctgagaggcgccagagtgttcctgagacagaagagcagcaccagcctgagcaacggcggcgccatccagaaccaggagagcggcatcaaggagagcgtgagctggggcacccagagaacccaggacgccccccacgaggccagaccccccctggagagaggccacagcaccgagatccccgtgggcagaagcggcgccctggccgtggacgtgcagatgcagagcatcaccagaagaggccccgacggcgagccccagcccggcctggagagccagggcagagccgccagcatgcccagactggccgccgagacccagcccgtgaccgacgccagccccatgaagagaagcatcagcaccctggcccagagacccagaggcacccacctgtgcagcaccacccccgacagacccccccccagccaggccagcagccaccaccaccaccacagatgccacagaagaagagacagaaagcagagaagcctggagaagggccccagcctgagcgccgacatggacggcgcccccagcagcgccgtgggccccggcctgccccccggcgagggccccaccggctgcagaagagagagagagagaagacaggagagaggcagaagccaggagagaagacagcccagcagcagcagcagcgagaagcagagattctacagctgcgacagattcggcggcagagagccccccaagcccaagcccagcctgagcagccaccccaccagccccaccgccggccaggagcccggcccccacccccagggcagcggcagcgtgaacggcagccccctgctgagcaccagcggcgccagcacccccggcagaggcggcagaagacagctgccccagacccccctgacccccagacccagcatcacctacaagaccgccaacagcagccccatccacttcgccggcgcccagaccagcctgcccgccttcagccccggcagactgagcagaggcctgagcgagcacaacgccctgctgcagagagaccccctgagccagcccctggcccccggcagcagaatcggcagcgacccctacctgggccagagactggacagcgaggccagcgtgcacgccctgcccgaggacaccctgaccttcgaggaggccgtggccaccaacagcggcagaagcagcagaaccagctacgtgagcagcctgaccagccagagccaccccctgagaagagtgcccaacggctaccactgcaccctgggcctgagcagcggcggcagagccagacacagctaccaccaccccgaccaggaccactggtgctag

SEQ ID NO: 75054 - DNA, 7014 bp, Artificial Sequence
  Description of Artificial Sequence: Synthetic coding sequence
atggtgagattcggcgacgagctgggcggcagatacggcggccccggcggcggcgagagagccagaggcggcggcgccggcggcgccggcggccccggccccggcggcctgcagcccggccagagagtgctgtacaagcagagcatcgcccagagagccagaaccatggccctgtacaaccccatccccgtgaagcagaactgcttcaccgtgaacagaagcctgttcgtgttcagcgaggacaacgtggtgagaaagtacgccaagagaatcaccgagtggccccccttcgagtacatgatcctggccaccatcatcgccaactgcatcgtgctggccctggagcagcacctgcccgacggcgacaagacccccatgagcgagagactggacgacaccgagccctacttcatcggcatcttctgcttcgaggccggcatcaagatcatcgccctgggcttcgtgttccacaagggcagctacctgagaaacggctggaacgtgatggacttcgtggtggtgctgaccggcatcctggccaccgccggcaccgacttcgacctgagaaccctgagagccgtgagagtgctgagacccctgaagctggtgagcggcatccccagcctgcaggtggtgctgaagagcatcatgaaggccatggtgcccctgctgcagatcggcctgctgctgttcttcgccatcctgatgttcgccatcatcggcctggagttctacatgggcaagttccacaaggcctgcttccccaacagcaccgacgccgagcccgtgggcgacttcccctgcggcaaggaggcccccgccagactgtgcgagggcgacaccgagtgcagagagtactggcccggccccaacttcggcatcaccaacttcgacaacatcctgttcgccatcctgaccgtgttccagtgcatcaccatggagggctggaccgacatcctgtacaacaccaacgacgccgccggcaacacctggaactggctgtacttcatccccctgatcatcatcggcagcttcttcatgctgaacctggtgctgggcgtgctgagcggcgagttcgccaaggagagagagagagtggagaacagaagagccttcctgaagctgagaagacagcagcagatcgagagagagctgaacggctacctggagtggatcttcaaggccgaggaggtgatgctggccgaggaggacagaaacgccgaggagaagagccccctggacgtgctgaagagagccgccaccaagaagagcagaaacgacctgatccacgccgaggagggcgaggacagattcgccgacctgtgcgccgtgggcagccccttcgccagagccagcctgaagagcggcaagaccgagagcagcagctacttcagaagaaaggagaagatgttcagattcttcatcagaagaatggtgaaggcccagagcttctactgggtggtgctgtgcgtggtggccctgaacaccctgtgcgtggccatggtgcactacaaccagcccagaagactgaccaccaccctgtacttcgccgagttcgtgttcctgggcctgttcctgaccgagatgagcctgaagatgtacggcctgggccccagaagctacttcagaagcagcttcaactgcttcgacttcggcgtgatcgtgggcagcgtgttcgaggtggtgtgggccgccatcaagcccggcagcagcttcggcatcagcgtgctgagagccctgagactgctgagaatcttcaaggtgaccaagtactggagcagcctgagaaacctggtggtgagcctgctgaacagcatgaagagcatcatcagcctgctgttcctgctgttcctgttcatcgtggtgttcgccctgctgggcatgcagctgttcggcggccagttcaacttccaggacgagacccccaccaccaacttcgacaccttccccgccgccatcctgaccgtgttccagatcctgaccggcgaggactggaacgccgtgatgtaccacggcatcgagagccagggcggcgtgagcaagggcatgttcagcagcttctacttcatcgtgctgaccctgttcggcaactacaccctgctgaacgtgttcctggccatcgccgtggacaacctggccaacgcccaggagctgaccaaggacgaggaggagatggaggaggccgccaaccagaagctggccctgcagaaggccaaggaggtggccgaggtgagccccatgagcgccgccaacatcagcatcgccgccagacagcagaacagcgccaaggccagaagcgtgtgggagcagagagccagccagctgagactgcagaacctgagagccagctgcgaggccctgtacagcgagatggaccccgaggagagactgagattcgccaccaccagacacctgagacccgacatgaagacccacctggacagacccctggtggtggagctgggcagagacggcgccagaggccccgtgggcggcaaggccagacccgaggccgccgaggcccccgagggcgtggacccccccagaagacaccacagacacagagacaaggacaagacccccgccgccggcgaccaggacagagccgaggcccccaaggccgagagcggcgagcccggcgccagagaggagagacccagaccccacagaagccacagcaaggaggccgccggcccccccgaggccagaagcgagagaggcagaggccccggccccgagggcggcagaagacaccacagaagaggcagccccgaggaggccgccgagagagagcccagaagacacagagcccacagacaccaggaccccagcaaggagtgcgccggcgccaagggcgagagaagagccagacacagaggcggccccagagccggccccagagaggccgagagcggcgaggagcccgccagaagacacagagccagacacaaggcccagcccgcccacgaggccgtggagaaggagaccaccgagaaggaggccaccgagaaggaggccgagatcgtggaggccgacaaggagaaggagctgagaaaccaccagcccagagagccccactgcgacctggagaccagcggcaccgtgaccgtgggccccatgcacaccctgcccagcacctgcctgcagaaggtggaggagcagcccgaggacgccgacaaccagagaaacgtgaccagaatgggcagccagccccccgaccccaacaccatcgtgcacatccccgtgatgctgaccggccccctgggcgaggccaccgtggtgcccagcggcaacgtggacctggagagccaggccgagggcaagaaggaggtggaggccgacgacgtgatgagaagcggccccagacccatcgtgccctacagcagcatgttctgcctgagccccaccaacctgctgagaagattctgccactacatcgtgaccatgagatacttcgaggtggtgatcctggtggtgatcgccctgagcagcatcgccctggccgccgaggaccccgtgagaaccgacagccccagaaacaacgccctgaagtacctggactacatcttcaccggcgtgttcaccttcgagatggtgatcaagatgatcgacctgggcctgctgctgcaccccggcgcctacttcagagacctgtggaacatcctggacttcatcgtggtgagcggcgccctggtggccttcgccttcagcggcagcaagggcaaggacatcaacaccatcaagagcctgagagtgctgagagtgctgagacccctgaagaccatcaagagactgcccaagctgaaggccgtgttcgactgcgtggtgaacagcctgaagaacgtgctgaacatcctgatcgtgtacatgctgttcatgttcatcttcgccgtgatcgccgtgcagctgttcaagggcaagttcttctactgcaccgacgagagcaaggagctggagagagactgcagaggccagtacctggactacgagaaggaggaggtggaggcccagcccagacagtggaagaagtacgacttccactacgacaacgtgctgtgggccctgctgaccctgttcaccgtgagcaccggcgagggctggcccatggtgctgaagcacagcgtggacgccacctacgaggagcagggccccagccccggctacagaatggagctgagcatcttctacgtggtgtacttcgtggtgttccccttcttcttcgtgaacatcttcgtggccctgatcatcatcaccttccaggagcagggcgacaaggtgatgagcgagtgcagcctggagaagaacgagagagcctgcatcgacttcgccatcagcgccaagcccctgaccagatacatgccccagaacagacagagcttccagtacaagacctggaccttcgtggtgagcccccccttcgagtacttcatcatggccatgatcgccctgaacaccgtggtgctgatgatgaagttctacgacgccccctacgagtacgagctgatgctgaagtgcctgaacatcgtgttcaccagcatgttcagcatggagtgcgtgctgaagatcatcgccttcggcgtgctgaactacttcagagacgcctggaacgtgttcgacttcgtgaccgtgctgggcagcatcaccgacatcctggtgaccgagatcgccaacaacttcatcaacctgagcttcctgagactgttcagagccgccagactgatcaagctgctgagacagggctacaccatcagaatcctgctgtggaccttcgtgcagagcttcaaggccctgccctacgtgtgcctgctgatcgccatgctgttcttcatctacgccatcatcggcatgcaggtgttcggcaacatcgccctggacgacgacaccagcatcaacagacacaacaacttcagaaccttcctgcaggccctgatgctgctgttcagaagcgccaccggcgaggcctggcacgagatcatgctgagctgcctgagcaaccaggcctgcgacgagcaggccaacgccaccgagtgcggcagcgacttcgcctacttctacttcgtgagcttcatcttcctgtgcagcttcctgatgctgaacctgttcgtggccgtgatcatggacaacttcgagtacctgaccagagacagcagcatcctgggcccccaccacctggacgagttcatcagagtgtgggccgagtacgaccccgccgcctgcggcagaatcagctacaacgacatgttcgagatgctgaagcacatgagcccccccctgggcctgggcaagaagtgccccgccagagtggcctacaagagactggtgagaatgaacatgcccatcagcaacgaggacatgaccgtgcacttcaccagcaccctgatggccctgatcagaaccgccctggagatcaagctggcccccgccggcaccaagcagcaccagtgcgacgccgagctgagaaaggagatcagcgtggtgtgggccaacctgccccagaagaccctggacctgctggtgcccccccacaagcccgacgagatgaccgtgggcaaggtgtacgccgccctgatgatcttcgacttctacaagcagaacaagaccaccagagaccagatgcagcaggcccccggcggcctgagccagatgggccccgtgagcctgttccaccccctgaaggccaccctggagcagacccagcccgccgtgctgagaggcgccagagtgttcctgagacagaagagcagcaccagcctgagcaacggcggcgccatccagaaccaggagagcggcatcaaggagagcgtgagctggggcacccagagaacccaggacgccccccacgaggccagaccccccctggagagaggccacagcaccgagatccccgtgggcagaagcggcgccctggccgtggacgtgcagatgcagagcatcaccagaagaggccccgacggcgagccccagcccggcctggagagccagggcagagccgccagcatgcccagactggccgccgagacccagcccgtgaccgacgccagccccatgaagagaagcatcagcaccctggcccagagacccagaggcacccacctgtgcagcaccacccccgacagacccccccccagccaggccagcagccaccaccaccaccacagatgccacagaagaagagacagaaagcagagaagcctggagaagggccccagcctgagcgccgacatggacggcgcccccagcagcgccgtgggccccggcctgccccccggcgagggccccaccggctgcagaagagagagagagagaagacaggagagaggcagaagccaggagagaagacagcccagcagcagcagcagcgagaagcagagattctacagctgcgacagattcggcggcagagagccccccaagcccaagcccagcctgagcagccaccccaccagccccaccgccggccaggagcccggcccccacccccagggcagcggcagcgtgaacggcagccccctgctgagcaccagcggcgccagcacccccggcagaggcggcagaagacagctgccccagacccccctgacccccagacccagcatcacctacaagaccgccaacagcagccccatccacttcgccggcgcccagaccagcctgcccgccttcagccccggcagactgagcagaggcctgagcgagcacaacgccctgctgcagagagaccccctgagccagcccctggcccccggcagcagaatcggcagcgacccctacctgggccagagactggacagcgaggccagcgtgcacgccctgcccgaggacaccctgaccttcgaggaggccgtggccaccaacagcggcagaagcagcagaaccagctacgtgagcagcctgaccagccagagccaccccctgagaagagtgcccaacggctaccactgcaccctgggcctgagcagcggcggcagagccagacacagctaccaccaccccgaccaggaccactggtgctag

SEQ ID NO: 75055 - DNA, 495 bp, Artificial Sequence
  Description of Artificial Sequence: Synthetic coding sequence
aacttcagaaccttcctgcaggccctgatgctgctgttcagaagcgccaccggcgaggcctggcacgagatcatgctgagctgcctgagcaaccaggcctgcgacgagcaggccaacgccaccgagtgcggcagcgacttcgcctacttctacttcgtgagcttcatcttcctgtgcagcttcctgatgctgaacctgttcgtggccgtgatcatggacaacttcgagtacctgaccagagacagcagcatcctgggcccccaccacctggacgagttcatcagagtgtgggccgagtacgaccccgccgcctgctgcagaatccactacaaggacatgtacagcctgctgagatgcatcgccccccccgtgggcctgggcaagaactgccccagaagactggcctacaagagactggtgagaatgaacatgcccatcagcaacgaggacatgaccgtgcacttcaccagcaccctgatggccctgatcagatag

SEQ ID NO: 75056 - DNA, 327 bp, Artificial Sequence
  Description of Artificial Sequence: Synthetic coding sequence
ctgagaaaccaccagcccagagagccccactgcgacctggagaccagcggcaccgtgaccgtgggccccatgcacaccctgcccagcacctgcctgcagaaggtggaggagcagcccgaggacgccgacaaccagagaaacgtgaccagaatgggcagccagccccccgaccccaacaccatcgtgcacatccccgtgatgctgaccggccccctgggcgaggccaccgtggtgcccaccctggagaagaacgtgtgcctgttcctgctgaccagcatggtgagcgacgagaagagcaccgtgatcagaatcgtgttcttcctgtag

SEQ ID NO: 75057 - DNA, 7020 bp, Artificial Sequence
  Description of Artificial Sequence: Synthetic coding sequence
atggtgagattcggcgacgagctgggcggcagatacggcggccccggcggcggcgagagagccagaggcggcggcgccggcggcgccggcggccccggccccggcggcctgcagcccggccagagagtgctgtacaagcagagcatcgcccagagagccagaaccatggccctgtacaaccccatccccgtgaagcagaactgcttcaccgtgaacagaagcctgttcgtgttcagcgaggacaacgtggtgagaaagtacgccaagagaatcaccgagtggccccccttcgagtacatgatcctggccaccatcatcgccaactgcatcgtgctggccctggagcagcacctgcccgacggcgacaagacccccatgagcgagagactggacgacaccgagccctacttcatcggcatcttctgcttcgaggccggcatcaagatcatcgccctgggcttcgtgttccacaagggcagctacctgagaaacggctggaacgtgatggacttcgtggtggtgctgaccggcatcctggccaccgccggcaccgacttcgacctgagaaccctgagagccgtgagagtgctgagacccctgaagctggtgagcggcatccccagcctgcaggtggtgctgaagagcatcatgaaggccatggtgcccctgctgcagatcggcctgctgctgttcttcgccatcctgatgttcgccatcatcggcctggagttctacatgggcaagttccacaaggcctgcttccccaacagcaccgacgccgagcccgtgggcgacttcccctgcggcaaggaggcccccgccagactgtgcgagggcgacaccgagtgcagagagtactggcccggccccaacttcggcatcaccaacttcgacaacatcctgttcgccatcctgaccgtgttccagtgcatcaccatggagggctggaccgacatcctgtacaacaccaacgacgccgccggcaacacctggaactggctgtacttcatccccctgatcatcatcggcagcttcttcatgctgaacctggtgctgggcgtgctgagcggcgagttcgccaaggagagagagagagtggagaacagaagagccttcctgaagctgagaagacagcagcagatcgagagagagctgaacggctacctggagtggatcttcaaggccgaggaggtgatgctggccgaggaggacagaaacgccgaggagaagagccccctggacgtgctgaagagagccgccaccaagaagagcagaaacgacctgatccacgccgaggagggcgaggacagattcgccgacctgtgcgccgtgggcagccccttcgccagagccagcctgaagagcggcaagaccgagagcagcagctacttcagaagaaaggagaagatgttcagattcttcatcagaagaatggtgaaggcccagagcttctactgggtggtgctgtgcgtggtggccctgaacaccctgtgcgtggccatggtgcactacaaccagcccagaagactgaccaccaccctgtacttcgccgagttcgtgttcctgggcctgttcctgaccgagatgagcctgaagatgtacggcctgggccccagaagctacttcagaagcagcttcaactgcttcgacttcggcgtgatcgtgggcagcgtgttcgaggtggtgtgggccgccatcaagcccggcagcagcttcggcatcagcgtgctgagagccctgagactgctgagaatcttcaaggtgaccaagtactggagcagcctgagaaacctggtggtgagcctgctgaacagcatgaagagcatcatcagcctgctgttcctgctgttcctgttcatcgtggtgttcgccctgctgggcatgcagctgttcggcggccagttcaacttccaggacgagacccccaccaccaacttcgacaccttccccgccgccatcctgaccgtgttccagatcctgaccggcgaggactggaacgccgtgatgtaccacggcatcgagagccagggcggcgtgagcaagggcatgttcagcagcttctacttcatcgtgctgaccctgttcggcaactacaccctgctgaacgtgttcctggccatcgccgtggacaacctggccaacgcccaggagctgaccaaggacgaggaggagatggaggaggccgccaaccagaagctggccctgcagaaggccaaggaggtggccgaggtgagccccatgagcgccgccaacatcagcatcgccgccagacagcagaacagcgccaaggccagaagcgtgtgggagcagagagccagccagctgagactgcagaacctgagagccagctgcgaggccctgtacagcgagatggaccccgaggagagactgagattcgccaccaccagacacctgagacccgacatgaagacccacctggacagacccctggtggtggagctgggcagagacggcgccagaggccccgtgggcggcaaggccagacccgaggccgccgaggcccccgagggcgtggacccccccagaagacaccacagacacagagacaaggacaagacccccgccgccggcgaccaggacagagccgaggcccccaaggccgagagcggcgagcccggcgccagagaggagagacccagaccccacagaagccacagcaaggaggccgccggcccccccgaggccagaagcgagagaggcagaggccccggccccgagggcggcagaagacaccacagaagaggcagccccgaggaggccgccgagagagagcccagaagacacagagcccacagacaccaggaccccagcaaggagtgcgccggcgccaagggcgagagaagagccagacacagaggcggccccagagccggccccagagaggccgagagcggcgaggagcccgccagaagacacagagccagacacaaggcccagcccgcccacgaggccgtggagaaggagaccaccgagaaggaggccaccgagaaggaggccgagatcgtggaggccgacaaggagaaggagctgagaaaccaccagcccagagagccccactgcgacctggagaccagcggcaccgtgaccgtgggccccatgcacaccctgcccagcacctgcctgcagaaggtggaggagcagcccgaggacgccgacaaccagagaaacgtgaccagaatgggcagccagccccccgaccccaacaccatcgtgcacatccccgtgatgctgaccggccccctgggcgaggccaccgtggtgcccagcggcaacgtggacctggagagccaggccgagggcaagaaggaggtggaggccgacgacgtgatgagaagcggccccagacccatcgtgccctacagcagcatgttctgcctgagccccaccaacctgctgagaagattctgccactacatcgtgaccatgagatacttcgaggtggtgatcctggtggtgatcgccctgagcagcatcgccctggccgccgaggaccccgtgagaaccgacagccccagaaacaacgccctgaagtacctggactacatcttcaccggcgtgttcaccttcgagatggtgatcaagatgatcgacctgggcctgctgctgcaccccggcgcctacttcagagacctgtggaacatcctggacttcatcgtggtgagcggcgccctggtggccttcgccttcagcggcagcaagggcaaggacatcaacaccatcaagagcctgagagtgctgagagtgctgagacccctgaagaccatcaagagactgcccaagctgaaggccgtgttcgactgcgtggtgaacagcctgaagaacgtgctgaacatcctgatcgtgtacatgctgttcatgttcatcttcgccgtgatcgccgtgcagctgttcaagggcaagttcttctactgcaccgacgagagcaaggagctggagagagactgcagaggccagtacctggactacgagaaggaggaggtggaggcccagcccagacagtggaagaagtacgacttccactacgacaacgtgctgtgggccctgctgaccctgttcaccgtgagcaccggcgagggctggcccatggtgctgaagcacagcgtggacgccacctacgaggagcagggccccagccccggctacagaatggagctgagcatcttctacgtggtgtacttcgtggtgttccccttcttcttcgtgaacatcttcgtggccctgatcatcatcaccttccaggagcagggcgacaaggtgatgagcgagtgcagcctggagaagaacgagagagcctgcatcgacttcgccatcagcgccaagcccctgaccagatacatgccccagaacagacagagcttccagtacaagacctggaccttcgtggtgagcccccccttcgagtacttcatcatggccatgatcgccctgaacaccgtggtgctgatgatgaagttctacgacgccccctacgagtacgagctgatgctgaagtgcctgaacatcgtgttcaccagcatgttcagcatggagtgcgtgctgaagatcatcgccttcggcgtgctgaactacttcagagacgcctggaacgtgttcgacttcgtgaccgtgctgggcagcatcaccgacatcctggtgaccgagatcgccgagaccaacaacttcatcaacctgagcttcctgagactgttcagagccgccagactgatcaagctgctgagacagggctacaccatcagaatcctgctgtggaccttcgtgcagagcttcaaggccctgccctacgtgtgcctgctgatcgccatgctgttcttcatctacgccatcatcggcatgcaggtgttcggcaacatcgccctggacgacgacaccagcatcaacagacacaacaacttcagaaccttcctgcaggccctgatgctgctgttcagaagcgccaccggcgaggcctggcacgagatcatgctgagctgcctgagcaaccaggcctgcgacgagcaggccaacgccaccgagtgcggcagcgacttcgcctacttctacttcgtgagcttcatcttcctgtgcagcttcctgatgctgaacctgttcgtggccgtgatcatggacaacttcgagtacctgaccagagacagcagcatcctgggcccccaccacctggacgagttcatcagagtgtgggccgagtacgaccccgccgcctgcggcagaatcagctacaacgacatgttcgagatgctgaagcacatgagcccccccctgggcctgggcaagaagtgccccgccagagtggcctacaagagactggtgagaatgaacatgcccatcagcaacgaggacatgaccgtgcacttcaccagcaccctgatggccctgatcagaaccgccctggagatcaagctggcccccgccggcaccaagcagcaccagtgcgacgccgagctgagaaaggagatcagcgtggtgtgggccaacctgccccagaagaccctggacctgctggtgcccccccacaagcccgacgagatgaccgtgggcaaggtgtacgccgccctgatgatcttcgacttctacaagcagaacaagaccaccagagaccagatgcagcaggcccccggcggcctgagccagatgggccccgtgagcctgttccaccccctgaaggccaccctggagcagacccagcccgccgtgctgagaggcgccagagtgttcctgagacagaagagcagcaccagcctgagcaacggcggcgccatccagaaccaggagagcggcatcaaggagagcgtgagctggggcacccagagaacccaggacgccccccacgaggccagaccccccctggagagaggccacagcaccgagatccccgtgggcagaagcggcgccctggccgtggacgtgcagatgcagagcatcaccagaagaggccccgacggcgagccccagcccggcctggagagccagggcagagccgccagcatgcccagactggccgccgagacccagcccgtgaccgacgccagccccatgaagagaagcatcagcaccctggcccagagacccagaggcacccacctgtgcagcaccacccccgacagacccccccccagccaggccagcagccaccaccaccaccacagatgccacagaagaagagacagaaagcagagaagcctggagaagggccccagcctgagcgccgacatggacggcgcccccagcagcgccgtgggccccggcctgccccccggcgagggccccaccggctgcagaagagagagagagagaagacaggagagaggcagaagccaggagagaagacagcccagcagcagcagcagcgagaagcagagattctacagctgcgacagattcggcggcagagagccccccaagcccaagcccagcctgagcagccaccccaccagccccaccgccggccaggagcccggcccccacccccagggcagcggcagcgtgaacggcagccccctgctgagcaccagcggcgccagcacccccggcagaggcggcagaagacagctgccccagacccccctgacccccagacccagcatcacctacaagaccgccaacagcagccccatccacttcgccggcgcccagaccagcctgcccgccttcagccccggcagactgagcagaggcctgagcgagcacaacgccctgctgcagagagaccccctgagccagcccctggcccccggcagcagaatcggcagcgacccctacctgggccagagactggacagcgaggccagcgtgcacgccctgcccgaggacaccctgaccttcgaggaggccgtggccaccaacagcggcagaagcagcagaaccagctacgtgagcagcctgaccagccagagccaccccctgagaagagtgcccaacggctaccactgcaccctgggcctgagcagcggcggcagagccagacacagctaccaccaccccgaccaggaccactggtgctag

SEQ ID NO: 75058 - DNA, 498 bp, Artificial Sequence
  Description of Artificial Sequence: Synthetic coding sequence
tgaaacttcagaaccttcctgcaggccctgatgctgctgttcagaagcgccaccggcgaggcctggcacgagatcatgctgagctgcctgagcaaccaggcctgcgacgagcaggccaacgccaccgagtgcggcagcgacttcgcctacttctacttcgtgagcttcatcttcctgtgcagcttcctgatgctgaacctgttcgtggccgtgatcatggacaacttcgagtacctgaccagagacagcagcatcctgggcccccaccacctggacgagttcatcagagtgtgggccgagtacgaccccgccgcctgctgcagaatccactacaaggacatgtacagcctgctgagatgcatcgccccccccgtgggcctgggcaagaactgccccagaagactggcctacaagagactggtgagaatgaacatgcccatcagcaacgaggacatgaccgtgcacttcaccagcaccctgatggccctgatcagatag

SEQ ID NO: 75059 - DNA, 564 bp, Artificial Sequence
  Description of Artificial Sequence: Synthetic coding sequence
ctgagaaaccaccagcccagagagccccactgcgacctggagaccagcggcaccgtgaccgtgggccccatgcacaccctgcccagcacctgcctgcagaaggtggaggagcagcccgaggacgccgacaaccagagaaacgtgaccagaatgggcagccagccccccgaccccaacaccatcgtgcacatccccgtgatgctgaccggccccctgggcgaggccaccgtggtgcccagccccaccatcggcagactgcaggccgaggagcagggcgagcccgccagagtgagcaagctgaacctggagagcgacgtgagaggccaggaggccagcagcaccggcgagagatacagactgggcggcggcaacgtggacctggagagccaggccgagggcaagaaggaggtggaggccgacgacgtgatgagaagcggccccagacccatcgtgccctacagcagcatgttctgcctgagccccaccaacctgctgagaagattctgccactacatcgtgaccatgagatacttcgaggtggtgatcctggtggtgatcgcctag

SEQ ID NO: 75060 - DNA, 6786 bp, Artificial Sequence
  Description of Artificial Sequence: Synthetic coding sequence
atggccagattcggcgacgagatgcccgccagatacggcggcggcggcagcggcgccgccgccggcgtggtggtgggcagcggcggcggcagaggcgccggcggcagcagacagggcggccagcccggcgcccagagaatgtacaagcagagcatggcccagagagccagaaccatggccctgtacaaccccatccccgtgagacagaactgcctgaccgtgaacagaagcctgttcctgttcagcgaggacaacgtggtgagaaagtacgccaagaagatcaccgagtggccccccttcgagtacatgatcctggccaccatcatcgccaactgcatcgtgctggccctggagcagcacctgcccgacgacgacaagacccccatgagcgagagactggacgacaccgagccctacttcatcggcatcttctgcttcgaggccggcatcaagatcatcgccctgggcttcgccttccacaagggcagctacctgagaaacggctggaacgtgatggacttcgtggtggtgctgaccggcatcctggccaccgtgggcaccgagttcgacctgagaaccctgagagccgtgagagtgctgagacccctgaagctggtgagcggcatccccagcctgcaggtggtgctgaagagcatcatgaaggccatgatccccctgctgcagatcggcctgctgctgttcttcgccatcctgatcttcgccatcatcggcctggagttctacatgggcaagttccacaccacctgcttcgaggagggcaccgacgacatccagggcgagagccccgccccctgcggcaccgaggagcccgccagaacctgccccaacggcaccaagtgccagccctactgggagggccccaacaacggcatcacccagttcgacaacatcctgttcgccgtgctgaccgtgttccagtgcatcaccatggagggctggaccgacctgctgtacaacagcaacgacgccagcggcaacacctggaactggctgtacttcatccccctgatcatcatcggcagcttcttcatgctgaacctggtgctgggcgtgctgagcggcgagttcgccaaggagagagagagagtggagaacagaagagccttcctgaagctgagaagacagcagcagatcgagagagagctgaacggctacatggagtggatcagcaaggccgaggaggtgatcctggccgaggacgagaccgacggcgagcagagacaccccttcgacggcgccctgagaagaaccaccatcaagaagagcaagaccgacctgctgaaccccgaggaggccgaggaccagctggccgacatcgccagcgtgggcagccccttcgccagagccagcatcaagagcgccaagctggagaacagcaccttcttccacaagaaggagagaagaatgagattctacatcagaagaatggtgaagacccaggccttctactggaccgtgctgagcctggtggccctgaacaccctgtgcgtggccatcgtgcactacaaccagcccgagtggctgagcgacttcctgtactacgccgagttcatcttcctgggcctgttcatgagcgagatgttcatcaagatgtacggcctgggcaccagaccctacttccacagcagcttcaactgcttcgactgcggcgtgatcatcggcagcatcttcgaggtgatctgggccgtgatcaagcccggcaccagcttcggcatcagcgtgctgagagccctgagactgctgagaatcttcaaggtgaccaagtactgggccagcctgagaaacctggtggtgagcctgctgaacagcatgaagagcatcatcagcctgctgttcctgctgttcctgttcatcgtggtgttcgccctgctgggcatgcagctgttcggcggccagttcaacttcgacgagggcaccccccccaccaacttcgacaccttccccgccgccatcatgaccgtgttccagatcctgaccggcgaggactggaacgaggtgatgtacgacggcatcaagagccagggcggcgtgcagggcggcatggtgttcagcatctacttcatcgtgctgaccctgttcggcaactacaccctgctgaacgtgttcctggccatcgccgtggacaacctggccaacgcccaggagctgaccaaggacgagcaggaggaggaggaggccgccaaccagaagctggccctgcagaaggccaaggaggtggccgaggtgagccccctgagcgccgccaacatgagcatcgccgtgaaggagcagcagaagaaccagaagcccgccaagagcgtgtgggagcagagaaccagcgagatgagaaagcagaacctgctggccagcagagaggccctgtacaacgagatggaccccgacgagagatggaaggccgcctacaccagacacctgagacccgacatgaagacccacctggacagacccctggtggtggacccccaggagaacagaaacaacaacaccaacaagagcagagccgccgagcccaccgtggaccagagactgggccagcagagagccgaggacttcctgagaaagcaggccagataccacgacagagccagagaccccagcggcagcgccggcctggacgccagaagaccctgggccggcagccaggaggccgagctgagcagagagggcccctacggcagagagagcgaccaccacgccagagagggcagcctggagcagcccggcttctgggagggcgaggccgagagaggcaaggccggcgacccccacagaagacacgtgcacagacagggcggcagcagagagagcagaagcggcagccccagaaccggcgccgacggcgagcacagaagacacagagcccacagaagacccggcgaggagggccccgaggacaaggccgagagaagagccagacacagagagggcagcagacccgccagaggcggcgagggcgagggcgagggccccgacggcggcgagagaagaagaagacacagacacggcgcccccgccacctacgagggcgacgccagaagagaggacaaggagagaagacacagaagaagaaaggagaaccagggcagcggcgtgcccgtgagcggccccaacctgagcaccaccagacccatccagcaggacctgggcagacaggacccccccctggccgaggacatcgacaacatgaagaacaacaagctggccaccgccgagagcgccgccccccacggcagcctgggccacgccggcctgccccagagccccgccaagatgggcaacagcaccgaccccggccccatgctggccatccccgccatggccaccaacccccagaacgccgccagcagaagaacccccaacaaccccggcaaccccagcaaccccggcccccccaagacccccgagaacagcctgatcgtgaccaaccccagcggcacccagaccaacagcgccaagaccgccagaaagcccgaccacaccaccgtggacatcccccccgcctgccccccccccctgaaccacaccgtggtgcaggtgaacaagaacgccaaccccgaccccctgcccaagaaggaggaggagaagaaggaggaggaggaggacgacagaggcgaggacggccccaagcccatgcccccctacagcagcatgttcatcctgagcaccaccaaccccctgagaagactgtgccactacatcctgaacctgagatacttcgagatgtgcatcctgatggtgatcgccatgagcagcatcgccctggccgccgaggaccccgtgcagcccaacgcccccagaaacaacgtgctgagatacttcgactacgtgttcaccggcgtgttcaccttcgagatggtgatcaagatgatcgacctgggcctggtgctgcaccagggcgcctacttcagagacctgtggaacatcctggacttcatcgtggtgagcggcgccctggtggccttcgccttcaccggcaacagcaagggcaaggacatcaacaccatcaagagcctgagagtgctgagagtgctgagacccctgaagaccatcaagagactgcccaagctgaaggccgtgttcgactgcgtggtgaacagcctgaagaacgtgttcaacatcctgatcgtgtacatgctgttcatgttcatcttcgccgtggtggccgtgcagctgttcaagggcaagttcttccactgcaccgacgagagcaaggagttcgagaaggactgcagaggcaagtacctgctgtacgagaagaacgaggtgaaggccagagacagagagtggaagaagtacgagttccactacgacaacgtgctgtgggccctgctgaccctgttcaccgtgagcaccggcgagggctggccccaggtgctgaagcacagcgtggacgccaccttcgagaaccagggccccagccccggctacagaatggagatgagcatcttctacgtggtgtacttcgtggtgttccccttcttcttcgtgaacatcttcgtggccctgatcatcatcaccttccaggagcagggcgacaagatgatggaggagtacagcctggagaagaacgagagagcctgcatcgacttcgccatcagcgccaagcccctgaccagacacatgccccagaacaagcagagcttccagtacagaatgtggcagttcgtggtgagcccccccttcgagtacaccatcatggccatgatcgccctgaacaccatcgtgctgatgatgaagttctacggcgccagcgtggcctacgagaacgccctgagagtgttcaacatcgtgttcaccagcctgttcagcctggagtgcgtgctgaaggtgatggccttcggcatcctgaactacttcagagacgcctggaacatcttcgacttcgtgaccgtgctgggcagcatcaccgacatcctggtgaccgagttcggcaacaacttcatcaacctgagcttcctgagactgttcagagccgccagactgatcaagctgctgagacagggctacaccatcagaatcctgctgtggaccttcgtgcagagcttcaaggccctgccctacgtgtgcctgctgatcgccatgctgttcttcatctacgccatcatcggcatgcaggtgttcggcaacatcggcatcgacgtggaggacgaggacagcgacgaggacgagttccagatcaccgagcacaacaacttcagaaccttcttccaggccctgatgctgctgttcagaagcgccaccggcgaggcctggcacaacatcatgctgagctgcctgagcggcaagccctgcgacaagaacagcggcatcctgaccagagagtgcggcaacgagttcgcctacttctacttcgtgagcttcatcttcctgtgcagcttcctgatgctgaacctgttcgtggccgtgatcatggacaacttcgagtacctgaccagagacagcagcatcctgggcccccaccacctggacgagtacgtgagagtgtgggccgagtacgaccccgccgcctgcggcagaatccactacaaggacatgtacagcctgctgagagtgatcagcccccccctgggcctgggcaagaagtgcccccacagagtggcctgcaagagactgctgagaatggacctgcccgtggccgacgacaacaccgtgcacttcaacagcaccctgatggccctgatcagaaccgccctggacatcaagatcgccaagggcggcgccgacaagcagcagatggacgccgagctgagaaaggagatgatggccatctggcccaacctgagccagaagaccctggacctgctggtgaccccccacaagagcaccgacctgaccgtgggcaagatctacgccgccatgatgatcatggagtactacagacagagcaaggccaagaagctgcaggccatgagagaggagcaggacagaacccccctgatgttccagagaatggagccccccagccccacccaggagggcggccccggccagaacgccctgcccagcacccagctggaccccggcggcgccctgatggcccacgagagcggcctgaaggagagccccagctgggtgacccagagagcccaggagatgttccagaagaccggcacctggagccccgagcagggcccccccaccgacatgcccaacagccagcccaacagccagagcgtggagatgagagagatgggcagagacggctacagcgacagcgagcactacctgcccatggagggccagggcagagccgccagcatgcccagactgcccgccgagaaccagagaagaagaggcagacccagaggcaacaacctgagcaccatcagcgacaccagccccatgaagagaagcgccagcgtgctgggccccaaggccagaagactggacgactacagcctggagagagtgccccccgaggagaaccagagacaccaccagagaagaagagacagaagccacagagccagcgagagaagcctgggcagatacaccgacgtggacaccggcctgggcaccgacctgagcatgaccacccagagcggcgacctgcccagcaaggagagagaccaggagagaggcagacccaaggacagaaagcacagacagcaccaccaccaccaccaccaccaccaccacccccccccccccgacaaggacagatacgcccaggagagacccgaccacggcagagccagagccagagaccagagatggagcagaagccccagcgagggcagagagcacatggcccacagacagtag

SEQ ID NO: 75061 - DNA, 7488 bp, Artificial Sequence
  Description of Artificial Sequence: Synthetic coding sequence
atggccagattcggcgacgagatgcccgccagatacggcggcggcggcagcggcgccgccgccggcgtggtggtgggcagcggcggcggcagaggcgccggcggcagcagacagggcggccagcccggcgcccagagaatgtacaagcagagcatggcccagagagccagaaccatggccctgtacaaccccatccccgtgagacagaactgcctgaccgtgaacagaagcctgttcctgttcagcgaggacaacgtggtgagaaagtacgccaagaagatcaccgagtggccccccttcgagtacatgatcctggccaccatcatcgccaactgcatcgtgctggccctggagcagcacctgcccgacgacgacaagacccccatgagcgagagactggacgacaccgagccctacttcatcggcatcttctgcttcgaggccggcatcaagatcatcgccctgggcttcgccttccacaagggcagctacctgagaaacggctggaacgtgatggacttcgtggtggtgctgaccggcatcctggccaccgtgggcaccgagttcgacctgagaaccctgagagccgtgagagtgctgagacccctgaagctggtgagcggcatccccagcctgcaggtggtgctgaagagcatcatgaaggccatgatccccctgctgcagatcggcctgctgctgttcttcgccatcctgatcttcgccatcatcggcctggagttctacatgggcaagttccacaccacctgcttcgaggagggcaccgacgacatccagggcgagagccccgccccctgcggcaccgaggagcccgccagaacctgccccaacggcaccaagtgccagccctactgggagggccccaacaacggcatcacccagttcgacaacatcctgttcgccgtgctgaccgtgttccagtgcatcaccatggagggctggaccgacctgctgtacaacagcaacgacgccagcggcaacacctggaactggctgtacttcatccccctgatcatcatcggcagcttcttcatgctgaacctggtgctgggcgtgctgagcggcgagttcgccaaggagagagagagagtggagaacagaagagccttcctgaagctgagaagacagcagcagatcgagagagagctgaacggctacatggagtggatcagcaaggccgaggaggtgatcctggccgaggacgagaccgacggcgagcagagacaccccttcgacggcgccctgagaagaaccaccatcaagaagagcaagaccgacctgctgaaccccgaggaggccgaggaccagctggccgacatcgccagcgtgggcagccccttcgccagagccagcatcaagagcgccaagctggagaacagcaccttcttccacaagaaggagagaagaatgagattctacatcagaagaatggtgaagacccaggccttctactggaccgtgctgagcctggtggccctgaacaccctgtgcgtggccatcgtgcactacaaccagcccgagtggctgagcgacttcctgtactacgccgagttcatcttcctgggcctgttcatgagcgagatgttcatcaagatgtacggcctgggcaccagaccctacttccacagcagcttcaactgcttcgactgcggcgtgatcatcggcagcatcttcgaggtgatctgggccgtgatcaagcccggcaccagcttcggcatcagcgtgctgagagccctgagactgctgagaatcttcaaggtgaccaagtactgggccagcctgagaaacctggtggtgagcctgctgaacagcatgaagagcatcatcagcctgctgttcctgctgttcctgttcatcgtggtgttcgccctgctgggcatgcagctgttcggcggccagttcaacttcgacgagggcaccccccccaccaacttcgacaccttccccgccgccatcatgaccgtgttccagatcctgaccggcgaggactggaacgaggtgatgtacgacggcatcaagagccagggcggcgtgcagggcggcatggtgttcagcatctacttcatcgtgctgaccctgttcggcaactacaccctgctgaacgtgttcctggccatcgccgtggacaacctggccaacgcccaggagctgaccaaggacgagcaggaggaggaggaggccgccaaccagaagctggccctgcagaaggccaaggaggtggccgaggtgagccccctgagcgccgccaacatgagcatcgccgtgaaggagcagcagaagaaccagaagcccgccaagagcgtgtgggagcagagaaccagcgagatgagaaagcagaacctgctggccagcagagaggccctgtacaacgagatggaccccgacgagagatggaaggccgcctacaccagacacctgagacccgacatgaagacccacctggacagacccctggtggtggacccccaggagaacagaaacaacaacaccaacaagagcagagccgccgagcccaccgtggaccagagactgggccagcagagagccgaggacttcctgagaaagcaggccagataccacgacagagccagagaccccagcggcagcgccggcctggacgccagaagaccctgggccggcagccaggaggccgagctgagcagagagggcccctacggcagagagagcgaccaccacgccagagagggcagcctggagcagcccggcttctgggagggcgaggccgagagaggcaaggccggcgacccccacagaagacacgtgcacagacagggcggcagcagagagagcagaagcggcagccccagaaccggcgccgacggcgagcacagaagacacagagcccacagaagacccggcgaggagggccccgaggacaaggccgagagaagagccagacacagagagggcagcagacccgccagaggcggcgagggcgagggcgagggccccgacggcggcgagagaagaagaagacacagacacggcgcccccgccacctacgagggcgacgccagaagagaggacaaggagagaagacacagaagaagaaaggagaaccagggcagcggcgtgcccgtgagcggccccaacctgagcaccaccagacccatccagcaggacctgggcagacaggacccccccctggccgaggacatcgacaacatgaagaacaacaagctggccaccgccgagagcgccgccccccacggcagcctgggccacgccggcctgccccagagccccgccaagatgggcaacagcaccgaccccggccccatgctggccatccccgccatggccaccaacccccagaacgccgccagcagaagaacccccaacaaccccggcaaccccagcaaccccggcccccccaagacccccgagaacagcctgatcgtgaccaaccccagcggcacccagaccaacagcgccaagaccgccagaaagcccgaccacaccaccgtggacatcccccccgcctgccccccccccctgaaccacaccgtggtgcaggtgaacaagaacgccaaccccgaccccctgcccaagaaggaggaggagaagaaggaggaggaggaggacgacagaggcgaggacggccccaagcccatgcccccctacagcagcatgttcatcctgagcaccaccaaccccctgagaagactgtgccactacatcctgaacctgagatacttcgagatgtgcatcctgatggtgatcgccatgagcagcatcgccctggccgccgaggaccccgtgcagcccaacgcccccagaaacaacgtgctgagatacttcgactacgtgttcaccggcgtgttcaccttcgagatggtgatcaagatgatcgacctgggcctggtgctgcaccagggcgcctacttcagagacctgtggaacatcctggacttcatcgtggtgagcggcgccctggtggccttcgccttcaccggcaacagcaagggcaaggacatcaacaccatcaagagcctgagagtgctgagagtgctgagacccctgaagaccatcaagagactgcccaagctgaaggccgtgttcgactgcgtggtgaacagcctgaagaacgtgttcaacatcctgatcgtgtacatgctgttcatgttcatcttcgccgtggtggccgtgcagctgttcaagggcaagttcttccactgcaccgacgagagcaaggagttcgagaaggactgcagaggcaagtacctgctgtacgagaagaacgaggtgaaggccagagacagagagtggaagaagtacgagttccactacgacaacgtgctgtgggccctgctgaccctgttcaccgtgagcaccggcgagggctggccccaggtgctgaagcacagcgtggacgccaccttcgagaaccagggccccagccccggctacagaatggagatgagcatcttctacgtggtgtacttcgtggtgttccccttcttcttcgtgaacatcttcgtggccctgatcatcatcaccttccaggagcagggcgacaagatgatggaggagtacagcctggagaagaacgagagagcctgcatcgacttcgccatcagcgccaagcccctgaccagacacatgccccagaacaagcagagcttccagtacagaatgtggcagttcgtggtgagcccccccttcgagtacaccatcatggccatgatcgccctgaacaccatcgtgctgatgatgaagttctacggcgccagcgtggcctacgagaacgccctgagagtgttcaacatcgtgttcaccagcctgttcagcctggagtgcgtgctgaaggtgatggccttcggcatcctgaactacttcagagacgcctggaacatcttcgacttcgtgaccgtgctgggcagcatcaccgacatcctggtgaccgagttcggcaacaacttcatcaacctgagcttcctgagactgttcagagccgccagactgatcaagctgctgagacagggctacaccatcagaatcctgctgtggaccttcgtgcagagcttcaaggccctgccctacgtgtgcctgctgatcgccatgctgttcttcatctacgccatcatcggcatgcaggtgttcggcaacatcggcatcgacgtggaggacgaggacagcgacgaggacgagttccagatcaccgagcacaacaacttcagaaccttcttccaggccctgatgctgctgttcagaagcgccaccggcgaggcctggcacaacatcatgctgagctgcctgagcggcaagccctgcgacaagaacagcggcatcctgaccagagagtgcggcaacgagttcgcctacttctacttcgtgagcttcatcttcctgtgcagcttcctgatgctgaacctgttcgtggccgtgatcatggacaacttcgagtacctgaccagagacagcagcatcctgggcccccaccacctggacgagtacgtgagagtgtgggccgagtacgaccccgccgcctggggcagaatgccctacctggacatgtaccagatgctgagacacatgagcccccccctgggcctgggcaagaagtgccccgccagagtggcctacaagagactgctgagaatggacctgcccgtggccgacgacaacaccgtgcacttcaacagcaccctgatggccctgatcagaaccgccctggacatcaagatcgccaagggcggcgccgacaagcagcagatggacgccgagctgagaaaggagatgatggccatctggcccaacctgagccagaagaccctggacctgctggtgaccccccacaagagcaccgacctgaccgtgggcaagatctacgccgccatgatgatcatggagtactacagacagagcaaggccaagaagctgcaggccatgagagaggagcaggacagaacccccctgatgttccagagaatggagccccccagccccacccaggagggcggccccggccagaacgccctgcccagcacccagctggaccccggcggcgccctgatggcccacgagagcggcctgaaggagagccccagctgggtgacccagagagcccaggagatgttccagaagaccggcacctggagccccgagcagggcccccccaccgacatgcccaacagccagcccaacagccagagcgtggagatgagagagatgggcagagacggctacagcgacagcgagcactacctgcccatggagggccagggcagagccgccagcatgcccagactgcccgccgagaaccagaccatcagcgacaccagccccatgaagagaagcgccagcgtgctgggccccaaggccagaagactggacgactacagcctggagagagtgccccccgaggagaaccagagacaccaccagagaagaagagacagaagccacagagccagcgagagaagcctgggcagatacaccgacgtggacaccggcctgggcaccgacctgagcatgaccacccagagcggcgacctgcccagcaaggagagagaccaggagagaggcagacccaaggacagaaagcacagacagcaccaccaccaccaccaccaccaccaccacccccccccccccgacaaggacagatacgcccaggagagacccgaccacggcagagccagagccagagaccagagatggagcagaagccccagcgagggcagagagcacatggcccacagacagggcagcagcagcgtgagcggcagccccgcccccagcaccagcggcaccagcacccccagaagaggcagaagacagctgccccagacccccagcacccccagaccccacgtgagctacagccccgtgatcagaaaggccggcggcagcggccccccccagcagcagcagcagcagcagcagcagcagcagcagcaggccgtggccagacccggcagagccgccaccagcggccccagaagataccccggccccaccgccgagcccctggccggcgacagaccccccaccggcggccacagcagcggcagaagccccagaatggagagaagagtgcccggccccgccagaagcgagagccccagagcctgcagacacggcggcgccagatggcccgccagcggcccccacgtgagcgagggcccccccggccccagacaccacggctactacagaggcagcgactacgacgaggccgacggccccggcagcggcggcggcgaggaggccatggccggcgcctacgacgcccccccccccgtgagacacgccagcagcggcgccaccggcagaagccccagaacccccagagccagcggccccgcctgcgccagccccagcagacacggcagaagactgcccaacggctactaccccgcccacggcctggccagacccagaggccccggcagcagaaagggcctgcacgagccctacagcgagagcgacgacgactggtgctag

SEQ ID NO: 75062 - DNA, 7521 bp, Artificial Sequence
  Description of Artificial Sequence: Synthetic coding sequence
atggccagattcggcgacgagatgcccgccagatacggcggcggcggcagcggcgccgccgccggcgtggtggtgggcagcggcggcggcagaggcgccggcggcagcagacagggcggccagcccggcgcccagagaatgtacaagcagagcatggcccagagagccagaaccatggccctgtacaaccccatccccgtgagacagaactgcctgaccgtgaacagaagcctgttcctgttcagcgaggacaacgtggtgagaaagtacgccaagaagatcaccgagtggccccccttcgagtacatgatcctggccaccatcatcgccaactgcatcgtgctggccctggagcagcacctgcccgacgacgacaagacccccatgagcgagagactggacgacaccgagccctacttcatcggcatcttctgcttcgaggccggcatcaagatcatcgccctgggcttcgccttccacaagggcagctacctgagaaacggctggaacgtgatggacttcgtggtggtgctgaccggcatcctggccaccgtgggcaccgagttcgacctgagaaccctgagagccgtgagagtgctgagacccctgaagctggtgagcggcatccccagcctgcaggtggtgctgaagagcatcatgaaggccatgatccccctgctgcagatcggcctgctgctgttcttcgccatcctgatcttcgccatcatcggcctggagttctacatgggcaagttccacaccacctgcttcgaggagggcaccgacgacatccagggcgagagccccgccccctgcggcaccgaggagcccgccagaacctgccccaacggcaccaagtgccagccctactgggagggccccaacaacggcatcacccagttcgacaacatcctgttcgccgtgctgaccgtgttccagtgcatcaccatggagggctggaccgacctgctgtacaacagcaacgacgccagcggcaacacctggaactggctgtacttcatccccctgatcatcatcggcagcttcttcatgctgaacctggtgctgggcgtgctgagcggcgagttcgccaaggagagagagagagtggagaacagaagagccttcctgaagctgagaagacagcagcagatcgagagagagctgaacggctacatggagtggatcagcaaggccgaggaggtgatcctggccgaggacgagaccgacggcgagcagagacaccccttcgacgccctgagaagaaccaccatcaagaagagcaagaccgacctgctgaaccccgaggaggccgaggaccagctggccgacatcgccagcgtgggcagccccttcgccagagccagcatcaagagcgccaagctggagaacagcaccttcttccacaagaaggagagaagaatgagattctacatcagaagaatggtgaagacccaggccttctactggaccgtgctgagcctggtggccctgaacaccctgtgcgtggccatcgtgcactacaaccagcccgagtggctgagcgacttcctgtactacgccgagttcatcttcctgggcctgttcatgagcgagatgttcatcaagatgtacggcctgggcaccagaccctacttccacagcagcttcaactgcttcgactgcggcgtgatcatcggcagcatcttcgaggtgatctgggccgtgatcaagcccggcaccagcttcggcatcagcgtgctgagagccctgagactgctgagaatcttcaaggtgaccaagtactgggccagcctgagaaacctggtggtgagcctgctgaacagcatgaagagcatcatcagcctgctgttcctgctgttcctgttcatcgtggtgttcgccctgctgggcatgcagctgttcggcggccagttcaacttcgacgagggcaccccccccaccaacttcgacaccttccccgccgccatcatgaccgtgttccagatcctgaccggcgaggactggaacgaggtgatgtacgacggcatcaagagccagggcggcgtgcagggcggcatggtgttcagcatctacttcatcgtgctgaccctgttcggcaactacaccctgctgaacgtgttcctggccatcgccgtggacaacctggccaacgcccaggagctgaccaaggacgagcaggaggaggaggaggccgccaaccagaagctggccctgcagaaggccaaggaggtggccgaggtgagccccctgagcgccgccaacatgagcatcgccgtgaaggagcagcagaagaaccagaagcccgccaagagcgtgtgggagcagagaaccagcgagatgagaaagcagaacctgctggccagcagagaggccctgtacaacgagatggaccccgacgagagatggaaggccgcctacaccagacacctgagacccgacatgaagacccacctggacagacccctggtggtggacccccaggagaacagaaacaacaacaccaacaagagcagagccgccgagcccaccgtggaccagagactgggccagcagagagccgaggacttcctgagaaagcaggccagataccacgacagagccagagaccccagcggcagcgccggcctggacgccagaagaccctgggccggcagccaggaggccgagctgagcagagagggcccctacggcagagagagcgaccaccacgccagagagggcagcctggagcagcccggcttctgggagggcgaggccgagagaggcaaggccggcgacccccacagaagacacgtgcacagacagggcggcagcagagagagcagaagcggcagccccagaaccggcgccgacggcgagcacagaagacacagagcccacagaagacccggcgaggagggccccgaggacaaggccgagagaagagccagacacagagagggcagcagacccgccagaggcggcgagggcgagggcgagggccccgacggcggcgagagaagaagaagacacagacacggcgcccccgccacctacgagggcgacgccagaagagaggacaaggagagaagacacagaagaagaaaggagaaccagggcagcggcgtgcccgtgagcggccccaacctgagcaccaccagacccatccagcaggacctgggcagacaggacccccccctggccgaggacatcgacaacatgaagaacaacaagctggccaccgccgagagcgccgccccccacggcagcctgggccacgccggcctgccccagagccccgccaagatgggcaacagcaccgaccccggccccatgctggccatccccgccatggccaccaacccccagaacgccgccagcagaagaacccccaacaaccccggcaaccccagcaaccccggcccccccaagacccccgagaacagcctgatcgtgaccaaccccagcggcacccagaccaacagcgccaagaccgccagaaagcccgaccacaccaccgtggacatcccccccgcctgccccccccccctgaaccacaccgtggtgcaggtgaacaagaacgccaaccccgaccccctgcccaagaaggaggaggagaagaaggaggaggaggaggacgacagaggcgaggacggccccaagcccatgcccccctacagcagcatgttcatcctgagcaccaccaaccccctgagaagactgtgccactacatcctgaacctgagatacttcgagatgtgcatcctgatggtgatcgccatgagcagcatcgccctggccgccgaggaccccgtgcagcccaacgcccccagaaacaacgtgctgagatacttcgactacgtgttcaccggcgtgttcaccttcgagatggtgatcaagatgatcgacctgggcctggtgctgcaccagggcgcctacttcagagacctgtggaacatcctggacttcatcgtggtgagcggcgccctggtggccttcgccttcaccggcaacagcaagggcaaggacatcaacaccatcaagagcctgagagtgctgagagtgctgagacccctgaagaccatcaagagactgcccaagctgaaggccgtgttcgactgcgtggtgaacagcctgaagaacgtgttcaacatcctgatcgtgtacatgctgttcatgttcatcttcgccgtggtggccgtgcagctgttcaagggcaagttcttccactgcaccgacgagagcaaggagttcgagaaggactgcagaggcaagtacctgctgtacgagaagaacgaggtgaaggccagagacagagagtggaagaagtacgagttccactacgacaacgtgctgtgggccctgctgaccctgttcaccgtgagcaccggcgagggctggccccaggtgctgaagcacagcgtggacgccaccttcgagaaccagggccccagccccggctacagaatggagatgagcatcttctacgtggtgtacttcgtggtgttccccttcttcttcgtgaacatcttcgtggccctgatcatcatcaccttccaggagcagggcgacaagatgatggaggagtacagcctggagaagaacgagagagcctgcatcgacttcgccatcagcgccaagcccctgaccagacacatgccccagaacaagcagagcttccagtacagaatgtggcagttcgtggtgagcccccccttcgagtacaccatcatggccatgatcgccctgaacaccatcgtgctgatgatgaagttctacggcgccagcgtggcctacgagaacgccctgagagtgttcaacatcgtgttcaccagcctgttcagcctggagtgcgtgctgaaggtgatggccttcggcatcctgaactacttcagagacgcctggaacatcttcgacttcgtgaccgtgctgggcagcatcaccgacatcctggtgaccgagttcggcaacaacttcatcaacctgagcttcctgagactgttcagagccgccagactgatcaagctgctgagacagggctacaccatcagaatcctgctgtggaccttcgtgcagagcttcaaggccctgccctacgtgtgcctgctgatcgccatgctgttcttcatctacgccatcatcggcatgcaggtgttcggcaacatcggcatcgacgtggaggacgaggacagcgacgaggacgagttccagatcaccgagcacaacaacttcagaaccttcttccaggccctgatgctgctgttcagaagcgccaccggcgaggcctggcacaacatcatgctgagctgcctgagcggcaagccctgcgacaagaacagcggcatcctgaccagagagtgcggcaacgagttcgcctacttctacttcgtgagcttcatcttcctgtgcagcttcctgatgctgaacctgttcgtggccgtgatcatggacaacttcgagtacctgaccagagacagcagcatcctgggcccccaccacctggacgagtacgtgagagtgtgggccgagtacgaccccgccgcctggggcagaatgccctacctggacatgtaccagatgctgagacacatgagcccccccctgggcctgggcaagaagtgccccgccagagtggcctacaagagactgctgagaatggacctgcccgtggccgacgacaacaccgtgcacttcaacagcaccctgatggccctgatcagaaccgccctggacatcaagatcgccaagggcggcgccgacaagcagcagatggacgccgagctgagaaaggagatgatggccatctggcccaacctgagccagaagaccctggacctgctggtgaccccccacaagagcaccgacctgaccgtgggcaagatctacgccgccatgatgatcatggagtactacagacagagcaaggccaagaagctgcaggccatgagagaggagcaggacagaacccccctgatgttccagagaatggagccccccagccccacccaggagggcggccccggccagaacgccctgcccagcacccagctggaccccggcggcgccctgatggcccacgagagcggcctgaaggagagccccagctgggtgacccagagagcccaggagatgttccagaagaccggcacctggagccccgagcagggcccccccaccgacatgcccaacagccagcccaacagccagagcgtggagatgagagagatgggcagagacggctacagcgacagcgagcactacctgcccatggagggccagggcagagccgccagcatgcccagactgcccgccgagaaccagagaagaagaggcagacccagaggcaacaacctgagcaccatcagcgacaccagccccatgaagagaagcgccagcgtgctgggccccaaggccagaagactggacgactacagcctggagagagtgccccccgaggagaaccagagacaccaccagagaagaagagacagaagccacagagccagcgagagaagcctgggcagatacaccgacgtggacaccggcctgggcaccgacctgagcatgaccacccagagcggcgacctgcccagcaaggagagagaccaggagagaggcagacccaaggacagaaagcacagacagcaccaccaccaccaccaccaccaccaccacccccccccccccgacaaggacagatacgcccaggagagacccgaccacggcagagccagagccagagaccagagatggagcagaagccccagcgagggcagagagcacatggcccacagacagggcagcagcagcgtgagcggcagccccgcccccagcaccagcggcaccagcacccccagaagaggcagaagacagctgccccagacccccagcacccccagaccccacgtgagctacagccccgtgatcagaaaggccggcggcagcggccccccccagcagcagcagcagcagcagcagcagcagcagcagcaggccgtggccagacccggcagagccgccaccagcggccccagaagataccccggccccaccgccgagcccctggccggcgacagaccccccaccggcggccacagcagcggcagaagccccagaatggagagaagagtgcccggccccgccagaagcgagagccccagagcctgcagacacggcggcgccagatggcccgccagcggcccccacgtgagcgagggcccccccggccccagacaccacggctactacagaggcagcgactacgacgaggccgacggccccggcagcggcggcggcgaggaggccatggccggcgcctacgacgcccccccccccgtgagacacgccagcagcggcgccaccggcagaagccccagaacccccagagccagcggccccgcctgcgccagccccagcagacacggcagaagactgcccaacggctactaccccgcccacggcctggccagacccagaggccccggcagcagaaagggcctgcacgagccctacagcgagagcgacgacgactggtgctag

SEQ ID NO: 75063 - DNA, 7539 bp, Artificial Sequence
  Description of Artificial Sequence: Synthetic coding sequence
atggccagattcggcgacgagatgcccgccagatacggcggcggcggcagcggcgccgccgccggcgtggtggtgggcagcggcggcggcagaggcgccggcggcagcagacagggcggccagcccggcgcccagagaatgtacaagcagagcatggcccagagagccagaaccatggccctgtacaaccccatccccgtgagacagaactgcctgaccgtgaacagaagcctgttcctgttcagcgaggacaacgtggtgagaaagtacgccaagaagatcaccgagtggccccccttcgagtacatgatcctggccaccatcatcgccaactgcatcgtgctggccctggagcagcacctgcccgacgacgacaagacccccatgagcgagagactggacgacaccgagccctacttcatcggcatcttctgcttcgaggccggcatcaagatcatcgccctgggcttcgccttccacaagggcagctacctgagaaacggctggaacgtgatggacttcgtggtggtgctgaccggcatcctggccaccgtgggcaccgagttcgacctgagaaccctgagagccgtgagagtgctgagacccctgaagctggtgagcggcatccccagcctgcaggtggtgctgaagagcatcatgaaggccatgatccccctgctgcagatcggcctgctgctgttcttcgccatcctgatcttcgccatcatcggcctggagttctacatgggcaagttccacaccacctgcttcgaggagggcaccgacgacatccagggcgagagccccgccccctgcggcaccgaggagcccgccagaacctgccccaacggcaccaagtgccagccctactgggagggccccaacaacggcatcacccagttcgacaacatcctgttcgccgtgctgaccgtgttccagtgcatcaccatggagggctggaccgacctgctgtacaacagcaacgacgccagcggcaacacctggaactggctgtacttcatccccctgatcatcatcggcagcttcttcatgctgaacctggtgctgggcgtgctgagcggcgagttcgccaaggagagagagagagtggagaacagaagagccttcctgaagctgagaagacagcagcagatcgagagagagctgaacggctacatggagtggatcagcaaggccgaggaggtgatcctggccgaggacgagaccgacggcgagcagagacaccccttcgacggcgccctgagaagaaccaccatcaagaagagcaagaccgacctgctgaaccccgaggaggccgaggaccagctggccgacatcgccagcgtgggcagccccttcgccagagccagcatcaagagcgccaagctggagaacagcaccttcttccacaagaaggagagaagaatgagattctacatcagaagaatggtgaagacccaggccttctactggaccgtgctgagcctggtggccctgaacaccctgtgcgtggccatcgtgcactacaaccagcccgagtggctgagcgacttcctgtactacgccgagttcatcttcctgggcctgttcatgagcgagatgttcatcaagatgtacggcctgggcaccagaccctacttccacagcagcttcaactgcttcgactgcggcgtgatcatcggcagcatcttcgaggtgatctgggccgtgatcaagcccggcaccagcttcggcatcagcgtgctgagagccctgagactgctgagaatcttcaaggtgaccaagtactgggccagcctgagaaacctggtggtgagcctgctgaacagcatgaagagcatcatcagcctgctgttcctgctgttcctgttcatcgtggtgttcgccctgctgggcatgcagctgttcggcggccagttcaacttcgacgagggcaccccccccaccaacttcgacaccttccccgccgccatcatgaccgtgttccagatcctgaccggcgaggactggaacgaggtgatgtacgacggcatcaagagccagggcggcgtgcagggcggcatggtgttcagcatctacttcatcgtgctgaccctgttcggcaactacaccctgctgaacgtgttcctggccatcgccgtggacaacctggccaacgcccaggagctgaccaaggtggaggccgacgagcaggaggaggaggaggccgccaaccagaagctggccctgcagaaggccaaggaggtggccgaggtgagccccctgagcgccgccaacatgagcatcgccgtgaaggagcagcagaagaaccagaagcccgccaagagcgtgtgggagcagagaaccagcgagatgagaaagcagaacctgctggccagcagagaggccctgtacaacgagatggaccccgacgagagatggaaggccgcctacaccagacacctgagacccgacatgaagacccacctggacagacccctggtggtggacccccaggagaacagaaacaacaacaccaacaagagcagagccgccgagcccaccgtggaccagagactgggccagcagagagccgaggacttcctgagaaagcaggccagataccacgacagagccagagaccccagcggcagcgccggcctggacgccagaagaccctgggccggcagccaggaggccgagctgagcagagagggcccctacggcagagagagcgaccaccacgccagagagggcagcctggagcagcccggcttctgggagggcgaggccgagagaggcaaggccggcgacccccacagaagacacgtgcacagacagggcggcagcagagagagcagaagcggcagccccagaaccggcgccgacggcgagcacagaagacacagagcccacagaagacccggcgaggagggccccgaggacaaggccgagagaagagccagacacagagagggcagcagacccgccagaggcggcgagggcgagggcgagggccccgacggcggcgagagaagaagaagacacagacacggcgcccccgccacctacgagggcgacgccagaagagaggacaaggagagaagacacagaagaagaaaggagaaccagggcagcggcgtgcccgtgagcggccccaacctgagcaccaccagacccatccagcaggacctgggcagacaggacccccccctggccgaggacatcgacaacatgaagaacaacaagctggccaccgccgagagcgccgccccccacggcagcctgggccacgccggcctgccccagagccccgccaagatgggcaacagcaccgaccccggccccatgctggccatccccgccatggccaccaacccccagaacgccgccagcagaagaacccccaacaaccccggcaaccccagcaaccccggcccccccaagacccccgagaacagcctgatcgtgaccaaccccagcggcacccagaccaacagcgccaagaccgccagaaagcccgaccacaccaccgtggacatcccccccgcctgccccccccccctgaaccacaccgtggtgcaggtgaacaagaacgccaaccccgaccccctgcccaagaaggaggaggagaagaaggaggaggaggaggacgacagaggcgaggacggccccaagcccatgcccccctacagcagcatgttcatcctgagcaccaccaaccccctgagaagactgtgccactacatcctgaacctgagatacttcgagatgtgcatcctgatggtgatcgccatgagcagcatcgccctggccgccgaggaccccgtgcagcccaacgcccccagaaacaacgtgctgagatacttcgactacgtgttcaccggcgtgttcaccttcgagatggtgatcaagatgatcgacctgggcctggtgctgcaccagggcgcctacttcagagacctgtggaacatcctggacttcatcgtggtgagcggcgccctggtggccttcgccttcaccggcaacagcaagggcaaggacatcaacaccatcaagagcctgagagtgctgagagtgctgagacccctgaagaccatcaagagactgcccaagctgaaggccgtgttcgactgcgtggtgaacagcctgaagaacgtgttcaacatcctgatcgtgtacatgctgttcatgttcatcttcgccgtggtggccgtgcagctgttcaagggcaagttcttccactgcaccgacgagagcaaggagttcgagaaggactgcagaggcaagtacctgctgtacgagaagaacgaggtgaaggccagagacagagagtggaagaagtacgagttccactacgacaacgtgctgtgggccctgctgaccctgttcaccgtgagcaccggcgagggctggccccaggtgctgaagcacagcgtggacgccaccttcgagaaccagggccccagccccggctacagaatggagatgagcatcttctacgtggtgtacttcgtggtgttccccttcttcttcgtgaacatcttcgtggccctgatcatcatcaccttccaggagcagggcgacaagatgatggaggagtacagcctggagaagaacgagagagcctgcatcgacttcgccatcagcgccaagcccctgaccagacacatgccccagaacaagcagagcttccagtacagaatgtggcagttcgtggtgagcccccccttcgagtacaccatcatggccatgatcgccctgaacaccatcgtgctgatgatgaagttctacggcgccagcgtggcctacgagaacgccctgagagtgttcaacatcgtgttcaccagcctgttcagcctggagtgcgtgctgaaggtgatggccttcggcatcctgaactacttcagagacgcctggaacatcttcgacttcgtgaccgtgctgggcagcatcaccgacatcctggtgaccgagttcggcaaccccaacaacttcatcaacctgagcttcctgagactgttcagagccgccagactgatcaagctgctgagacagggctacaccatcagaatcctgctgtggaccttcgtgcagagcttcaaggccctgccctacgtgtgcctgctgatcgccatgctgttcttcatctacgccatcatcggcatgcaggtgttcggcaacatcggcatcgacgtggaggacgaggacagcgacgaggacgagttccagatcaccgagcacaacaacttcagaaccttcttccaggccctgatgctgctgttcagaagcgccaccggcgaggcctggcacaacatcatgctgagctgcctgagcggcaagccctgcgacaagaacagcggcatcctgaccagagagtgcggcaacgagttcgcctacttctacttcgtgagcttcatcttcctgtgcagcttcctgatgctgaacctgttcgtggccgtgatcatggacaacttcgagtacctgaccagagacagcagcatcctgggcccccaccacctggacgagtacgtgagagtgtgggccgagtacgaccccgccgcctggggcagaatgccctacctggacatgtaccagatgctgagacacatgagcccccccctgggcctgggcaagaagtgccccgccagagtggcctacaagagactgctgagaatggacctgcccgtggccgacgacaacaccgtgcacttcaacagcaccctgatggccctgatcagaaccgccctggacatcaagatcgccaagggcggcgccgacaagcagcagatggacgccgagctgagaaaggagatgatggccatctggcccaacctgagccagaagaccctggacctgctggtgaccccccacaagagcaccgacctgaccgtgggcaagatctacgccgccatgatgatcatggagtactacagacagagcaaggccaagaagctgcaggccatgagagaggagcaggacagaacccccctgatgttccagagaatggagccccccagccccacccaggagggcggccccggccagaacgccctgcccagcacccagctggaccccggcggcgccctgatggcccacgagagcggcctgaaggagagccccagctgggtgacccagagagcccaggagatgttccagaagaccggcacctggagccccgagcagggcccccccaccgacatgcccaacagccagcccaacagccagagcgtggagatgagagagatgggcagagacggctacagcgacagcgagcactacctgcccatggagggccagggcagagccgccagcatgcccagactgcccgccgagaaccagagaagaagaggcagacccagaggcaacaacctgagcaccatcagcgacaccagccccatgaagagaagcgccagcgtgctgggccccaaggccagaagactggacgactacagcctggagagagtgccccccgaggagaaccagagacaccaccagagaagaagagacagaagccacagagccagcgagagaagcctgggcagatacaccgacgtggacaccggcctgggcaccgacctgagcatgaccacccagagcggcgacctgcccagcaaggagagagaccaggagagaggcagacccaaggacagaaagcacagacagcaccaccaccaccaccaccaccaccaccacccccccccccccgacaaggacagatacgcccaggagagacccgaccacggcagagccagagccagagaccagagatggagcagaagccccagcgagggcagagagcacatggcccacagacagggcagcagcagcgtgagcggcagccccgcccccagcaccagcggcaccagcacccccagaagaggcagaagacagctgccccagacccccagcacccccagaccccacgtgagctacagccccgtgatcagaaaggccggcggcagcggccccccccagcagcagcagcagcagcagcagcagcagcagcagcaggccgtggccagacccggcagagccgccaccagcggccccagaagataccccggccccaccgccgagcccctggccggcgacagaccccccaccggcggccacagcagcggcagaagccccagaatggagagaagagtgcccggccccgccagaagcgagagccccagagcctgcagacacggcggcgccagatggcccgccagcggcccccacgtgagcgagggcccccccggccccagacaccacggctactacagaggcagcgactacgacgaggccgacggccccggcagcggcggcggcgaggaggccatggccggcgcctacgacgcccccccccccgtgagacacgccagcagcggcgccaccggcagaagccccagaacccccagagccagcggccccgcctgcgccagccccagcagacacggcagaagactgcccaacggctactaccccgcccacggcctggccagacccagaggccccggcagcagaaagggcctgcacgagccctacagcgagagcgacgacgactggtgctag

SEQ ID NO: 75064 - DNA, 804 bp, Artificial Sequence
  Description of Artificial Sequence: Synthetic coding sequence
atgctgttcatgttcatcttcgccgtggtggccgtgcagctgttcaagggcaagttcttccactgcaccgacgagagcaaggagttcgagaaggactgcagaggcaagtacctgctgtacgagaagaacgaggtgaaggccagagacagagagtggaagaagtacgagttccactacgacaacgtgctgtgggccctgctgaccctgttcaccgtgagcaccggcgagggctggccccaggtgctgaagcacagcgtggacgccaccttcgagaaccagggccccagccccggctacagaatggagatgagcatcttctacgtggtgtacttcgtggtgttccccttcttcttcgtgaacatcttcgtggccctgatcatcatcaccttccaggagcagggcgacaagatgatggaggagtacagcctggagaagaacgagagagcctgcatcgacttcgccatcagcgccaagcccctgaccagacacatgccccagaacaagcagagcttccagtacagaatgtggcagttcgtggtgagcccccccttcgagtacaccatcatggccatgatcgccctgaacaccatcgtgctgatgatgaagttctacggcgccagcgtggcctacgagaacgccctgagagtgttcaacatcgtgttcaccagcctgttcagcctggagtgcgtgctgaaggtgatggccttcggcatcctgaactacttcagagacgcctggaacatcttcgacttcgtgaccgtgctgggcagcatcaccgacatcctggtgaccgagttcggctag

SEQ ID NO: 75065 - DNA, 6795 bp, Artificial Sequence
  Description of Artificial Sequence: Synthetic coding sequence
atggccctgtacaaccccatccccgtgagacagaactgcttcaccgtgaacagaagcctgttcatcttcggcgaggacaacatcgtgagaaagtacgccaagaagctgatcgactggccccccttcgagtacatgatcctggccaccatcatcgccaactgcatcgtgctggccctggagcagcacctgcccgaggacgacaagacccccatgagcagaagactggagaagaccgagccctacttcatcggcatcttctgcttcgaggccggcatcaagatcgtggccctgggcttcatcttccacaagggcagctacctgagaaacggctggaacgtgatggacttcatcgtggtgctgagcggcatcctggccaccgccggcacccacttcaacacccacgtggacctgagaaccctgagagccgtgagagtgctgagacccctgaagctggtgagcggcatccccagcctgcagatcgtgctgaagagcatcatgaaggccatggtgcccctgctgcagatcggcctgctgctgttcttcgccatcctgatgttcgccatcatcggcctggagttctacagcggcaagctgcacagagcctgcttcatgaacaacagcggcatcctggagggcttcgaccccccccacccctgcggcgtgcagggctgccccgccggctacgagtgcaaggactggatcggccccaacgacggcatcacccagttcgacaacatcctgttcgccgtgctgaccgtgttccagtgcatcaccatggagggctggaccaccgtgctgtacaacaccaacgacgccctgggcgccacctggaactggctgtacttcatccccctgatcatcatcggcagcttcttcgtgctgaacctggtgctgggcgtgctgagcggcgagttcgccaaggagagagagagagtggagaacagaagagccttcatgaagctgagaagacagcagcagatcgagagagagctgaacggctacagagcctggatcgacaaggccgaggaggtgatgctggccgaggagaacaagaacgccggcaccagcgccctggaggtgctgagaagagccaccatcaagagaagcagaaccgaggccatgaccagagacagcagcgacgagcactgcgtggacatcagcagcgtgggcacccccctggccagagccagcatcaagagcgccaaggtggacggcgtgagctacttcagacacaaggagagactgctgagaatcagcatcagacacatggtgaagagccaggtgttctactggatcgtgctgagcctggtggccctgaacaccgcctgcgtggccatcgtgcaccacaaccagccccagtggctgacccacctgctgtactacgccgagttcctgttcctgggcctgttcctgctggagatgagcctgaagatgtacggcatgggccccagactgtacttccacagcagcttcaactgcttcgacttcggcgtgaccgtgggcagcatcttcgaggtggtgtgggccatcttcagacccggcaccagcttcggcatcagcgtgctgagagccctgagactgctgagaatcttcaagatcaccaagtactgggccagcctgagaaacctggtggtgagcctgatgagcagcatgaagagcatcatcagcctgctgttcctgctgttcctgttcatcgtggtgttcgccctgctgggcatgcagctgttcggcggcagattcaacttcaacgacggcacccccagcgccaacttcgacaccttccccgccgccatcatgaccgtgttccagatcctgaccggcgaggactggaacgaggtgatgtacaacggcatcagaagccagggcggcgtgagcagcggcatgtggagcgccatctacttcatcgtgctgaccctgttcggcaactacaccctgctgaacgtgttcctggccatcgccgtggacaacctggccaacgcccaggagctgaccaaggacgagcaggaggaggaggaggccttcaaccagaagcacgccctgcagaaggccaaggaggtgagccccatgagcgcccccaacatgcccagcatcgagagagacagaagaagaagacaccacatgagcatgtgggagcccagaagcagccacctgagagagagaagaagaagacaccacatgagcgtgtgggagcagagaaccagccagctgagaaagcacatgcagatgagcagccaggaggccctgaacagagaggaggcccccaccatgaaccccctgaaccccctgaaccccctgagcagcctgaaccccctgaacgcccaccccagcctgtacagaagacccagagccatcgagggcctggccctgggcctggccctggagaagttcgaggaggagagaatcagcagaggcggcagcctgaagggcgacggcggcgacagaagcagcgccctggacaaccagagaacccccctgagcctgggccagagagagcccccctggctggccagaccctgccacggcaactgcgaccccacccagcaggaggccggcggcggcgaggccgtggtgaccttcgaggacagagccagacacagacagagccagagaagaagcagacacagaagagtgagaaccgagggcaaggagagcagcagcgccagcagaagcagaagcgccagccaggagagaagcctggacgaggccatgcccaccgagggcgagaaggaccacgagctgagaggcaaccacggcgccaaggagcccaccatccaggaggagagagcccaggacctgagaagaaccaacagcctgatggtgagcagaggcagcggcctggccggcggcctggacgaggccgacacccccctggtgctgccccaccccgagctggaggtgggcaagcacgtggtgctgaccgagcaggagcccgagggcagcagcgagcaggccctgctgggcaacgtgcagctggacatgggcagagtgatcagccagagcgagcccgacctgagctgcatcaccgccaacaccgacaaggccaccaccgagagcaccagcgtgaccgtggccatccccgacgtggaccccctggtggacagcaccgtggtgcacatcagcaacaagaccgacggcgaggccagccccctgaaggaggccgagatcagagaggacgaggaggaggtggagaagaagaagcagaagaaggagaagagagagaccggcaaggccatggtgccccacagcagcatgttcatcttcagcaccaccaaccccatcagaagagcctgccactacatcgtgaacctgagatacttcgagatgtgcatcctgctggtgatcgccgccagcagcatcgccctggccgccgaggaccccgtgctgaccaacagcgagagaaacaaggtgctgagatacttcgactacgtgttcaccggcgtgttcaccttcgagatggtgatcaagatgatcgaccagggcctgatcctgcaggacggcagctacttcagagacctgtggaacatcctggacttcgtggtggtggtgggcgccctggtggccttcgccctggccaacagcatgaagaccaacaagggcagagacatcaagaccatcaagagcctgagagtgctgagagtgctgagacccctgaagaccatcaagagactgcccaagctgaaggccgtgttcgactgcgtggtgaccagcctgaagaacgtgttcaacatcctgatcgtgtacaagctgttcatgttcatcttcgccgtgatcgccgtgcagctgttcaagggcaagttcttctactgcaccgacagcagcaaggacaccgagaaggagtgcatcggcaactacgtggaccacgagaagaacaagatggaggtgaagggcagagagtggaagagacacgagttccactacgacaacatcatctgggccctgctgaccctgttcaccgtgagcaccggcgagggctggccccaggtgctgcagcacagcgtggacgtgaccgaggaggacagaggccccagcagaagcaacagaatggagatgagcatcttctacgtggtgtacttcgtggtgttccccttcttcttcgtgaacatcttcgtggccctgatcatcatcaccttccaggagcagggcgacaagatgatggaggagtgcagcctggagaagaacgagagagcctgcatcgacttcgccatcagcgccaagcccctgaccagatacatgccccagaacagacacaccttccagtacagagtgtggcacttcgtggtgagccccagcttcgagtacaccatcatggccatgatcgccctgaacaccgtggtgctgatgatgaagtactacagcgccccctgcacctacgagctggccctgaagtacctgaacatcgccttcaccatggtgttcagcctggagtgcgtgctgaaggtgatcgccttcggcttcctgaactacttcagagacacctggaacatcttcgacttcatcaccgtgatcggcagcatcaccgagatcatcctgaccgacagcaagctggtgaacaccagcggcttcaacatgagcttcctgaagctgttcagagccgccagactgatcaagctgctgagacagggctacaccatcagaatcctgctgtggaccttcgtgcagagcttcaaggccctgccctacgtgtgcctgctgatcgccatgctgttcttcatctacgccatcatcggcatgcaggtgttcggcaacatcaagctggacgaggagagccacatcaacagacacaacaacttcagaagcttcttcggcagcctgatgctgctgttcagaagcgccaccggcgaggcctggcaggagatcatgctgagctgcctgggcgagaagggctgcgagcccgacaccaccgcccccagcggccagaacgagaacgagagatgcggcaccgacctggcctacgtgtacttcgtgagcttcatcttcttctgcagcttcctgatgctgaacctgttcgtggccgtgatcatggacaacttcgagtacctgaccagagacagcagcatcctgggcccccaccacctggacgagttcgtgagagtgtgggccgagtacgacagagccgcctgcggcagaatccactacaccgagatgtacgagatgctgaccctgatgagcccccccctgggcctgggcaagagatgccccagcaaggtggcctacaagagactggtgctgatgaacatgcccgtggccgaggacatgaccgtgcacttcaccagcaccctgatggccctgatcagaaccgccctggacatcaagatcgccaagggcggcgccgacagacagcagctggacagcgagctgcagaaggagaccctggccatctggccccacctgagccagaagatgctggacctgctggtgcccatgcccaaggccagcgacctgaccgtgggcaagatctacgccgccatgatgatcatggactactacaagcagagcaaggtgaagaagcagagacagcagctggaggagcagaagaacgcccccatgttccagagaatggagcccagcagcctgccccaggagatcatcgccaacgccaaggccctgccctacctgcagcaggaccccgtgagcggcctgagcggcagaagcggctaccccagcatgagccccctgagcccccaggacatcttccagctggcctgcatggaccccgccgacgacggccagttccaggagagacagagcctggagcccgaggtgagcgagctgaagagcgtgcagcccagcaaccacggcatctacctgcccagcgacacccaggagcacgccggcagcggcagagccagcagcatgcccagactgaccgtggacccccaggtggtgaccgaccccagcagcatgagaagaagcttcagcaccatcagagacaagagaagcaacagcagctggctggaggagttcagcatggagagaagcagcgagaacacctacaagagcagaagaagaagctaccacagcagcctgagactgagcgcccacagactgaacagcgacagcggccacaagagcgacacccacagaagcggcggcagagagagaggcagaagcaaggagagaaagcacctgctgagccccgacgtgagcagatgcaacagcgaggagagaggcacccaggccgactgggagagccccgagagaagacagagcagaagccccagcgagggcagaagccagacccccaacagacagggcaccggcagcctgagcgagagcagcatccccagcgtgagcgacaccagcacccccagaagaagcagaagacagctgccccccgtgccccccaagcccagacccctgctgagctacagcagcctgatcagacacgccggcagcatcagcccccccgccgacggcagcgaggagggcagccccctgaccagccaggccctggagagcaacaacgcctgcctgaccgagagcagcaacagcccccacccccagcagagccagcacgccagcccccagagatacatcagcgagccctacctggccctgcacgaggacagccacgccagcgactgcggcgaggaggagaccctgaccttcgaggccgccgtggccaccagcctgggcagaagcaacaccatcggcagcgccccccccctgagacacagctggcagatgcccaacggccactacagaagaagaagaagaggcggccccggccccggcatgatgtgcggcgccgtgaacaacctgctgagcgacaccgaggaggacgacaagtgctag

SEQ ID NO: 75066 - DNA, 6609 bp, Artificial Sequence
  Description of Artificial Sequence: Synthetic coding sequence
atggccctgtacaaccccatccccgtgagacagaactgcttcaccgtgaacagaagcctgttcatcttcggcgaggacaacatcgtgagaaagtacgccaagaagctgatcgactggccccccttcgagtacatgatcctggccaccatcatcgccaactgcatcgtgctggccctggagcagcacctgcccgaggacgacaagacccccatgagcagaagactggagaagaccgagccctacttcatcggcatcttctgcttcgaggccggcatcaagatcgtggccctgggcttcatcttccacaagggcagctacctgagaaacggctggaacgtgatggacttcatcgtggtgctgagcggcatcctggccaccgccggcacccacttcaacacccacgtggacctgagaaccctgagagccgtgagagtgctgagacccctgaagctggtgagcggcatccccagcctgcagatcgtgctgaagagcatcatgaaggccatggtgcccctgctgcagatcggcctgctgctgttcttcgccatcctgatgttcgccatcatcggcctggagttctacagcggcaagctgcacagagcctgcttcatgaacaacagcggcatcctggagggcttcgaccccccccacccctgcggcgtgcagggctgccccgccggctacgagtgcaaggactggatcggccccaacgacggcatcacccagttcgacaacatcctgttcgccgtgctgaccgtgttccagtgcatcaccatggagggctggaccaccgtgctgtacaacaccaacgacgccctgggcgccacctggaactggctgtacttcatccccctgatcatcatcggcagcttcttcgtgctgaacctggtgctgggcgtgctgagcggcgagttcgccaaggagagagagagagtggagaacagaagagccttcatgaagctgagaagacagcagcagatcgagagagagctgaacggctacagagcctggatcgacaaggccgaggaggtgatgctggccgaggagaacaagaacgccggcaccagcgccctggaggtgctgagaagagccaccatcaagagaagcagaaccgaggccatgaccagagacagcagcgacgagcactgcgtggacatcagcagcgtgggcacccccctggccagagccagcatcaagagcgccaaggtggacggcgtgagctacttcagacacaaggagagactgctgagaatcagcatcagacacatggtgaagagccaggtgttctactggatcgtgctgagcctggtggccctgaacaccgcctgcgtggccatcgtgcaccacaaccagccccagtggctgacccacctgctgtactacgccgagttcctgttcctgggcctgttcctgctggagatgagcctgaagatgtacggcatgggccccagactgtacttccacagcagcttcaactgcttcgacttcggcgtgaccgtgggcagcatcttcgaggtggtgtgggccatcttcagacccggcaccagcttcggcatcagcgtgctgagagccctgagactgctgagaatcttcaagatcaccaagtactgggccagcctgagaaacctggtggtgagcctgatgagcagcatgaagagcatcatcagcctgctgttcctgctgttcctgttcatcgtggtgttcgccctgctgggcatgcagctgttcggcggcagattcaacttcaacgacggcacccccagcgccaacttcgacaccttccccgccgccatcatgaccgtgttccagatcctgaccggcgaggactggaacgaggtgatgtacaacggcatcagaagccagggcggcgtgagcagcggcatgtggagcgccatctacttcatcgtgctgaccctgttcggcaactacaccctgctgaacgtgttcctggccatcgccgtggacaacctggccaacgcccaggagctgaccaaggacgagcaggaggaggaggaggccttcaaccagaagcacgccctgcagaaggccaaggaggtgagccccatgagcgcccccaacatgcccagcatcgagagagagagaagaagaagacaccacatgagcgtgtgggagcagagaaccagccagctgagaaagcacatgcagatgagcagccaggaggccctgaacagagaggaggcccccaccatgaaccccctgaaccccctgaaccccctgagcagcctgaaccccctgaacgcccaccccagcctgtacagaagacccagagccatcgagggcctggccctgggcctggccctggagaagttcgaggaggagagaatcagcagaggcggcagcctgaagggcgacggcggcgacagaagcagcgccctggacaaccagagaacccccctgagcctgggccagagagagcccccctggctggccagaccctgccacggcaactgcgaccccacccagcaggaggccggcggcggcgaggccgtggtgaccttcgaggacagagccagacacagacagagccagagaagaagcagacacagaagagtgagaaccgagggcaaggagagcagcagcgccagcagaagcagaagcgccagccaggagagaagcctggacgaggccatgcccaccgagggcgagaaggaccacgagctgagaggcaaccacggcgccaaggagcccaccatccaggaggagagagcccaggacctgagaagaaccaacagcctgatggtgagcagaggcagcggcctggccggcggcctggacgaggccgacacccccctggtgctgccccaccccgagctggaggtgggcaagcacgtggtgctgaccgagcaggagcccgagggcagcagcgagcaggccctgctgggcaacgtgcagctggacatgggcagagtgatcagccagagcgagcccgacctgagctgcatcaccgccaacaccgacaaggccaccaccgagagcaccagcgtgaccgtggccatccccgacgtggaccccctggtggacagcaccgtggtgcacatcagcaacaagaccgacggcgaggccagccccctgaaggaggccgagatcagagaggacgaggaggaggtggagaagaagaagcagaagaaggagaagagagagaccggcaaggccatggtgccccacagcagcatgttcatcttcagcaccaccaaccccatcagaagagcctgccactacatcgtgaacctgagatacttcgagatgtgcatcctgctggtgatcgccgccagcagcatcgccctggccgccgaggaccccgtgctgaccaacagcgagagaaacaaggtgctgagatacttcgactacgtgttcaccggcgtgttcaccttcgagatggtgatcaagatgatcgaccagggcctgatcctgcaggacggcagctacttcagagacctgtggaacatcctggacttcgtggtggtggtgggcgccctggtggccttcgccctggccaacagcatgaagaccaacaagggcagagacatcaagaccatcaagagcctgagagtgctgagagtgctgagacccctgaagaccatcaagagactgcccaagctgaaggccgtgttcgactgcgtggtgaccagcctgaagaacgtgttcaacatcctgatcgtgtacaagctgttcatgttcatcttcgccgtgatcgccgtgcagctgttcaagggcaagttcttctactgcaccgacagcagcaaggacaccgagaaggagtgcatcggcaactacgtggaccacgagaagaacaagatggaggtgaagggcagagagtggaagagacacgagttccactacgacaacatcatctgggccctgctgaccctgttcaccgtgagcaccggcgagggctggccccaggtgctgcagcacagcgtggacgtgaccgaggaggacagaggccccagcagaagcaacagaatggagatgagcatcttctacgtggtgtacttcgtggtgttccccttcttcttcgtgaacatcttcgtggccctgatcatcatcaccttccaggagcagggcgacaagatgatggaggagtgcagcctggagaagaacgagagagcctgcatcgacttcgccatcagcgccaagcccctgaccagatacatgccccagaacagacacaccttccagtacagagtgtggcacttcgtggtgagccccagcttcgagtacaccatcatggccatgatcgccctgaacaccgtggtgctgatgatgaagtactacagcgccccctgcacctacgagctggccctgaagtacctgaacatcgccttcaccatggtgttcagcctggagtgcgtgctgaaggtgatcgccttcggcttcctgaactacttcagagacacctggaacatcttcgacttcatcaccgtgatcggcagcatcaccgagatcatcctgaccgacagcaagctggtgaacaccagcggcttcaacatgagcttcctgaagctgttcagagccgccagactgatcaagctgctgagacagggctacaccatcagaatcctgctgtggaccttcgtgcagagcttcaaggccctgccctacgtgtgcctgctgatcgccatgctgttcttcatctacgccatcatcggcatgcaggtgttcggcaacatcaagctggacgaggagagccacatcaacagacacaacaacttcagaagcttcttcggcagcctgatgctgctgttcagaagcgccaccggcgaggcctggcaggagatcatgctgagctgcctgggcgagaagggctgcgagcccgacaccaccgcccccagcggccagaacgagaacgagagatgcggcaccgacctggcctacgtgtacttcgtgagcttcatcttcttctgcagcttcctgatgctgaacctgttcgtggccgtgatcatggacaacttcgagtacctgaccagagacagcagcatcctgggcccccaccacctggacgagttcgtgagagtgtgggccgagtacgacagagccgcctgcggcagaatcccctacaaggacatgtacaagctggtgagagtgatcagcccccccctgggcctgggcgagaactgcccctacagagtggcctgcaagagactggtgctgatgaacatgcccgtggccgaggacatgaccgtgcacttcaccagcaccctgatggccctgatcagaaccgccctggacatcaagatcgccaagggcggcgccgacagacagcagctggacagcgagctgcagaaggagaccctggccatctggccccacctgagccagaagatgctggacctgctggtgcccatgcccaaggccagcgacctgaccgtgggcaagatctacgccgccatgatgatcatggactactacaagcagagcaaggtgaagaagcagagacagcagctggaggagcagaagaacgcccccatgttccagagaatggagcccagcagcctgccccaggagatcatcgccaacgccaaggccctgccctacctgcagcaggaccccgtgagcggcctgagcggcagaagcggctaccccagcatgagccccctgagcccccaggacatcttccagctggcctgcatggaccccgccgacgacggccagttccaggagagacagagcctggtggtgaccgaccccagcagcatgagaagaagcttcagcaccatcagagacaagagaagcaacagcagctggctggaggagttcagcatggagagaagcagcgagaacacctacaagagcagaagaagaagctaccacagcagcctgagactgagcgcccacagactgaacagcgacagcggccacaagagcgacacccacagaagcggcggcagagagagaggcagaagcaaggagagaaagcacctgctgagccccgacgtgagcagatgcaacagcgaggagagaggcacccaggccgactgggagagccccgagagaagacagagcagaagccccagcgagggcagaagccagacccccaacagacagggcaccggcagcctgagcgagagcagcatccccagcgtgagcgacaccagcacccccagaagaagcagaagacagctgccccccgtgccccccaagcccagacccctgctgagctacagcagcctgatcagacacgccggcagcatcagcccccccgccgacggcagcgaggagggcagccccctgaccagccaggccctggagagcaacaacgcctgcctgaccgagagcagcaacagcccccacccccagcagagccagcacgccagcccccagagatacatcagcgagccctacctggccctgcacgaggacagccacgccagcgactgcggcgaggaggagaccctgaccttcgaggccgccgtggccaccagcctgggcagaagcaacaccatcggcagcgccccccccctgagacacagctggcagatgcccaacggccactacagaagaagaagaagaggcggccccggccccggcatgatgtgcggcgccgtgaacaacctgctgagcgacaccgaggaggacgacaagtgctag

SEQ ID NO: 75067 - DNA, 6885 bp, Artificial Sequence
  Description of Artificial Sequence: Synthetic coding sequence
atggccagattcggcgaggccgtggtggccagacccggcagcggcgacggcgacagcgaccagagcagaaacagacagggcacccccgtgcccgccagcggccaggccgccgcctacaagcagaccaaggcccagagagccagaaccatggccctgtacaaccccatccccgtgagacagaactgcttcaccgtgaacagaagcctgttcatcttcggcgaggacaacatcgtgagaaagtacgccaagaagctgatcgactggccccccttcgagtacatgatcctggccaccatcatcgccaactgcatcgtgctggccctggagcagcacctgcccgaggacgacaagacccccatgagcagaagactggagaagaccgagccctacttcatcggcatcttctgcttcgaggccggcatcaagatcgtggccctgggcttcatcttccacaagggcagctacctgagaaacggctggaacgtgatggacttcatcgtggtgctgagcggcatcctggccaccgccggcacccacttcaacacccacgtggacctgagaaccctgagagccgtgagagtgctgagacccctgaagctggtgagcggcatccccagcctgcagatcgtgctgaagagcatcatgaaggccatggtgcccctgctgcagatcggcctgctgctgttcttcgccatcctgatgttcgccatcatcggcctggagttctacagcggcaagctgcacagagcctgcttcatgaacaacagcggcatcctggagggcttcgaccccccccacccctgcggcgtgcagggctgccccgccggctacgagtgcaaggactggatcggccccaacgacggcatcacccagttcgacaacatcctgttcgccgtgctgaccgtgttccagtgcatcaccatggagggctggaccaccgtgctgtacaacaccaacgacgccctgggcgccacctggaactggctgtacttcatccccctgatcatcatcggcagcttcttcgtgctgaacctggtgctgggcgtgctgagcggcgagttcgccaaggagagagagagagtggagaacagaagagccttcatgaagctgagaagacagcagcagatcgagagagagctgaacggctacagagcctggatcgacaaggccgaggaggtgatgctggccgaggagaacaagaacgccggcaccagcgccctggaggtgctgagaagagccaccatcaagagaagcagaaccgaggccatgaccagagacagcagcgacgagcactgcgtggacatcagcagcgtgggcacccccctggccagagccagcatcaagagcgccaaggtggacggcgtgagctacttcagacacaaggagagactgctgagaatcagcatcagacacatggtgaagagccaggtgttctactggatcgtgctgagcctggtggccctgaacaccgcctgcgtggccatcgtgcaccacaaccagccccagtggctgacccacctgctgtactacgccgagttcctgttcctgggcctgttcctgctggagatgagcctgaagatgtacggcatgggccccagactgtacttccacagcagcttcaactgcttcgacttcggcgtgaccgtgggcagcatcttcgaggtggtgtgggccatcttcagacccggcaccagcttcggcatcagcgtgctgagagccctgagactgctgagaatcttcaagatcaccaagtactgggccagcctgagaaacctggtggtgagcctgatgagcagcatgaagagcatcatcagcctgctgttcctgctgttcctgttcatcgtggtgttcgccctgctgggcatgcagctgttcggcggcagattcaacttcaacgacggcacccccagcgccaacttcgacaccttccccgccgccatcatgaccgtgttccagatcctgaccggcgaggactggaacgaggtgatgtacaacggcatcagaagccagggcggcgtgagcagcggcatgtggagcgccatctacttcatcgtgctgaccctgttcggcaactacaccctgctgaacgtgttcctggccatcgccgtggacaacctggccaacgcccaggagctgaccaaggacgagcaggaggaggaggaggccttcaaccagaagcacgccctgcagaaggccaaggaggtgagccccatgagcgcccccaacatgcccagcatcgagagagagagaagaagaagacaccacatgagcgtgtgggagcagagaaccagccagctgagaaagcacatgcagatgagcagccaggaggccctgaacagagaggaggcccccaccatgaaccccctgaaccccctgaaccccctgagcagcctgaaccccctgaacgcccaccccagcctgtacagaagacccagagccatcgagggcctggccctgggcctggccctggagaagttcgaggaggagagaatcagcagaggcggcagcctgaagggcgacggcggcgacagaagcagcgccctggacaaccagagaacccccctgagcctgggccagagagagcccccctggctggccagaccctgccacggcaactgcgaccccacccagcaggaggccggcggcggcgaggccgtggtgaccttcgaggacagagccagacacagacagagccagagaagaagcagacacagaagagtgagaaccgagggcaaggagagcagcagcgccagcagaagcagaagcgccagccaggagagaagcctggacgaggccatgcccaccgagggcgagaaggaccacgagctgagaggcaaccacggcgccaaggagcccaccatccaggaggagagagcccaggacctgagaagaaccaacagcctgatggtgagcagaggcagcggcctggccggcggcctggacgaggccgacacccccctggtgctgccccaccccgagctggaggtgggcaagcacgtggtgctgaccgagcaggagcccgagggcagcagcgagcaggccctgctgggcaacgtgcagctggacatgggcagagtgatcagccagagcgagcccgacctgagctgcatcaccgccaacaccgacaaggccaccaccgagagcaccagcgtgaccgtggccatccccgacgtggaccccctggtggacagcaccgtggtgcacatcagcaacaagaccgacggcgaggccagccccctgaaggaggccgagatcagagaggacgaggaggaggtggagaagaagaagcagaagaaggagaagagagagaccggcaaggccatggtgccccacagcagcatgttcatcttcagcaccaccaaccccatcagaagagcctgccactacatcgtgaacctgagatacttcgagatgtgcatcctgctggtgatcgccgccagcagcatcgccctggccgccgaggaccccgtgctgaccaacagcgagagaaacaaggtgctgagatacttcgactacgtgttcaccggcgtgttcaccttcgagatggtgatcaagatgatcgaccagggcctgatcctgcaggacggcagctacttcagagacctgtggaacatcctggacttcgtggtggtggtgggcgccctggtggccttcgccctggccaacgccctgggcaccaacaagggcagagacatcaagaccatcaagagcctgagagtgctgagagtgctgagacccctgaagaccatcaagagactgcccaagctgaaggccgtgttcgactgcgtggtgaccagcctgaagaacgtgttcaacatcctgatcgtgtacaagctgttcatgttcatcttcgccgtgatcgccgtgcagctgttcaagggcaagttcttctactgcaccgacagcagcaaggacaccgagaaggagtgcatcggcaactacgtggaccacgagaagaacaagatggaggtgaagggcagagagtggaagagacacgagttccactacgacaacatcatctgggccctgctgaccctgttcaccgtgagcaccggcgagggctggccccaggtgctgcagcacagcgtggacgtgaccgaggaggacagaggccccagcagaagcaacagaatggagatgagcatcttctacgtggtgtacttcgtggtgttccccttcttcttcgtgaacatcttcgtggccctgatcatcatcaccttccaggagcagggcgacaagatgatggaggagtgcagcctggagaagaacgagagagcctgcatcgacttcgccatcagcgccaagcccctgaccagatacatgccccagaacagacacaccttccagtacagagtgtggcacttcgtggtgagccccagcttcgagtacaccatcatggccatgatcgccctgaacaccgtggtgctgatgatgaagtactacagcgccccctgcacctacgagctggccctgaagtacctgaacatcgccttcaccatggtgttcagcctggagtgcgtgctgaaggtgatcgccttcggcttcctgaactacttcagagacacctggaacatcttcgacttcatcaccgtgatcggcagcatcaccgagatcatcctgaccgacagcaagctggtgaacaccagcggcttcaacatgagcttcctgaagctgttcagagccgccagactgatcaagctgctgagacagggctacaccatcagaatcctgctgtggaccttcgtgcagagcttcaaggccctgccctacgtgtgcctgctgatcgccatgctgttcttcatctacgccatcatcggcatgcaggtgttcggcaacatcaagctggacgaggagagccacatcaacagacacaacaacttcagaagcttcttcggcagcctgatgctgctgttcagaagcgccaccggcgaggcctggcaggagatcatgctgagctgcctgggcgagaagggctgcgagcccgacaccaccgcccccagcggccagaacgagaacgagagatgcggcaccgacctggcctacgtgtacttcgtgagcttcatcttcttctgcagcttcctgatgctgaacctgttcgtggccgtgatcatggacaacttcgagtacctgaccagagacagcagcatcctgggcccccaccacctggacgagttcgtgagagtgtgggccgagtacgacagagccgcctgcggcagaatccactacaccgagatgtacgagatgctgaccctgatgagcccccccctgggcctgggcaagagatgccccagcaaggtggcctacaagagactggtgctgatgaacatgcccgtggccgaggacatgaccgtgcacttcaccagcaccctgatggccctgatcagaaccgccctggacatcaagatcgccaagggcggcgccgacagacagcagctggacagcgagctgcagaaggagaccctggccatctggccccacctgagccagaagatgctggacctgctggtgcccatgcccaaggccagcgacctgaccgtgggcaagatctacgccgccatgatgatcatggactactacaagcagagcaaggtgaagaagcagagacagcagctggaggagcagaagaacgcccccatgttccagagaatggagcccagcagcctgccccaggagatcatcgccaacgccaaggccctgccctacctgcagcaggaccccgtgagcggcctgagcggcagaagcggctaccccagcatgagccccctgagcccccaggacatcttccagctggcctgcatggaccccgccgacgacggccagttccaggagagacagagcctggagcccgaggtgagcgagctgaagagcgtgcagcccagcaaccacggcatctacctgcccagcgacacccaggagcacgccggcagcggcagagccagcagcatgcccagactgaccgtggacccccaggtggtgaccgaccccagcagcatgagaagaagcttcagcaccatcagagacaagagaagcaacagcagctggctggaggagttcagcatggagagaagcagcgagaacacctacaagagcagaagaagaagctaccacagcagcctgagactgagcgcccacagactgaacagcgacagcggccacaagagcgacacccacagaagcggcggcagagagagaggcagaagcaaggagagaaagcacctgctgagccccgacgtgagcagatgcaacagcgaggagagaggcacccaggccgactgggagagccccgagagaagacagagcagaagccccagcgagggcagaagccagacccccaacagacagggcaccggcagcctgagcgagagcagcatccccagcgtgagcgacaccagcacccccagaagaagcagaagacagctgccccccgtgccccccaagcccagacccctgctgagctacagcagcctgatcagacacgccggcagcatcagcccccccgccgacggcagcgaggagggcagccccctgaccagccaggccctggagagcaacaacgcctgcctgaccgagagcagcaacagcccccacccccagcagagccagcacgccagcccccagagatacatcagcgagccctacctggccctgcacgaggacagccacgccagcgactgcggcgaggaggagaccctgaccttcgaggccgccgtggccaccagcctgggcagaagcaacaccatcggcagcgccccccccctgagacacagctggcagatgcccaacggccactacagaagaagaagaagaggcggccccggccccggcatgatgtgcggcgccgtgaacaacctgctgagcgacaccgaggaggacgacaagtgctag

SEQ ID NO: 75068 - DNA, 5634 bp, Artificial Sequence
  Description of Artificial Sequence: Synthetic coding sequence
atgctggccgaggagaacaagaacgccggcaccagcgccctggaggtgctgagaagagccaccatcaagagaagcagaaccgaggccatgaccagagacagcagcgacgagcactgcgtggacatcagcagcgtgggcacccccctggccagagccagcatcaagagcgccaaggtggacggcgtgagctacttcagacacaaggagagactgctgagaatcagcatcagacacatggtgaagagccaggtgttctactggatcgtgctgagcctggtggccctgaacaccgcctgcgtggccatcgtgcaccacaaccagccccagtggctgacccacctgctgtactacgccgagttcctgttcctgggcctgttcctgctggagatgagcctgaagatgtacggcatgggccccagactgtacttccacagcagcttcaactgcttcgacttcggcgtgaccgtgggcagcatcttcgaggtggtgtgggccatcttcagacccggcaccagcttcggcatcagcgtgctgagagccctgagactgctgagaatcttcaagatcaccaagtactgggccagcctgagaaacctggtggtgagcctgatgagcagcatgaagagcatcatcagcctgctgttcctgctgttcctgttcatcgtggtgttcgccctgctgggcatgcagctgttcggcggcagattcaacttcaacgacggcacccccagcgccaacttcgacaccttccccgccgccatcatgaccgtgttccagatcctgaccggcgaggactggaacgaggtgatgtacaacggcatcagaagccagggcggcgtgagcagcggcatgtggagcgccatctacttcatcgtgctgaccctgttcggcaactacaccctgctgaacgtgttcctggccatcgccgtggacaacctggccaacgcccaggagctgaccaaggacgagcaggaggaggaggaggccttcaaccagaagcacgccctgcagaaggccaaggaggtgagccccatgagcgcccccaacatgcccagcatcgagagagacagaagaagaagacaccacatgagcatgtgggagcccagaagcagccacctgagagagagaagaagaagacaccacatgagcgtgtgggagcagagaaccagccagctgagaaagcacatgcagatgagcagccaggaggccctgaacagagaggaggcccccaccatgaaccccctgaaccccctgaaccccctgagcagcctgaaccccctgaacgcccaccccagcctgtacagaagacccagagccatcgagggcctggccctgggcctggccctggagaagttcgaggaggagagaatcagcagaggcggcagcctgaagggcgacggcggcgacagaagcagcgccctggacaaccagagaacccccctgagcctgggccagagagagcccccctggctggccagaccctgccacggcaactgcgaccccacccagcaggaggccggcggcggcgaggccgtggtgaccttcgaggacagagccagacacagacagagccagagaagaagcagacacagaagagtgagaaccgagggcaaggagagcagcagcgccagcagaagcagaagcgccagccaggagagaagcctggacgaggccatgcccaccgagggcgagaaggaccacgagctgagaggcaaccacggcgccaaggagcccaccatccaggaggagagagcccaggacctgagaagaaccaacagcctgatggtgagcagaggcagcggcctggccggcggcctggacgaggccgacacccccctggtgctgccccaccccgagctggaggtgggcaagcacgtggtgctgaccgagcaggagcccgagggcagcagcgagcaggccctgctgggcaacgtgcagctggacatgggcagagtgatcagccagagcgagcccgacctgagctgcatcaccgccaacaccgacaaggccaccaccgagagcaccagcgtgaccgtggccatccccgacgtggaccccctggtggacagcaccgtggtgcacatcagcaacaagaccgacggcgaggccagccccctgaaggaggccgagatcagagaggacgaggaggaggtggagaagaagaagcagaagaaggagaagagagagaccggcaaggccatggtgccccacagcagcatgttcatcttcagcaccaccaaccccatcagaagagcctgccactacatcgtgaacctgagatacttcgagatgtgcatcctgctggtgatcgccgccagcagcatcgccctggccgccgaggaccccgtgctgaccaacagcgagagaaacaaggtgctgagatacttcgactacgtgttcaccggcgtgttcaccttcgagatggtgatcaagatgatcgaccagggcctgatcctgcaggacggcagctacttcagagacctgtggaacatcctggacttcgtggtggtggtgggcgccctggtggccttcgccctggccatgagcctggagaccaacaagggcagagacatcaagaccatcaagagcctgagagtgctgagagtgctgagacccctgaagaccatcaagagactgcccaagctgaaggccgtgttcgactgcgtggtgaccagcctgaagaacgtgttcaacatcctgatcgtgtacaagctgttcatgttcatcttcgccgtgatcgccgtgcagctgttcaagggcaagttcttctactgcaccgacagcagcaaggacaccgagaaggagtgcatcggcaactacgtggaccacgagaagaacaagatggaggtgaagggcagagagtggaagagacacgagttccactacgacaacatcatctgggccctgctgaccctgttcaccgtgagcaccggcgagggctggccccaggtgctgcagcacagcgtggacgtgaccgaggaggacagaggccccagcagaagcaacagaatggagatgagcatcttctacgtggtgtacttcgtggtgttccccttcttcttcgtgaacatcttcgtggccctgatcatcatcaccttccaggagcagggcgacaagatgatggaggagtgcagcctggagaagaacgagagagcctgcatcgacttcgccatcagcgccaagcccctgaccagatacatgccccagaacagacacaccttccagtacagagtgtggcacttcgtggtgagccccagcttcgagtacaccatcatggccatgatcgccctgaacaccgtggtgctgatgatgaagtactacagcgccccctgcacctacgagctggccctgaagtacctgaacatcgccttcaccatggtgttcagcctggagtgcgtgctgaaggtgatcgccttcggcttcctgaactacttcagagacacctggaacatcttcgacttcatcaccgtgatcggcagcatcaccgagatcatcctgaccgacagcaagctggtgaacaccagcggcttcaacatgagcttcctgaagctgttcagagccgccagactgatcaagctgctgagacagggctacaccatcagaatcctgctgtggaccttcgtgcagagcttcaaggccctgccctacgtgtgcctgctgatcgccatgctgttcttcatctacgccatcatcggcatgcaggtgttcggcaacatcaagctggacgaggagagccacatcaacagacacaacaacttcagaagcttcttcggcagcctgatgctgctgttcagaagcgccaccggcgaggcctggcaggagatcatgctgagctgcctgggcgagaagggctgcgagcccgacaccaccgcccccagcggccagaacgagaacgagagatgcggcaccgacctggcctacgtgtacttcgtgagcttcatcttcttctgcagcttcctgatgctgaacctgttcgtggccgtgatcatggacaacttcgagtacctgaccagagacagcagcatcctgggcccccaccacctggacgagttcgtgagagtgtgggccgagtacgacagagccgcctgcggcagaatccactacaccgagatgtacgagatgctgaccctgatgagcccccccctgggcctgggcaagagatgccccagcaaggtggcctacaagagactggtgctgatgaacatgcccgtggccgaggacatgaccgtgcacttcaccagcaccctgatggccctgatcagaaccgccctggacatcaagatcgccaagggcggcgccgacagacagcagctggacagcgagctgcagaaggagaccctggccatctggccccacctgagccagaagatgctggacctgctggtgcccatgcccaaggccagcgacctgaccgtgggcaagatctacgccgccatgatgatcatggactactacaagcagagcaaggtgaagaagcagagacagcagctggaggagcagaagaacgcccccatgttccagagaatggagcccagcagcctgccccaggagatcatcgccaacgccaaggccctgccctacctgcagcaggaccccgtgagcggcctgagcggcagaagcggctaccccagcatgagccccctgagcccccaggacatcttccagctggcctgcatggaccccgccgacgacggccagttccaggagagacagagcctggtggtgaccgaccccagcagcatgagaagaagcttcagcaccatcagagacaagagaagcaacagcagctggctggaggagttcagcatggagagaagcagcgagaacacctacaagagcagaagaagaagctaccacagcagcctgagactgagcgcccacagactgaacagcgacagcggccacaagagcgacacccacagaagcggcggcagagagagaggcagaagcaaggagagaaagcacctgctgagccccgacgtgagcagatgcaacagcgaggagagaggcacccaggccgactgggagagccccgagagaagacagagcagaagccccagcgagggcagaagccagacccccaacagacagggcaccggcagcctgagcgagagcagcatccccagcgtgagcgacaccagcacccccagaagaagcagaagacagctgccccccgtgccccccaagcccagacccctgctgagctacagcagcctgatcagacacgccggcagcatcagcccccccgccgacggcagcgaggagggcagccccctgaccagccaggccctggagagcaacaacgcctgcctgaccgagagcagcaacagcccccacccccagcagagccagcacgccagcccccagagatacatcagcgagccctacctggccctgcacgaggacagccacgccagcgactgcggcgaggaggagaccctgaccttcgaggccgccgtggccaccagcctgggcagaagcaacaccatcggcagcgccccccccctgagacacagctggcagatgcccaacggccactacagaagaagaagaagaggcggccccggccccggcatgatgtgcggcgccgtgaacaacctgctgagcgacaccgaggaggacgacaagtgctag

SEQ ID NO: 75069 - DNA, 6813 bp, Artificial Sequence
  Description of Artificial Sequence: Synthetic coding sequence
atggccagattcggcgaggccgtggtggccagacccggcagcggcgacggcgacagcgaccagagcagaaacagacagggcacccccgtgcccgccagcggccaggccgccgcctacaagcagaccaaggcccagagagccagaaccatggccctgtacaaccccatccccgtgagacagaactgcttcaccgtgaacagaagcctgttcatcttcggcgaggacaacatcgtgagaaagtacgccaagaagctgatcgactggccccccttcgagtacatgatcctggccaccatcatcgccaactgcatcgtgctggccctggagcagcacctgcccgaggacgacaagacccccatgagcagaagactggagaagaccgagccctacttcatcggcatcttctgcttcgaggccggcatcaagatcgtggccctgggcttcatcttccacaagggcagctacctgagaaacggctggaacgtgatggacttcatcgtggtgctgagcggcatcctggccaccgccggcacccacttcaacacccacgtggacctgagaaccctgagagccgtgagagtgctgagacccctgaagctggtgagcggcatccccagcctgcagatcgtgctgaagagcatcatgaaggccatggtgcccctgctgcagatcggcctgctgctgttcttcgccatcctgatgttcgccatcatcggcctggagttctacagcggcaagctgcacagagcctgcttcatgaacaacagcggcatcctggagggcttcgaccccccccacccctgcggcgtgcagggctgccccgccggctacgagtgcaaggactggatcggccccaacgacggcatcacccagttcgacaacatcctgttcgccgtgctgaccgtgttccagtgcatcaccatggagggctggaccaccgtgctgtacaacaccaacgacgccctgggcgccacctggaactggctgtacttcatccccctgatcatcatcggcagcttcttcgtgctgaacctggtgctgggcgtgctgagcggcgagttcgccaaggagagagagagagtggagaacagaagagccttcatgaagctgagaagacagcagcagatcgagagagagctgaacggctacagagcctggatcgacaaggccgaggaggtgatgctggccgaggagaacaagaacgccggcaccagcgccctggaggtgctgagaagagccaccatcaagagaagcagaaccgaggccatgaccagagacagcagcgacgagcactgcgtggacatcagcagcgtgggcacccccctggccagagccagcatcaagagcgccaaggtggacggcgtgagctacttcagacacaaggagagactgctgagaatcagcatcagacacatggtgaagagccaggtgttctactggatcgtgctgagcctggtggccctgaacaccgcctgcgtggccatcgtgcaccacaaccagccccagtggctgacccacctgctgtactacgccgagttcctgttcctgggcctgttcctgctggagatgagcctgaagatgtacggcatgggccccagactgtacttccacagcagcttcaactgcttcgacttcggcgtgaccgtgggcagcatcttcgaggtggtgtgggccatcttcagacccggcaccagcttcggcatcagcgtgctgagagccctgagactgctgagaatcttcaagatcaccaagtactgggccagcctgagaaacctggtggtgagcctgatgagcagcatgaagagcatcatcagcctgctgttcctgctgttcctgttcatcgtggtgttcgccctgctgggcatgcagctgttcggcggcagattcaacttcaacgacggcacccccagcgccaacttcgacaccttccccgccgccatcatgaccgtgttccagatcctgaccggcgaggactggaacgaggtgatgtacaacggcatcagaagccagggcggcgtgagcagcggcatgtggagcgccatctacttcatcgtgctgaccctgttcggcaactacaccctgctgaacgtgttcctggccatcgccgtggacaacctggccaacgcccaggagctgaccaaggacgagcaggaggaggaggaggccttcaaccagaagcacgccctgcagaaggccaaggaggtgagccccatgagcgcccccaacatgcccagcatcgagagagacagaagaagaagacaccacatgagcatgtgggagcccagaagcagccacctgagagagagaagaagaagacaccacatgagcgtgtgggagcagagaaccagccagctgagaaagcacatgcagatgagcagccaggaggccctgaacagagaggaggcccccaccatgaaccccctgaaccccctgaaccccctgagcagcctgaaccccctgaacgcccaccccagcctgtacagaagacccagagccatcgagggcctggccctgggcctggccctggagaagttcgaggaggagagaatcagcagaggcggcagcctgaagggcgacggcggcgacagaagcagcgccctggacaaccagagaacccccctgagcctgggccagagagagcccccctggctggccagaccctgccacggcaactgcgaccccacccagcaggaggccggcggcggcgaggccgtggtgaccttcgaggacagagccagacacagacagagccagagaagaagcagacacagaagagtgagaaccgagggcaaggagagcagcagcgccagcagaagcagaagcgccagccaggagagaagcctggacgaggccatgcccaccgagggcgagaaggaccacgagctgagaggcaaccacggcgccaaggagcccaccatccaggaggagagagcccaggacctgagaagaaccaacagcctgatggtgagcagaggcagcggcctggccggcggcctggacgaggccgacacccccctggtgctgccccaccccgagctggaggtgggcaagcacgtggtgctgaccgagcaggagcccgagggcagcagcgagcaggccctgctgggcaacgtgcagctggacatgggcagagtgatcagccagagcgagcccgacctgagctgcatcaccgccaacaccgacaaggccaccaccgagagcaccagcgtgaccgtggccatccccgacgtggaccccctggtggacagcaccgtggtgcacatcagcaacaagaccgacggcgaggccagccccctgaaggaggccgagatcagagaggacgaggaggaggtggagaagaagaagcagaagaaggagaagagagagaccggcaaggccatggtgccccacagcagcatgttcatcttcagcaccaccaaccccatcagaagagcctgccactacatcgtgaacctgagatacttcgagatgtgcatcctgctggtgatcgccgccagcagcatcgccctggccgccgaggaccccgtgctgaccaacagcgagagaaacaaggtgctgagatacttcgactacgtgttcaccggcgtgttcaccttcgagatggtgatcaagatgatcgaccagggcctgatcctgcaggacggcagctacttcagagacctgtggaacatcctggacttcgtggtggtggtgggcgccctggtggccttcgccctggccaacgccctgggcaccaacaagggcagagacatcaagaccatcaagagcctgagagtgctgagagtgctgagacccctgaagaccatcaagagactgcccaagctgaaggccgtgttcgactgcgtggtgaccagcctgaagaacgtgttcaacatcctgatcgtgtacaagctgttcatgttcatcttcgccgtgatcgccgtgcagctgttcaagggcaagttcttctactgcaccgacagcagcaaggacaccgagaaggagtgcatcggcaactacgtggaccacgagaagaacaagatggaggtgaagggcagagagtggaagagacacgagttccactacgacaacatcatctgggccctgctgaccctgttcaccgtgagcaccggcgagggctggccccaggtgctgcagcacagcgtggacgtgaccgaggaggacagaggccccagcagaagcaacagaatggagatgagcatcttctacgtggtgtacttcgtggtgttccccttcttcttcgtgaacatcttcgtggccctgatcatcatcaccttccaggagcagggcgacaagatgatggaggagtgcagcctggagaagaacgagagagcctgcatcgacttcgccatcagcgccaagcccctgaccagatacatgccccagaacagacacaccttccagtacagagtgtggcacttcgtggtgagccccagcttcgagtacaccatcatggccatgatcgccctgaacaccgtggtgctgatgatgaagtactacagcgccccctgcacctacgagctggccctgaagtacctgaacatcgccttcaccatggtgttcagcctggagtgcgtgctgaaggtgatcgccttcggcttcctgaactacttcagagacacctggaacatcttcgacttcatcaccgtgatcggcagcatcaccgagatcatcctgaccgacagcaagctggtgaacaccagcggcttcaacatgagcttcctgaagctgttcagagccgccagactgatcaagctgctgagacagggctacaccatcagaatcctgctgtggaccttcgtgcagagcttcaaggccctgccctacgtgtgcctgctgatcgccatgctgttcttcatctacgccatcatcggcatgcaggtgttcggcaacatcaagctggacgaggagagccacatcaacagacacaacaacttcagaagcttcttcggcagcctgatgctgctgttcagaagcgccaccggcgaggcctggcaggagatcatgctgagctgcctgggcgagaagggctgcgagcccgacaccaccgcccccagcggccagaacgagaacgagagatgcggcaccgacctggcctacgtgtacttcgtgagcttcatcttcttctgcagcttcctgatgctgaacctgttcgtggccgtgatcatggacaacttcgagtacctgaccagagacagcagcatcctgggcccccaccacctggacgagttcgtgagagtgtgggccgagtacgacagagccgcctgcggcagaatccactacaccgagatgtacgagatgctgaccctgatgagcccccccctgggcctgggcaagagatgccccagcaaggtggcctacaagagactggtgctgatgaacatgcccgtggccgaggacatgaccgtgcacttcaccagcaccctgatggccctgatcagaaccgccctggacatcaagatcgccaagggcggcgccgacagacagcagctggacagcgagctgcagaaggagaccctggccatctggccccacctgagccagaagatgctggacctgctggtgcccatgcccaaggccagcgacctgaccgtgggcaagatctacgccgccatgatgatcatggactactacaagcagagcaaggtgaagaagcagagacagcagctggaggagcagaagaacgcccccatgttccagagaatggagcccagcagcctgccccaggagatcatcgccaacgccaaggccctgccctacctgcagcaggaccccgtgagcggcctgagcggcagaagcggctaccccagcatgagccccctgagcccccaggacatcttccagctggcctgcatggaccccgccgacgacggccagttccaggagagacagagcctggtggtgaccgaccccagcagcatgagaagaagcttcagcaccatcagagacaagagaagcaacagcagctggctggaggagttcagcatggagagaagcagcgagaacacctacaagagcagaagaagaagctaccacagcagcctgagactgagcgcccacagactgaacagcgacagcggccacaagagcgacacccacagaagcggcggcagagagagaggcagaagcaaggagagaaagcacctgctgagccccgacgtgagcagatgcaacagcgaggagagaggcacccaggccgactgggagagccccgagagaagacagagcagaagccccagcgagggcagaagccagacccccaacagacagggcaccggcagcctgagcgagagcagcatccccagcgtgagcgacaccagcacccccagaagaagcagaagacagctgccccccgtgccccccaagcccagacccctgctgagctacagcagcctgatcagacacgccggcagcatcagcccccccgccgacggcagcgaggagggcagccccctgaccagccaggccctggagagcaacaacgcctgcctgaccgagagcagcaacagcccccacccccagcagagccagcacgccagcccccagagatacatcagcgagccctacctggccctgcacgaggacagccacgccagcgactgcggcgaggaggagaccctgaccttcgaggccgccgtggccaccagcctgggcagaagcaacaccatcggcagcgccccccccctgagacacagctggcagatgcccaacggccactacagaagaagaagaagaggcggccccggccccggcatgatgtgcggcgccgtgaacaacctgctgagcgacaccgaggaggacgacaagtgctag

SEQ ID NO: 75070 - DNA, 6942 bp, Artificial Sequence
  Description of Artificial Sequence: Synthetic coding sequence
atggccagattcggcgaggccgtggtggccagacccggcagcggcgacggcgacagcgaccagagcagaaacagacagggcacccccgtgcccgccagcggccaggccgccgcctacaagcagaccaaggcccagagagccagaaccatggccctgtacaaccccatccccgtgagacagaactgcttcaccgtgaacagaagcctgttcatcttcggcgaggacaacatcgtgagaaagtacgccaagaagctgatcgactggccccccttcgagtacatgatcctggccaccatcatcgccaactgcatcgtgctggccctggagcagcacctgcccgaggacgacaagacccccatgagcagaagactggagaagaccgagccctacttcatcggcatcttctgcttcgaggccggcatcaagatcgtggccctgggcttcatcttccacaagggcagctacctgagaaacggctggaacgtgatggacttcatcgtggtgctgagcggcatcctggccaccgccggcacccacttcaacacccacgtggacctgagaaccctgagagccgtgagagtgctgagacccctgaagctggtgagcggcatccccagcctgcagatcgtgctgaagagcatcatgaaggccatggtgcccctgctgcagatcggcctgctgctgttcttcgccatcctgatgttcgccatcatcggcctggagttctacagcggcaagctgcacagagcctgcttcatgaacaacagcggcatcctggagggcttcgaccccccccacccctgcggcgtgcagggctgccccgccggctacgagtgcaaggactggatcggccccaacgacggcatcacccagttcgacaacatcctgttcgccgtgctgaccgtgttccagtgcatcaccatggagggctggaccaccgtgctgtacaacaccaacgacgccctgggcgccacctggaactggctgtacttcatccccctgatcatcatcggcagcttcttcgtgctgaacctggtgctgggcgtgctgagcggcgagttcgccaaggagagagagagagtggagaacagaagagccttcatgaagctgagaagacagcagcagatcgagagagagctgaacggctacagagcctggatcgacaaggccgaggaggtgatgctggccgaggagaacaagaacgccggcaccagcgccctggaggtgctgagaagagccaccatcaagagaagcagaaccgaggccatgaccagagacagcagcgacgagcactgcgtggacatcagcagcgtgggcacccccctggccagagccagcatcaagagcgccaaggtggacggcgtgagctacttcagacacaaggagagactgctgagaatcagcatcagacacatggtgaagagccaggtgttctactggatcgtgctgagcctggtggccctgaacaccgcctgcgtggccatcgtgcaccacaaccagccccagtggctgacccacctgctgtactacgccgagttcctgttcctgggcctgttcctgctggagatgagcctgaagatgtacggcatgggccccagactgtacttccacagcagcttcaactgcttcgacttcggcgtgaccgtgggcagcatcttcgaggtggtgtgggccatcttcagacccggcaccagcttcggcatcagcgtgctgagagccctgagactgctgagaatcttcaagatcaccaagtactgggccagcctgagaaacctggtggtgagcctgatgagcagcatgaagagcatcatcagcctgctgttcctgctgttcctgttcatcgtggtgttcgccctgctgggcatgcagctgttcggcggcagattcaacttcaacgacggcacccccagcgccaacttcgacaccttccccgccgccatcatgaccgtgttccagatcctgaccggcgaggactggaacgaggtgatgtacaacggcatcagaagccagggcggcgtgagcagcggcatgtggagcgccatctacttcatcgtgctgaccctgttcggcaactacaccctgctgaacgtgttcctggccatcgccgtggacaacctggccaacgcccaggagctgaccaaggacgagcaggaggaggaggaggccttcaaccagaagcacgccctgcagaaggccaaggaggtgagccccatgagcgcccccaacatgcccagcatcgagagagacagaagaagaagacaccacatgagcatgtgggagcccagaagcagccacctgagagagagaagaagaagacaccacatgagcgtgtgggagcagagaaccagccagctgagaaagcacatgcagatgagcagccaggaggccctgaacagagaggaggcccccaccatgaaccccctgaaccccctgaaccccctgagcagcctgaaccccctgaacgcccaccccagcctgtacagaagacccagagccatcgagggcctggccctgggcctggccctggagaagttcgaggaggagagaatcagcagaggcggcagcctgaagggcgacggcggcgacagaagcagcgccctggacaaccagagaacccccctgagcctgggccagagagagcccccctggctggccagaccctgccacggcaactgcgaccccacccagcaggaggccggcggcggcgaggccgtggtgaccttcgaggacagagccagacacagacagagccagagaagaagcagacacagaagagtgagaaccgagggcaaggagagcagcagcgccagcagaagcagaagcgccagccaggagagaagcctggacgaggccatgcccaccgagggcgagaaggaccacgagctgagaggcaaccacggcgccaaggagcccaccatccaggaggagagagcccaggacctgagaagaaccaacagcctgatggtgagcagaggcagcggcctggccggcggcctggacgaggccgacacccccctggtgctgccccaccccgagctggaggtgggcaagcacgtggtgctgaccgagcaggagcccgagggcagcagcgagcaggccctgctgggcaacgtgcagctggacatgggcagagtgatcagccagagcgagcccgacctgagctgcatcaccgccaacaccgacaaggccaccaccgagagcaccagcgtgaccgtggccatccccgacgtggaccccctggtggacagcaccgtggtgcacatcagcaacaagaccgacggcgaggccagccccctgaaggaggccgagatcagagaggacgaggaggaggtggagaagaagaagcagaagaaggagaagagagagaccggcaaggccatggtgccccacagcagcatgttcatcttcagcaccaccaaccccatcagaagagcctgccactacatcgtgaacctgagatacttcgagatgtgcatcctgctggtgatcgccgccagcagcatcgccctggccgccgaggaccccgtgctgaccaacagcgagagaaacaaggtgctgagatacttcgactacgtgttcaccggcgtgttcaccttcgagatggtgatcaagatgatcgaccagggcctgatcctgcaggacggcagctacttcagagacctgtggaacatcctggacttcgtggtggtggtgggcgccctggtggccttcgccctggccaacgccctgggcaccaacaagggcagagacatcaagaccatcaagagcctgagagtgctgagagtgctgagacccctgaagaccatcaagagactgcccaagctgaaggccgtgttcgactgcgtggtgaccagcctgaagaacgtgttcaacatcctgatcgtgtacaagctgttcatgttcatcttcgccgtgatcgccgtgcagctgttcaagggcaagttcttctactgcaccgacagcagcaaggacaccgagaaggagtgcatcggcaactacgtggaccacgagaagaacaagatggaggtgaagggcagagagtggaagagacacgagttccactacgacaacatcatctgggccctgctgaccctgttcaccgtgagcaccggcgagggctggccccaggtgctgcagcacagcgtggacgtgaccgaggaggacagaggccccagcagaagcaacagaatggagatgagcatcttctacgtggtgtacttcgtggtgttccccttcttcttcgtgaacatcttcgtggccctgatcatcatcaccttccaggagcagggcgacaagatgatggaggagtgcagcctggagaagaacgagagagcctgcatcgacttcgccatcagcgccaagcccctgaccagatacatgccccagaacagacacaccttccagtacagagtgtggcacttcgtggtgagccccagcttcgagtacaccatcatggccatgatcgccctgaacaccgtggtgctgatgatgaagtactacagcgccccctgcacctacgagctggccctgaagtacctgaacatcgccttcaccatggtgttcagcctggagtgcgtgctgaaggtgatcgccttcggcttcctgaactacttcagagacacctggaacatcttcgacttcatcaccgtgatcggcagcatcaccgagatcatcctgaccgacagcaagctggtgaacaccagcggcttcaacatgagcttcctgaagctgttcagagccgccagactgatcaagctgctgagacagggctacaccatcagaatcctgctgtggaccttcgtgcagagcttcaaggccctgccctacgtgtgcctgctgatcgccatgctgttcttcatctacgccatcatcggcatgcaggtgttcggcaacatcaagctggacgaggagagccacatcaacagacacaacaacttcagaagcttcttcggcagcctgatgctgctgttcagaagcgccaccggcgaggcctggcaggagatcatgctgagctgcctgggcgagaagggctgcgagcccgacaccaccgcccccagcggccagaacgagaacgagagatgcggcaccgacctggcctacgtgtacttcgtgagcttcatcttcttctgcagcttcctgatgctgaacctgttcgtggccgtgatcatggacaacttcgagtacctgaccagagacagcagcatcctgggcccccaccacctggacgagttcgtgagagtgtgggccgagtacgacagagccgcctgcggcagaatccactacaccgagatgtacgagatgctgaccctgatgagcccccccctgggcctgggcaagagatgccccagcaaggtggcctacaagagactggtgctgatgaacatgcccgtggccgaggacatgaccgtgcacttcaccagcaccctgatggccctgatcagaaccgccctggacatcaagatcgccaagggcggcgccgacagacagcagctggacagcgagctgcagaaggagaccctggccatctggccccacctgagccagaagatgctggacctgctggtgcccatgcccaaggccagcgacctgaccgtgggcaagatctacgccgccatgatgatcatggactactacaagcagagcaaggtgaagaagcagagacagcagctggaggagcagaagaacgcccccatgttccagagaatggagcccagcagcctgccccaggagatcatcgccaacgccaaggccctgccctacctgcagcaggaccccgtgagcggcctgagcggcagaagcggctaccccagcatgagccccctgagcccccaggacatcttccagctggcctgcatggaccccgccgacgacggccagttccaggagagacagagcctggagcccgaggtgagcgagctgaagagcgtgcagcccagcaaccacggcatctacctgcccagcgacacccaggagcacgccggcagcggcagagccagcagcatgcccagactgaccgtggacccccaggtggtgaccgaccccagcagcatgagaagaagcttcagcaccatcagagacaagagaagcaacagcagctggctggaggagttcagcatggagagaagcagcgagaacacctacaagagcagaagaagaagctaccacagcagcctgagactgagcgcccacagactgaacagcgacagcggccacaagagcgacacccacagaagcggcggcagagagagaggcagaagcaaggagagaaagcacctgctgagccccgacgtgagcagatgcaacagcgaggagagaggcacccaggccgactgggagagccccgagagaagacagagcagaagccccagcgagggcagaagccagacccccaacagacagggcaccggcagcctgagcgagagcagcatccccagcgtgagcgacaccagcacccccagaagaagcagaagacagctgccccccgtgccccccaagcccagacccctgctgagctacagcagcctgatcagacacgccggcagcatcagcccccccgccgacggcagcgaggagggcagccccctgaccagccaggccctggagagcaacaacgcctgcctgaccgagagcagcaacagcccccacccccagcagagccagcacgccagcccccagagatacatcagcgagccctacctggccctgcacgaggacagccacgccagcgactgcggcgaggaggagaccctgaccttcgaggccgccgtggccaccagcctgggcagaagcaacaccatcggcagcgccccccccctgagacacagctggcagatgcccaacggccactacagaagaagaagaagaggcggccccggccccggcatgatgtgcggcgccgtgaacaacctgctgagcgacaccgaggaggacgacaagtgctag

SEQ ID NO: 75071 - DNA, 1317 bp, Artificial Sequence
  Description of Artificial Sequence: Synthetic coding sequence
atggccagattcggcgaggccgtggtggccagacccggcagcggcgacggcgacagcgaccagagcagaaacagacagggcacccccgtgcccgccagcggccaggccgccgcctacaagcagaccaaggcccagagagccagaaccatggccctgtacaaccccatccccgtgagacagaactgcttcaccgtgaacagaagcctgttcatcttcggcgaggacaacatcgtgagaaagtacgccaagaagctgatcgactggccccccttcgagtacatgatcctggccaccatcatcgccaactgcatcgtgctggccctggagcagcacctgcccgaggacgacaagacccccatgagcagaagactggagaagaccgagccctacttcatcggcatcttctgcttcgaggccggcatcaagatcgtggccctgggcttcatcttccacaagggcagctacctgagaaacggctggaacgtgatggacttcatcgtggtgctgagcggcatcctggccaccgccggcacccacttcaacacccacgtggacctgagaaccctgagagccgtgagagtgctgagacccctgaagctggtgagcggcatccccagcctgcagatcgtgctgaagagcatcatgaaggccatggtgcccctgctgcagatcggcctgctgctgttcttcgccatcctgatgttcgccatcatcggcctggagttctacagcggcaagctgcacagagcctgcttcatgaacaacagcggcatcctggagggcttcgaccccccccacccctgcggcgtgcagggctgccccgccggctacgagtgcaaggactggatcggccccaacgacggcatcacccagttcgacaacatcctgttcgccgtgctgaccgtgttccagtgcatcaccatggagggctggaccaccgtgctgtacaacaccaacgacgccctgggcgccacctggaactggctgtacttcatccccctgatcatcatcggcagcttcttcgtgctgaacctggtgctgggcgtgctgagcggcgagttcgccaaggagagagagagagtggagaacagaagagccttcatgaagctgagaagacagcagcagatcgagagagagctgaacggctacagagcctggatcgacaaggccgaggaggtgatgctggccgaggagaacaagaacgccggcaccagcgccctggaggtgctgagaagagccaccatcaagagaagcagaaccgaggccatgaccagagacagcagcgacgagcactgcgtggacatcagcagcgtgtag

SEQ ID NO: 75072 - DNA, 6756 bp, Artificial Sequence
  Description of Artificial Sequence: Synthetic coding sequence
atggccagattcggcgaggccgtggtggccagacccggcagcggcgacggcgacagcgaccagagcagaaacagacagggcacccccgtgcccgccagcggccaggccgccgcctacaagcagaccaaggcccagagagccagaaccatggccctgtacaaccccatccccgtgagacagaactgcttcaccgtgaacagaagcctgttcatcttcggcgaggacaacatcgtgagaaagtacgccaagaagctgatcgactggccccccttcgagtacatgatcctggccaccatcatcgccaactgcatcgtgctggccctggagcagcacctgcccgaggacgacaagacccccatgagcagaagactggagaagaccgagccctacttcatcggcatcttctgcttcgaggccggcatcaagatcgtggccctgggcttcatcttccacaagggcagctacctgagaaacggctggaacgtgatggacttcatcgtggtgctgagcggcatcctggccaccgccggcacccacttcaacacccacgtggacctgagaaccctgagagccgtgagagtgctgagacccctgaagctggtgagcggcatccccagcctgcagatcgtgctgaagagcatcatgaaggccatggtgcccctgctgcagatcggcctgctgctgttcttcgccatcctgatgttcgccatcatcggcctggagttctacagcggcaagctgcacagagcctgcttcatgaacaacagcggcatcctggagggcttcgaccccccccacccctgcggcgtgcagggctgccccgccggctacgagtgcaaggactggatcggccccaacgacggcatcacccagttcgacaacatcctgttcgccgtgctgaccgtgttccagtgcatcaccatggagggctggaccaccgtgctgtacaacaccaacgacgccctgggcgccacctggaactggctgtacttcatccccctgatcatcatcggcagcttcttcgtgctgaacctggtgctgggcgtgctgagcggcgagttcgccaaggagagagagagagtggagaacagaagagccttcatgaagctgagaagacagcagcagatcgagagagagctgaacggctacagagcctggatcgacaaggccgaggaggtgatgctggccgaggagaacaagaacgccggcaccagcgccctggaggtgctgagaagagccaccatcaagagaagcagaaccgaggccatgaccagagacagcagcgacgagcactgcgtggacatcagcagcgtgggcacccccctggccagagccagcatcaagagcgccaaggtggacggcgtgagctacttcagacacaaggagagactgctgagaatcagcatcagacacatggtgaagagccaggtgttctactggatcgtgctgagcctggtggccctgaacaccgcctgcgtggccatcgtgcaccacaaccagccccagtggctgacccacctgctgtactacgccgagttcctgttcctgggcctgttcctgctggagatgagcctgaagatgtacggcatgggccccagactgtacttccacagcagcttcaactgcttcgacttcggcgtgaccgtgggcagcatcttcgaggtggtgtgggccatcttcagacccggcaccagcttcggcatcagcgtgctgagagccctgagactgctgagaatcttcaagatcaccaagtactgggccagcctgagaaacctggtggtgagcctgatgagcagcatgaagagcatcatcagcctgctgttcctgctgttcctgttcatcgtggtgttcgccctgctgggcatgcagctgttcggcggcagattcaacttcaacgacggcacccccagcgccaacttcgacaccttccccgccgccatcatgaccgtgttccagatcctgaccggcgaggactggaacgaggtgatgtacaacggcatcagaagccagggcggcgtgagcagcggcatgtggagcgccatctacttcatcgtgctgaccctgttcggcaactacaccctgctgaacgtgttcctggccatcgccgtggacaacctggccaacgcccaggagctgaccaaggacgagcaggaggaggaggaggccttcaaccagaagcacgccctgcagaaggccaaggaggtgagccccatgagcgcccccaacatgcccagcatcgagagagagagaagaagaagacaccacatgagcgtgtgggagcagagaaccagccagctgagaaagcacatgcagatgagcagccaggaggccctgaacagagaggaggcccccaccatgaaccccctgaaccccctgaaccccctgagcagcctgaaccccctgaacgcccaccccagcctgtacagaagacccagagccatcgagggcctggccctgggcctggccctggagaagttcgaggaggagagaatcagcagaggcggcagcctgaagggcgacggcggcgacagaagcagcgccctggacaaccagagaacccccctgagcctgggccagagagagcccccctggctggccagaccctgccacggcaactgcgaccccacccagcaggaggccggcggcggcgaggccgtggtgaccttcgaggacagagccagacacagacagagccagagaagaagcagacacagaagagtgagaaccgagggcaaggagagcagcagcgccagcagaagcagaagcgccagccaggagagaagcctggacgaggccatgcccaccgagggcgagaaggaccacgagctgagaggcaaccacggcgccaaggagcccaccatccaggaggagagagcccaggacctgagaagaaccaacagcctgatggtgagcagaggcagcggcctggccggcggcctggacgaggccgacacccccctggtgctgccccaccccgagctggaggtgggcaagcacgtggtgctgaccgagcaggagcccgagggcagcagcgagcaggccctgctgggcaacgtgcagctggacatgggcagagtgatcagccagagcgagcccgacctgagctgcatcaccgccaacaccgacaaggccaccaccgagagcaccagcgtgaccgtggccatccccgacgtggaccccctggtggacagcaccgtggtgcacatcagcaacaagaccgacggcgaggccagccccctgaaggaggccgagatcagagaggacgaggaggaggtggagaagaagaagcagaagaaggagaagagagagaccggcaaggccatggtgccccacagcagcatgttcatcttcagcaccaccaaccccatcagaagagcctgccactacatcgtgaacctgagatacttcgagatgtgcatcctgctggtgatcgccgccagcagcatcgccctggccgccgaggaccccgtgctgaccaacagcgagagaaacaaggtgctgagatacttcgactacgtgttcaccggcgtgttcaccttcgagatggtgatcaagatgatcgaccagggcctgatcctgcaggacggcagctacttcagagacctgtggaacatcctggacttcgtggtggtggtgggcgccctggtggccttcgccctggccaacgccctgggcaccaacaagggcagagacatcaagaccatcaagagcctgagagtgctgagagtgctgagacccctgaagaccatcaagagactgcccaagctgaaggccgtgttcgactgcgtggtgaccagcctgaagaacgtgttcaacatcctgatcgtgtacaagctgttcatgttcatcttcgccgtgatcgccgtgcagctgttcaagggcaagttcttctactgcaccgacagcagcaaggacaccgagaaggagtgcatcggcaactacgtggaccacgagaagaacaagatggaggtgaagggcagagagtggaagagacacgagttccactacgacaacatcatctgggccctgctgaccctgttcaccgtgagcaccggcgagggctggccccaggtgctgcagcacagcgtggacgtgaccgaggaggacagaggccccagcagaagcaacagaatggagatgagcatcttctacgtggtgtacttcgtggtgttccccttcttcttcgtgaacatcttcgtggccctgatcatcatcaccttccaggagcagggcgacaagatgatggaggagtgcagcctggagaagaacgagagagcctgcatcgacttcgccatcagcgccaagcccctgaccagatacatgccccagaacagacacaccttccagtacagagtgtggcacttcgtggtgagccccagcttcgagtacaccatcatggccatgatcgccctgaacaccgtggtgctgatgatgaagtactacagcgccccctgcacctacgagctggccctgaagtacctgaacatcgccttcaccatggtgttcagcctggagtgcgtgctgaaggtgatcgccttcggcttcctgaactacttcagagacacctggaacatcttcgacttcatcaccgtgatcggcagcatcaccgagatcatcctgaccgacagcaagctggtgaacaccagcggcttcaacatgagcttcctgaagctgttcagagccgccagactgatcaagctgctgagacagggctacaccatcagaatcctgctgtggaccttcgtgcagagcttcaaggccctgccctacgtgtgcctgctgatcgccatgctgttcttcatctacgccatcatcggcatgcaggtgttcggcaacatcaagctggacgaggagagccacatcaacagacacaacaacttcagaagcttcttcggcagcctgatgctgctgttcagaagcgccaccggcgaggcctggcaggagatcatgctgagctgcctgggcgagaagggctgcgagcccgacaccaccgcccccagcggccagaacgagaacgagagatgcggcaccgacctggcctacgtgtacttcgtgagcttcatcttcttctgcagcttcctgatgctgaacctgttcgtggccgtgatcatggacaacttcgagtacctgaccagagacagcagcatcctgggcccccaccacctggacgagttcgtgagagtgtgggccgagtacgacagagccgcctgcggcagaatccactacaccgagatgtacgagatgctgaccctgatgagcccccccctgggcctgggcaagagatgccccagcaaggtggcctacaagagactggtgctgatgaacatgcccgtggccgaggacatgaccgtgcacttcaccagcaccctgatggccctgatcagaaccgccctggacatcaagatcgccaagggcggcgccgacagacagcagctggacagcgagctgcagaaggagaccctggccatctggccccacctgagccagaagatgctggacctgctggtgcccatgcccaaggccagcgacctgaccgtgggcaagatctacgccgccatgatgatcatggactactacaagcagagcaaggtgaagaagcagagacagcagctggaggagcagaagaacgcccccatgttccagagaatggagcccagcagcctgccccaggagatcatcgccaacgccaaggccctgccctacctgcagcaggaccccgtgagcggcctgagcggcagaagcggctaccccagcatgagccccctgagcccccaggacatcttccagctggcctgcatggaccccgccgacgacggccagttccaggagagacagagcctggtggtgaccgaccccagcagcatgagaagaagcttcagcaccatcagagacaagagaagcaacagcagctggctggaggagttcagcatggagagaagcagcgagaacacctacaagagcagaagaagaagctaccacagcagcctgagactgagcgcccacagactgaacagcgacagcggccacaagagcgacacccacagaagcggcggcagagagagaggcagaagcaaggagagaaagcacctgctgagccccgacgtgagcagatgcaacagcgaggagagaggcacccaggccgactgggagagccccgagagaagacagagcagaagccccagcgagggcagaagccagacccccaacagacagggcaccggcagcctgagcgagagcagcatccccagcgtgagcgacaccagcacccccagaagaagcagaagacagctgccccccgtgccccccaagcccagacccctgctgagctacagcagcctgatcagacacgccggcagcatcagcccccccgccgacggcagcgaggagggcagccccctgaccagccaggccctggagagcaacaacgcctgcctgaccgagagcagcaacagcccccacccccagcagagccagcacgccagcccccagagatacatcagcgagccctacctggccctgcacgaggacagccacgccagcgactgcggcgaggaggagaccctgaccttcgaggccgccgtggccaccagcctgggcagaagcaacaccatcggcagcgccccccccctgagacacagctggcagatgcccaacggccactacagaagaagaagaagaggcggccccggccccggcatgatgtgcggcgccgtgaacaacctgctgagcgacaccgaggaggacgacaagtgctag

SEQ ID NO: 75073 - DNA, 7062 bp, Artificial Sequence
  Description of Artificial Sequence: Synthetic coding sequence
atgaccgagggcgccagagccgccgacgaggtgagagtgcccctgggcgcccccccccccggccccgccgccctggtgggcgccagccccgagagccccggcgcccccggcagagaggccgagagaggcagcgagctgggcgtgagccccagcgagagccccgccgccgagagaggcgccgagctgggcgccgacgaggagcagagagtgccctaccccgccctggccgccaccgtgttcttctgcctgggccagaccaccagacccagaagctggtgcctgagactggtgtgcaacccctggttcgagcacgtgagcatgctggtgatcatgctgaactgcgtgaccctgggcatgttcagaccctgcgaggacgtggagtgcggcagcgagagatgcaacatcctggaggccttcgacgccttcatcttcgccttcttcgccgtggagatggtgatcaagatggtggccctgggcctgttcggccagaagtgctacctgggcgacacctggaacagactggacttcttcatcgtggtggccggcatgatggagtacagcctggacggccacaacgtgagcctgagcgccatcagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctggacagcgccttcgtgagaaacaacaacctgaccttcctgagaccctactaccagaccgaggagggcgaggagaaccccttcatctgcagcagcagaagagacaacggcatgcagaagtgcagccacatccccggcagaagagagctgagaatgccctgcaccctgggctgggaggcctacacccagccccaggccgagggcgtgggcgccgccagaaacgcctgcatcaactggaaccagtactacaacgtgtgcagaagcggcgacagcaacccccacaacggcgccatcaacttcgacaacatcggctacgcctggatcgccatcttccaggtgatcaccctggagggctgggtggacatcatgtactacgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagccagacacctgagcaacgacagcaccctggccagcttcagcgagcccggcagctgctacgaggagctgctgaagtacgtgggccacatcttcagaaaggtgaagagaagaagcctgagactgtacgccagatggcagagcagatggagaaagaaggtggaccccagcgccgtgcagggccagggccccggccacagacagagaagagccggcagacacaccgccagcgtgcaccacctggtgtaccaccaccaccaccaccaccaccaccactaccacttcagccacggcagccccagaagacccggccccgagcccggcgcctgcgacaccagactggtgagagccggcgccccccccagcccccccagccccggcagaggcccccccgacgccgagagcgtgcacagcatctaccacgccgactgccacatcgagggcccccaggagagagccagagtggcccacgccgccgccaccgccgccgccagcctgagactggccaccggcctgggcaccatgaactaccccaccatcctgcccagcggcgtgggcagcggcaagggcagcaccagccccggccccaagggcaagtgggccggcggcccccccggcaccggcggccacggccccctgagcctgaacagccccgacccctacgagaagatcccccacgtggtgggcgagcacggcctgggccaggcccccggccacctgagcggcctgagcgtgccctgccccctgcccagcccccccgccggcaccctgacctgcgagctgaagagctgcccctactgcaccagagccctggaggaccccgagggcgagctgagcggcagcgagagcggcgacagcgacggcagaggcgtgtacgagttcacccaggacgtgagacacggcgacagatgggaccccaccagaccccccagagccaccgacacccccggccccggccccggcagcccccagagaagagcccagcagagagccgcccccggcgagcccggctggatgggcagactgtgggtgaccttcagcggcaagctgagaagaatcgtggacagcaagtacttcagcagaggcatcatgatggccatcctggtgaacaccctgagcatgggcgtggagtaccacgagcagcccgaggagctgaccaacgccctggagatcagcaacatcgtgttcaccagcatgttcgccctggagatgctgctgaagctgctggcctgcggccccctgggctacatcagaaacccctacaacatcttcgacggcatcatcgtggtgatcagcgtgtgggagatcgtgggccaggccgacggcggcctgagcgtgctgagaaccttcagactgctgagagtgctgaagctggtgagattcctgcccgccctgagaagacagctggtggtgctggtgaagaccatggacaacgtggccaccttctgcaccctgctgatgctgttcatcttcatcttcagcatcctgggcatgcacctgttcggctgcaagttcagcctgaagaccgacaccggcgacaccgtgcccgacagaaagaacttcgacagcctgctgtgggccatcgtgaccgtgttccagatcctgacccaggaggactggaacgtggtgctgtacaacggcatggccagcaccagcagctgggccgccctgtacttcgtggccctgatgaccttcggcaactacgtgctgttcaacctgctggtggccatcctggtggagggcttccaggccgagggcgacgccaacagaagcgacaccgacgaggacaagaccagcgtgcacttcgaggaggacttccacaagctgagagagctgcagaccaccgagctgaagatgtgcagcctggccgtgacccccaacggccacctggagggcagaggcagcctgagcccccccctgatcatgtgcaccgccgccacccccatgcccacccccaagagcagccccttcctggacgccgcccccagcctgcccgacagcagaagaggcagcagcagcagcggcgacccccccctgggcgaccagaagccccccgccagcctgagaagcagcccctgcgccccctggggccccagcggcgcctggagcagcagaagaagcagctggagcagcctgggcagagcccccagcctgaagagaagaggccagtgcggcgagagagagagcctgctgagcggcgagggcaagggcagcaccgacgacgaggccgaggacggcagagccgcccccggccccagagccacccccctgagaagagccgagagcctggaccccagacccctgagacccgccgccctgccccccaccaagtgcagagacagagacggccaggtggtggccctgcccagcgacttcttcctgagaatcgacagccacagagaggacgccgccgagctggacgacgacagcgaggacagctgctgcctgagactgcacaaggtgctggagccctacaagccccagtggtgcagaagcagagaggcctgggccctgtacctgttcagcccccagaacagattcagagtgagctgccagaaggtgatcacccacaagatgttcgaccacgtggtgctggtgttcatcttcctgaactgcgtgaccatcgccctggagagacccgacatcgaccccggcagcaccgagagagtgttcctgagcgtgagcaactacatcttcaccgccatcttcgtggccgagatgatggtgaaggtggtggccctgggcctgctgagcggcgagcacgcctacctgcagagcagctggaacctgctggacggcctgctggtgctggtgagcctggtggacatcgtggtggccatggccagcgccggcggcgccaagatcctgggcgtgctgagagtgctgagactgctgagaaccctgagacccctgagagtgatcagcagagcccccggcctgaagctggtggtggagaccctgatcagcagcctgagacccatcggcaacatcgtgctgatctgctgcgccttcttcatcatcttcggcatcctgggcgtgcagctgttcaagggcaagttctactactgcgagggccccgacaccagaaacatcagcaccaaggcccagtgcagagccgcccactacagatgggtgagaagaaagtacaacttcgacaacctgggccaggccctgatgagcctgttcgtgctgagcagcaaggacggctgggtgaacatcatgtacgacggcctggacgccgtgggcgtggaccagcagcccgtgcagaaccacaacccctggatgctgctgtacttcatcagcttcctgctgatcgtgagcttcttcgtgctgaacatgttcgtgggcgtggtggtggagaacttccacaagtgcagacagcaccaggaggccgaggaggccagaagaagagaggagaagagactgagaagactggagagaagaagaagaagcaccttccccagccccgaggcccagagaagaccctactacgccgactacagccccaccagaagaagcatccacagcctgtgcaccagccactacctggacctgttcatcaccttcatcatctgcgtgaacgtgatcaccatgagcatggagcactacaaccagcccaagagcctggacgaggccctgaagtactgcaactacgtgttcaccatcgtgttcgtgttcgaggccgccctgaagctggtggccttcggcttcagaagattcttcaaggacagatggaaccagctggacctggccatcgtgctgctgagcctgatgggcatcaccctggaggagatcgagatgagcgccgccctgcccatcaaccccaccatcatcagaatcatgagagtgctgagaatcgccagagtgctgaagctgctgaagatggccaccggcatgagagccctgctggacaccgtggtgcaggccctgccccaggtgggcaacctgggcctgctgttcatgctgctgttcttcatctacgccgccctgggcgtggagctgttcggcagactggagtgcagcgaggacaacccctgcgagggcctgagcagacacgccaccttcagcaacttcggcatggccttcctgaccctgttcagagtgagcaccggcgacaactggaacggcatcatgaaggacaccctgagagagtgcagcagagaggacaagcactgcctgagctacctgcccgccctgagccccgtgtacttcgtgaccttcgtgctggtggcccagttcgtgctggtgaacgtggtggtggccgtgctgatgaagcacctggaggagagcaacaaggaggccagagaggacgccgagctggacgccgagatcgagctggagatggcccagggccccggcagcgccagaagagtggacgccgacagaccccccctgccccaggagagccccggcgccagagacgcccccaacctggtggccagaaaggtgagcgtgagcagaatgctgagcctgcccaacgacagctacatgttcagacccgtggtgcccgccagcgccccccaccccagacccctgcaggaggtggagatggagacctacggcgccggcacccccctgggcagcgtggccagcgtgcacagcccccccgccgagagctgcgccagcctgcagatccccctggccgtgagcagccccgccagaagcggcgagcccctgcacgccctgagccccagaggcaccgccagaagccccagcctgagcagactgctgtgcagacaggaggccgtgcacaccgacagcctggagggcaagatcgacagccccagagacaccctggaccccgccgagcccggcgagaagacccccgtgagacccgtgacccagggcggcagcctgcagagcccccccagaagccccagacccgccagcgtgagaaccagaaagcacaccttcggccagagatgcgtgagcagcagacccgccgcccccggcggcgaggaggccgaggccagcgaccccgccgacgaggaggtgagccacatcaccagcagcgcctgcccctggcagcccaccgccgagccccacggccccgaggccagccccgtggccggcggcgagagagacctgagaagactgtacagcgtggacgcccagggcttcctggacaagcccggcagagccgacgagcagtggagacccagcgccgagctgggcagcggcgagcccggcgaggccaaggcctggggccccgaggccgagcccgccctgggcgccagaagaaagaagaagatgagccccccctgcatcagcgtggagccccccgccgaggacgagggcagcgccagacccagcgccgccgagggcggcagcaccaccctgagaagaagaacccccagctgcgaggccaccccccacagagacagcctggagcccaccgagggcagcggcgccggcggcgaccccgccgccaagggcgagagatggggccaggccagctgcagagccgagcacctgaccgtgcccagcttcgccttcgagcccctggacctgggcgtgcccagcggcgaccccttcctggacggcagccacagcgtgacccccgagagcagagccagcagcagcggcgccatcgtgcccctggagccccccgagagcgagccccccatgcccgtgggcgacccccccgagaagagaagaggcctgtacctgaccgtgccccagtgccccctggagaagcccggcagccccagcgccacccccgcccccggcggcggcgccgacgaccccgtgtag

SEQ ID NO: 75074 - DNA, 7044 bp, Artificial Sequence
  Description of Artificial Sequence: Synthetic coding sequence
atgaccgagggcgccagagccgccgacgaggtgagagtgcccctgggcgcccccccccccggccccgccgccctggtgggcgccagccccgagagccccggcgcccccggcagagaggccgagagaggcagcgagctgggcgtgagccccagcgagagccccgccgccgagagaggcgccgagctgggcgccgacgaggagcagagagtgccctaccccgccctggccgccaccgtgttcttctgcctgggccagaccaccagacccagaagctggtgcctgagactggtgtgcaacccctggttcgagcacgtgagcatgctggtgatcatgctgaactgcgtgaccctgggcatgttcagaccctgcgaggacgtggagtgcggcagcgagagatgcaacatcctggaggccttcgacgccttcatcttcgccttcttcgccgtggagatggtgatcaagatggtggccctgggcctgttcggccagaagtgctacctgggcgacacctggaacagactggacttcttcatcgtggtggccggcatgatggagtacagcctggacggccacaacgtgagcctgagcgccatcagaaccgtgagagtgctgagacccctgagagccatcaacagagtgcccagcatgagaatcctggtgaccctgctgctggacaccctgcccatgctgggcaacgtgctgctgctgtgcttcttcgtgttcttcatcttcggcatcgtgggcgtgcagctgtgggccggcctgctgagaaacagatgcttcctggacagcgccttcgtgagaaacaacaacctgaccttcctgagaccctactaccagaccgaggagggcgaggagaaccccttcatctgcagcagcagaagagacaacggcatgcagaagtgcagccacatccccggcagaagagagctgagaatgccctgcaccctgggctgggaggcctacacccagccccaggccgagggcgtgggcgccgccagaaacgcctgcatcaactggaaccagtactacaacgtgtgcagaagcggcgacagcaacccccacaacggcgccatcaacttcgacaacatcggctacgcctggatcgccatcttccaggtgatcaccctggagggctgggtggacatcatgtactacgtgatggacgcccacagcttctacaacttcatctacttcatcctgctgatcatcgtgggcagcttcttcatgatcaacctgtgcctggtggtgatcgccacccagttcagcgagaccaagcagagagagagccagctgatgagagagcagagagccagacacctgagcaacgacagcaccctggccagcttcagcgagcccggcagctgctacgaggagctgctgaagtacgtgggccacatcttcagaaaggtgaagagaagaagcctgagactgtacgccagatggcagagcagatggagaaagaaggtggaccccagcgccgtgcagggccagggccccggccacagacagagaagagccggcagacacaccgccagcgtgcaccacctggtgtaccaccaccaccaccaccaccaccaccactaccacttcagccacggcagccccagaagacccggccccgagcccggcgcctgcgacaccagactggtgagagccggcgccccccccagcccccccagccccggcagaggcccccccgacgccgagagcgtgcacagcatctaccacgccgactgccacatcgagggcccccaggagagagccagagtggcccacgccgccgccaccgccgccgccagcctgagactggccaccggcctgggcaccatgaactaccccaccatcctgcccagcggcgtgggcagcggcaagggcagcaccagccccggccccaagggcaagtgggccggcggcccccccggcaccggcggccacggccccctgagcctgaacagccccgacccctacgagaagatcccccacgtggtgggcgagcacggcctgggccaggcccccggccacctgagcggcctgagcgtgccctgccccctgcccagcccccccgccggcaccctgacctgcgagctgaagagctgcccctactgcaccagagccctggaggaccccgagggcgagctgagcggcagcgagagcggcgacagcgacggcagaggcgtgtacgagttcacccaggacgtgagacacggcgacagatgggaccccaccagaccccccagagccaccgacacccccggccccggccccggcagcccccagagaagagcccagcagagagccgcccccggcgagcccggctggatgggcagactgtgggtgaccttcagcggcaagctgagaagaatcgtggacagcaagtacttcagcagaggcatcatgatggccatcctggtgaacaccctgagcatgggcgtggagtaccacgagcagcccgaggagctgaccaacgccctggagatcagcaacatcgtgttcaccagcatgttcgccctggagatgctgctgaagctgctggcctgcggccccctgggctacatcagaaacccctacaacatcttcgacggcatcatcgtggtgatcagcgtgtgggagatcgtgggccaggccgacggcggcctgagcgtgctgagaaccttcagactgctgagagtgctgaagctggtgagattcctgcccgccctgagaagacagctggtggtgctggtgaagaccatggacaacgtggccaccttctgcaccctgctgatgctgttcatcttcatcttcagcatcctgggcatgcacctgttcggctgcaagttcagcctgaagaccgacaccggcgacaccgtgcccgacagaaagaacttcgacagcctgctgtgggccatcgtgaccgtgttccagatcctgacccaggaggactggaacgtggtgctgtacaacggcatggccagcaccagcagctgggccgccctgtacttcgtggccctgatgaccttcggcaactacgtgctgttcaacctgctggtggccatcctggtggagggcttccaggccgagggcgacgccaacagaagcgacaccgacgaggacaagaccagcgtgcacttcgaggaggacttccacaagctgagagagctgcagaccaccgagctgaagatgtgcagcctggccgtgacccccaacggccacctggagggcagaggcagcctgagcccccccctgatcatgtgcaccgccgccacccccatgcccacccccaagagcagccccttcctggacgccgcccccagcctgcccgacagcagaagaggcagcagcagcagcggcgacccccccctgggcgaccagaagccccccgccagcctgagaagcagcccctgcgccccctggggccccagcggcgcctggagcagcagaagaagcagctggagcagcctgggcagagcccccagcctgaagagaagaggccagtgcggcgagagagagagcctgctgagcggcgagggcaagggcagcaccgacgacgaggccgaggacggcagagccgcccccggccccagagccacccccctgagaagagccgagagcctggaccccagacccctgagacccgccgccctgccccccaccaagtgcagagacagagacggccaggtggtggccctgcccagcgacttcttcctgagaatcgacagccacagagaggacgccgccgagctggacgacgacagcgaggacagctgctgcctgagactgcacaaggtgctggagccctacaagccccagtggtgcagaagcagagaggcctgggccctgtacctgttcagcccccagaacagattcagagtgagctgccagaaggtgatcacccacaagatgttcgaccacgtggtgctggtgttcatcttcctgaactgcgtgaccatcgccctggagagacccgacatcgaccccggcagcaccgagagagtgttcctgagcgtgagcaactacatcttcaccgccatcttcgtggccgagatgatggtgaaggtggtggccctgggcctgctgagcggcgagcacgcctacctgcagagcagctggaacctgctggacggcctgctggtgctggtgagcctggtggacatcgtggtggccatggccagcgccggcggcgccaagatcctgggcgtgctgagagtgctgagactgctgagaaccctgagacccctgagagtgatcagcagagcccccggcctgaagctggtggtggagaccctgatcagcagcctgagacccatcggcaacatcgtgctgatctgctgcgccttcttcatcatcttcggcatcctgggcgtgcagctgttcaagggcaagttctactactgcgagggccccgacaccagaaacatcagcaccaaggcccagtgcagagccgcccactacagatgggtgagaagaaagtacaacttcgacaacctgggccaggccctgatgagcctgttcgtgctgagcagcaaggacggctgggtgaacatcatgtacgacggcctggacgccgtgggcgtggaccagcagcccgtgcagaaccacaacccctggatgctgctgtacttcatcagcttcctgctgatcgtgagcttcttcgtgctgaacatgttcgtgggcgtggtggtggagaacttccacaagtgcagacagcaccaggaggccgaggaggccagaagaagagaggagaagagactgagaagactggagagaagaagaagaaaggcccagagaagaccctactacgccgactacagccccaccagaagaagcatccacagcctgtgcaccagccactacctggacctgttcatcaccttcatcatctgcgtgaacgtgatcaccatgagcatggagcactacaaccagcccaagagcctggacgaggccctgaagtactgcaactacgtgttcaccatcgtgttcgtgttcgaggccgccctgaagctggtggccttcggcttcagaagattcttcaaggacagatggaaccagctggacctggccatcgtgctgctgagcctgatgggcatcaccctggaggagatcgagatgagcgccgccctgcccatcaaccccaccatcatcagaatcatgagagtgctgagaatcgccagagtgctgaagctgctgaagatggccaccggcatgagagccctgctggacaccgtggtgcaggccctgccccaggtgggcaacctgggcctgctgttcatgctgctgttcttcatctacgccgccctgggcgtggagctgttcggcagactggagtgcagcgaggacaacccctgcgagggcctgagcagacacgccaccttcagcaacttcggcatggccttcctgaccctgttcagagtgagcaccggcgacaactggaacggcatcatgaaggacaccctgagagagtgcagcagagaggacaagcactgcctgagctacctgcccgccctgagccccgtgtacttcgtgaccttcgtgctggtggcccagttcgtgctggtgaacgtggtggtggccgtgctgatgaagcacctggaggagagcaacaaggaggccagagaggacgccgagctggacgccgagatcgagctggagatggcccagggccccggcagcgccagaagagtggacgccgacagaccccccctgccccaggagagccccggcgccagagacgcccccaacctggtggccagaaaggtgagcgtgagcagaatgctgagcctgcccaacgacagctacatgttcagacccgtggtgcccgccagcgccccccaccccagacccctgcaggaggtggagatggagacctacggcgccggcacccccctgggcagcgtggccagcgtgcacagcccccccgccgagagctgcgccagcctgcagatccccctggccgtgagcagccccgccagaagcggcgagcccctgcacgccctgagccccagaggcaccgccagaagccccagcctgagcagactgctgtgcagacaggaggccgtgcacaccgacagcctggagggcaagatcgacagccccagagacaccctggaccccgccgagcccggcgagaagacccccgtgagacccgtgacccagggcggcagcctgcagagcccccccagaagccccagacccgccagcgtgagaaccagaaagcacaccttcggccagagatgcgtgagcagcagacccgccgcccccggcggcgaggaggccgaggccagcgaccccgccgacgaggaggtgagccacatcaccagcagcgcctgcccctggcagcccaccgccgagccccacggccccgaggccagccccgtggccggcggcgagagagacctgagaagactgtacagcgtggacgcccagggcttcctggacaagcccggcagagccgacgagcagtggagacccagcgccgagctgggcagcggcgagcccggcgaggccaaggcctggggccccgaggccgagcccgccctgggcgccagaagaaagaagaagatgagccccccctgcatcagcgtggagccccccgccgaggacgagggcagcgccagacccagcgccgccgagggcggcagcaccaccctgagaagaagaacccccagctgcgaggccaccccccacagagacagcctggagcccaccgagggcagcggcgccggcggcgaccccgccgccaagggcgagagatggggccaggccagctgcagagccgagcacctgaccgtgcccagcttcgccttcgagcccctggacctgggcgtgcccagcggcgaccccttcctggacggcagccacagcgtgacccccgagagcagagccagcagcagcggcgccatcgtgcccctggagccccccgagagcgagccccccatgcccgtgggcgacccccccgagaagagaagaggcctgtacctgaccgtgccccagtgccccctggagaagcccggcagccccagcgccacccccgcccccggcggcggcgccgacgaccccgtgtag

SEQ ID NO: 75075 - DNA, 6690 bp, Artificial Sequence
  Description of Artificial Sequence: Synthetic coding sequence
atggccgagagcgccagcccccccagcagcagcgccgccgcccccgccgccgagcccggcgtgaccaccgagcagcccggccccagaagcccccccagcagcccccccggcctggaggagcccctggacggcgccgacccccacgtgccccaccccgacctggcccccatcgccttcttctgcctgagacagaccaccagccccagaaactggtgcatcaagatggccaccggcccctggtggtggtgcctgtgcatgctggtgatcctgctgaactgcgtgaccctgggcatgtaccagccctgcgacgacatggactgcctgagcgacagatgcaagatcctgcaggtgttcgacgacttcatcttcatcttcttcgccatggagatggtgctgaagatggtggccctgggcatcttcggcaagaagtgctacctgggcgacacctggaacagactggacttcttcatcgtgatggccggcatggtggagtacagcctggacctgcagaacatcaacctgagcgccatcagaaccgtgagagtgctgagacccctgaaggccatcaacagagtgcccagcatgagaatcctggtgaacctgctgctggacaccctgcccatgctgggcaacgtgctgctgctgtgcttcttcgtgttcttcatcttcggcatcatcggcgtgcagctgtgggccggcctgctgagaaacagatgcttcctggaggagaacttcaccatccagggcgacgtggccctgcccccctactaccagcccgaggaggacgacgagatgcccttcatctgcagcctgagcggcgacaacggcatcatgggctgccacgagatcccccccctgaaggagcagggcagagagtgctgcctgagcaaggacgacgtgtacgacttcggcgccggcagacaggacctgaacgccagcggcctgtgcgtgaactggaacagatactacaacgtgtgcagaaccggcagcgccaacccccacaagggcgccatcaacttcgacaacatcggctacgcctggatcgtgatcttccaggtgatcaccctggagggctgggtggagatcatgtactacgtgatggacgcccacagcttctacaacttcatctacttcatcctgctgatcatcgtgggcagcttcttcatgatcaacctgtgcctggtggtgatcgccacccagttcagcgagaccaagcagagagagcacagactgatgctggagcagagacagagatacctgagcagcagcaccgtggccagctacgccgagcccggcgactgctacgaggagatcttccagtacgtgtgccacatcctgagaaaggccaagagaagagccctgggcctgtaccaggccctgcagagcagaagacaggccctgggccccgaggcccccgcccccgccaagcccggcccccacgccaaggagcccagacactaccacggcaagaccaagggccagggcgacgagggcagacacctgggcagcagacactgccagaccctgcacggccccgccagccccggcaacgaccacagcggcagaggcaagcccggccccagagagctgtgcccccagcacagccccctggacgccaccccccacaccctggtgcagcccatccccgccaccctggccagcgaccccgccagctgcccctgctgccagcacgaggacggcagaagacccagcggcctgggcagcaccgacagcggccaggagggcagcggcagcggcagcagcgccggcggcgaggacgaggccgacggcgacggcgccagaagcagcgaggacggcgccagcagcgagctgggcaaggaggaggaggaggaggagcaggccgacggcgccgtgtggctgtgcggcgacgtgtggagagagaccagagccaagctgagaggcatcgtggacagcaagtacttcaacagaggcatcatgatggccatcctggtgaacaccgtgagcatgggcatcgagcaccacgagcaggccaacgagctgaccaacatcctggagatctgcaacgtggtgttcaccagcatgttcgccctggagatgatcctgaagctggccgccttcggcctgttcgactacctgagaaacccctacaacatcttcgacagcatcatcgtgatcatcagcatctgggagatcgtgggccaggccgacggcggcctgagcgtgctgagaaccttcagactgctgagagtgctgaagctggtgagattcatgcccgccctgagaagacagctggtggtgctgatgaagaccatggacaacgtggccaccttctgcatgctgctgatgctgttcatcttcatcttcagcatcctgggcatgcacatcttcggctgcaagttcagcctgagaaccgacaccggcgacaccgtgcccgacagaaagaacttcgacagcctgctgtgggccatcgtgaccgtgttccagatcctgacccaggaggactggaacgtggtgctgtacaacggcatggccagcaccagcccctgggccagcctgtacttcgtggccctgatgaccttcggcaactacgtgctgttcaacctgctggtggccatcctggtggagggcttccaggccgagggcgacgccaacagaagctacagcgacgaggaccagagcagcagcaacatcgaggagttcgacaagctgcaggagggcctggacagcagcggcgaccccaagctgtgccccatccccatgacccccaacggccacctggaccccagcctgcccctgggcggccacctgggccccgccggcgccgccggccccgcccccagactgagcctgcagcccgaccccatgctggtggccctgggcagcagaaagagcagcgtgatgagcctgggcagaatgagctacgaccagagaagcctgagcagcagcagaagcagctactacggcccctggggcagaagcgccgcctgggccagcagaagaagcagctggaacagcctgaagcacaagccccccagcgccgagcacgagagcctgctgagcgccgagagaggcggcggcgccagagtgtgcgaggtggccgccgacgagggcccccccagagccgcccccctgcacaccccccacgcccaccacatccaccacggcccccacctggcccacagacacagacaccacagaagaaccctgagcctggacaacagagacagcgtggacctggccgagctggtgcccgccgtgggcgcccaccccagagccgcctggagagccgccggccccgcccccggccacgaggactgcaacggcagaatgcccagcatcgccaaggacgtgttcaccaagatgggcgacagaggcgacagaggcgaggacgaggaggagatcgactacaccctgtgcttcagagtgagaaagatgatcgacgtgtacaagcccgactggtgcgaggtgagagaggactggagcgtgtacctgttcagccccgagaacagattcagagtgctgtgccagaccatcatcgcccacaagctgttcgactacgtggtgctggccttcatcttcctgaactgcatcaccatcgccctggagagaccccagatcgaggccggcagcaccgagagaatcttcctgaccgtgagcaactacatcttcaccgccatcttcgtgggcgagatgaccctgaaggtggtgagcctgggcctgtacttcggcgagcaggcctacctgagaagcagctggaacgtgctggacggcttcctggtgttcgtgagcatcatcgacatcgtggtgagcctggccagcgccggcggcgccaagatcctgggcgtgctgagagtgctgagactgctgagaaccctgagacccctgagagtgatcagcagagcccccggcctgaagctggtggtggagaccctgatcagcagcctgaagcccatcggcaacatcgtgctgatctgctgcgccttcttcatcatcttcggcatcctgggcgtgcagctgttcaagggcaagttctaccactgcctgggcgtggacaccagaaacatcaccaacagaagcgactgcatggccgccaactacagatgggtgcaccacaagtacaacttcgacaacctgggccaggccctgatgagcctgttcgtgctggccagcaaggacggctgggtgaacatcatgtacaacggcctggacgccgtggccgtggaccagcagcccgtgaccaaccacaacccctggatgctgctgtacttcatcagcttcctgctgatcgtgagcttcttcgtgctgaacatgttcgtgggcgtggtggtggagaacttccacaagtgcagacagcaccaggaggccgaggaggccagaagaagagaggagaagagactgagaagactggagaagaagagaagaaaggcccagagactgccctactacgccacctactgccacaccagactgctgatccacagcatgtgcaccagccactacctggacatcttcatcaccttcatcatctgcctgaacgtggtgaccatgagcctggagcactacaaccagcccaccagcctggagaccgccctgaagtactgcaactacatgttcaccaccgtgttcgtgctggaggccgtgctgaagctggtggccttcggcctgagaagattcttcaaggacagatggaaccagctggacctggccatcgtgctgctgagcgtgatgggcatcaccctggaggagatcgagatcaacgccgccctgcccatcaaccccaccatcatcagaatcatgagagtgctgagaatcgccagagtgctgaagctgctgaagatggccaccggcatgagagccctgctggacaccgtggtgcaggccctgccccaggtgggcaacctgggcctgctgttcatgctgctgttcttcatctacgccgccctgggcgtggagctgttcggcaagctggtgtgcaacgacgagaacccctgcgagggcatgagcagacacgccaccttcgagaacttcggcatggccttcctgaccctgttccaggtgagcaccggcgacaactggaacggcatcatgaaggacaccctgagagactgcacccacgacgagagaagctgcctgagcagcctgcagttcgtgagccccctgtacttcgtgagcttcgtgctgaccgcccagttcgtgctgatcaacgtggtggtggccgtgctgatgaagcacctggacgacagcaacaaggaggcccaggaggacgccgagatggacgccgagctggagctggagatggcccacggcctgggccccggccccagactgcccaccggcagccccggcgcccccggcagaggccccggcggcgccggcggcggcggcgacaccgagggcggcctgtgcagaagatgctacagccccgcccaggagaacctgtggctggacagcgtgagcctgatcatcaaggacagcctggagggcgagctgaccatcatcgacaacctgagcggcagcatcttccaccactacagcagccccgccggctgcaagaagtgccaccacgacaagcaggaggtgcagctggccgagaccgaggccttcagcctgaacagcgacagaagcagcagcatcctgctgggcgacgacctgagcctggaggaccccaccgcctgcccccccggcagaaaggacagcaagggcgagctggacccccccgagcccatgagagtgggcgacctgggcgagtgcttcttccccctgagcagcaccgccgtgagccccgaccccgagaacttcctgtgcgagatggaggagatccccttcaaccccgtgagaagctggctgaagcacgacagcagccaggccccccccagccccttcagccccgacgccagcagccccctgctgcccatgcccgccgagttcttccaccccgccgtgagcgccagccagaagggccccgagaagggcaccggcaccggcaccctgcccaagatcgccctgcagggcagctgggccagcctgagaagccccagagtgaactgcaccctgctgagacaggccaccggcagcgacaccagcctggacgccagccccagcagcagcgccggcagcctgcagaccaccctggaggacagcctgaccctgagcgacagccccagaagagccctgggcccccccgcccccgcccccggccccagagccggcctgagccccgccgccagaagaagactgagcctgagaggcagaggcctgttcagcctgagaggcctgagagcccaccagagaagccacagcagcggcggcagcaccagccccggctgcacccaccacgacagcatggaccccagcgacgaggagggcagaggcggcgccggcggcggcggcgccggcagcgagcacagcgagaccctgagcagcctgagcctgaccagcctgttctgcccccccccccccccccccgcccccggcctgacccccgccagaaagttcagcagcaccagcagcctggccgcccccggcagaccccacgccgccgccctggcccacggcctggccagaagccccagctgggccgccgacagaagcaaggacccccccggcagagcccccctgcccatgggcctgggccccctggccccccccccccagcccctgcccggcgagctggagcccggcgacgccgccagcaagagaaagagatag

SEQ ID NO: 75076 - DNA, 6567 bp, Artificial Sequence
  Description of Artificial Sequence: Synthetic coding sequence
atggccgagagcgccagcccccccagcagcagcgccgccgcccccgccgccgagcccggcgtgaccaccgagcagcccggccccagaagcccccccagcagcccccccggcctggaggagcccctggacggcgccgacccccacgtgccccaccccgacctggcccccatcgccttcttctgcctgagacagaccaccagccccagaaactggtgcatcaagatggccaccggcccctggtggtggtgcctgtgcatgctggtgatcctgctgaactgcgtgaccctgggcatgtaccagccctgcgacgacatggactgcctgagcgacagatgcaagatcctgcaggtgttcgacgacttcatcttcatcttcttcgccatggagatggtgctgaagatggtggccctgggcatcttcggcaagaagtgctacctgggcgacacctggaacagactggacttcttcatcgtgatggccggcatggtggagtacagcctggacctgcagaacatcaacctgagcgccatcagaaccgtgagagtgctgagacccctgaaggccatcaacagagtgcccagcatgagaatcctggtgaacctgctgctggacaccctgcccatgctgggcaacgtgctgctgctgtgcttcttcgtgttcttcatcttcggcatcatcggcgtgcagctgtgggccggcctgctgagaaacagatgcttcctggaggagaacttcaccatccagggcgacgtggccctgcccccctactaccagcccgaggaggacgacgagatgcccttcatctgcagcctgagcggcgacaacggcatcatgggctgccacgagatcccccccctgaaggagcagggcagagagtgctgcctgagcaaggacgacgtgtacgacttcggcgccggcagacaggacctgaacgccagcggcctgtgcgtgaactggaacagatactacaacgtgtgcagaaccggcagcgccaacccccacaagggcgccatcaacttcgacaacatcggctacgcctggatcgtgatcttccaggtgatcaccctggagggctgggtggagatcatgtactacgtgatggacgcccacagcttctacaacttcatctacttcatcctgctgatcatcgtgggcagcttcttcatgatcaacctgtgcctggtggtgatcgccacccagttcagcgagaccaagcagagagagcacagactgatgctggagcagagacagagatacctgagcagcagcaccgtggccagctacgccgagcccggcgactgctacgaggagatcttccagtacgtgtgccacatcctgagaaaggccaagagaagagccctgggcctgtaccaggccctgcagagcagaagacaggccctgggccccgaggcccccgcccccgccaagcccggcccccacgccaaggagcccagacactaccagctgtgcccccagcacagccccctggacgccaccccccacaccctggtgcagcccatccccgccaccctggccagcgaccccgccagctgcccctgctgccagcacgaggacggcagaagacccagcggcctgggcagcaccgacagcggccaggagggcagcggcagcggcagcagcgccggcggcgaggacgaggccgacggcgacggcgccagaagcagcgaggacggcgccagcagcgagctgggcaaggaggaggaggaggaggagcaggccgacggcgccgtgtggctgtgcggcgacgtgtggagagagaccagagccaagctgagaggcatcgtggacagcaagtacttcaacagaggcatcatgatggccatcctggtgaacaccgtgagcatgggcatcgagcaccacgagcaggccaccgagctgaccaacatcctggagatctgcaacgtggtgttcaccagcatgttcgccctggagatgatcctgaagctggccgccttcggcctgttcgactacctgagaaacccctacaacatcttcgacagcatcatcgtgatcatcagcatctgggagatcgtgggccaggccgacggcggcctgagcgtgctgagaaccttcagactgctgagagtgctgaagctggtgagattcatgcccgccctgagaagacagctggtggtgctgatgaagaccatggacaacgtggccaccttctgcatgctgctgatgctgttcatcttcatcttcagcatcctgggcatgcacatcttcggctgcaagttcagcctgagaaccgacaccggcgacaccgtgcccgacagaaagaacttcgacagcctgctgtgggccatcgtgaccgtgttccagatcctgacccaggaggactggaacgtggtgctgtacaacggcatggccagcaccagcccctgggccagcctgtacttcgtggccctgatgaccttcggcaactacgtgctgttcaacctgctggtggccatcctggtggagggcttccaggccgagggcgacgccaacagaagctacagcgacgaggaccagagcagcagcaacatcgaggagttcgacaagctgcaggagggcctggacagcagcggcgaccccaagctgtgccccatccccatgacccccaacggccacctggaccccagcctgcccctgggcggccacctgggccccgccggcgccgccggccccgcccccagactgagcctgcagcccgaccccatgctggtggccctgggcagcagaaagagcagcgtgatgagcctgggcagaatgagctacgaccagagaagcctgagcagcagcagaagcagctactacggcccctggggcagaagcgccgcctgggccagcagaagaagcagctggaacagcctgaagcacaagccccccagcgccgagcacgagagcctgctgagcgccgagagaggcggcggcgccagagtgtgcgaggtggccgccgacgagggcccccccagagccgcccccctgcacaccccccacgcccaccacatccaccacggcccccacctggcccacagacacagacaccacagaagaaccctgagcctggacaacagagacagcgtggacctggccgagctggtgcccgccgtgggcgcccaccccagagccgcctggagagccgccggccccgcccccggccacgaggactgcaacggcagaatgcccagcatcgccaaggacgtgttcaccaagatgggcgacagaggcgacagaggcgaggacgaggaggagatcgactacaccctgtgcttcagagtgagaaagatgatcgacgtgtacaagcccgactggtgcgaggtgagagaggactggagcgtgtacctgttcagccccgagaacagattcagagtgctgtgccagaccatcatcgcccacaagctgttcgactacgtggtgctggccttcatcttcctgaactgcatcaccatcgccctggagagaccccagatcgaggccggcagcaccgagagaatcttcctgaccgtgagcaactacatcttcaccgccatcttcgtgggcgagatgaccctgaaggtggtgagcctgggcctgtacttcggcgagcaggcctacctgagaagcagctggaacgtgctggacggcttcctggtgttcgtgagcatcatcgacatcgtggtgagcctggccagcgccggcggcgccaagatcctgggcgtgctgagagtgctgagactgctgagaaccctgagacccctgagagtgatcagcagagcccccggcctgaagctggtggtggagaccctgatcagcagcctgaagcccatcggcaacatcgtgctgatctgctgcgccttcttcatcatcttcggcatcctgggcgtgcagctgttcaagggcaagttctaccactgcctgggcgtggacaccagaaacatcaccaacagaagcgactgcatggccgccaactacagatgggtgcaccacaagtacaacttcgacaacctgggccaggccctgatgagcctgttcgtgctggccagcaaggacggctgggtgaacatcatgtacaacggcctggacgccgtggccgtggaccagcagcccgtgaccaaccacaacccctggatgctgctgtacttcatcagcttcctgctgatcgtgagcttcttcgtgctgaacatgttcgtgggcgtggtggtggagaacttccacaagtgcagacagcaccaggaggccgaggaggccagaagaagagaggagaagagactgagaagactggagaagaagagaagaaaggcccagagactgccctactacgccacctactgccacaccagactgctgatccacagcatgtgcaccagccactacctggacatcttcatcaccttcatcatctgcctgaacgtggtgaccatgagcctggagcactacaaccagcccaccagcctggagaccgccctgaagtactgcaactacatgttcaccaccgtgttcgtgctggaggccgtgctgaagctggtggccttcggcctgagaagattcttcaaggacagatggaaccagctggacctggccatcgtgctgctgagcgtgatgggcatcaccctggaggagatcgagatcaacgccgccctgcccatcaaccccaccatcatcagaatcatgagagtgctgagaatcgccagagtgctgaagctgctgaagatggccaccggcatgagagccctgctggacaccgtggtgcaggccctgccccaggtgggcaacctgggcctgctgttcatgctgctgttcttcatctacgccgccctgggcgtggagctgttcggcaagctggtgtgcaacgacgagaacccctgcgagggcatgagcagacacgccaccttcgagaacttcggcatggccttcctgaccctgttccaggtgagcaccggcgacaactggaacggcatcatgaaggacaccctgagagactgcacccacgacgagagaagctgcctgagcagcctgcagttcgtgagccccctgtacttcgtgagcttcgtgctgaccgcccagttcgtgctgatcaacgtggtggtggccgtgctgatgaagcacctggacgacagcaacaaggaggcccaggaggacgccgagatggacgccgagctggagctggagatggcccacggcctgggccccggccccagactgcccaccggcagccccggcgcccccggcagaggccccggcggcgccggcggcggcggcgacaccgagggcggcctgtgcagaagatgctacagccccgcccaggagaacctgtggctggacagcgtgagcctgatcatcaaggacagcctggagggcgagctgaccatcatcgacaacctgagcggcagcatcttccaccactacagcagccccgccggctgcaagaagtgccaccacgacaagcaggaggtgcagctggccgagaccgaggccttcagcctgaacagcgacagaagcagcagcatcctgctgggcgacgacctgagcctggaggaccccaccgcctgcccccccggcagaaaggacagcaagggcgagctggacccccccgagcccatgagagtgggcgacctgggcgagtgcttcttccccctgagcagcaccgccgtgagccccgaccccgagaacttcctgtgcgagatggaggagatccccttcaaccccgtgagaagctggctgaagcacgacagcagccaggccccccccagccccttcagccccgacgccagcagccccctgctgcccatgcccgccgagttcttccaccccgccgtgagcgccagccagaagggccccgagaagggcaccggcaccggcaccctgcccaagatcgccctgcagggcagctgggccagcctgagaagccccagagtgaactgcaccctgctgagacaggccaccggcagcgacaccagcctggacgccagccccagcagcagcgccggcagcctgcagaccaccctggaggacagcctgaccctgagcgacagccccagaagagccctgggcccccccgcccccgcccccggccccagagccggcctgagccccgccgccagaagaagactgagcctgagaggcagaggcctgttcagcctgagaggcctgagagcccaccagagaagccacagcagcggcggcagcaccagccccggctgcacccaccacgacagcatggaccccagcgacgaggagggcagaggcggcgccggcggcggcggcgccggcagcgagcacagcgagaccctgagcagcctgagcctgaccagcctgttctgcccccccccccccccccccgcccccggcctgacccccgccagaaagttcagcagcaccagcagcctggccgcccccggcagaccccacgccgccgccctggcccacggcctggccagaagccccagctgggccgccgacagaagcaaggacccccccggcagagcccccctgcccatgggcctgggccccctggccccccccccccagcccctgcccggcgagctggagcccggcgacgccgccagcaagagaaagagatag

SEQ ID NO: 75077 - DNA, 6051 bp, Artificial Sequence
  Description of Artificial Sequence: Synthetic coding sequence
atggccgagagcgccagcccccccagcagcagcgccgccgcccccgccgccgagcccggcgtgaccaccgagcagcccggccccagaagcccccccagcagcccccccggcctggaggagcccctggacggcgccgacccccacgtgccccaccccgacctggcccccatcgccttcttctgcctgagacagaccaccagccccagaaactggtgcatcaagatggtgtgcaacccctggttcgagtgcgtgagcatgctggtgatcctgctgaactgcgtgaccctgggcatgtaccagccctgcgacgacatggactgcctgagcgacagatgcaagatcctgcaggtgttcgacgacttcatcttcatcttcttcgccatggagatggtgctgaagatggtggccctgggcatcttcggcaagaagtgctacctgggcgacacctggaacagactggacttcttcatcgtgatggccggcatggtggagtacagcctggacctgcagaacatcaacctgagcgccatcagaaccgtgagagtgctgagacccctgaaggccatcaacagagtgcccagcatgagaatcctggtgaacctgctgctggacaccctgcccatgctgggcaacgtgctgctgctgtgcttcttcgtgttcttcatcttcggcatcatcggcgtgcagctgtgggccggcctgctgagaaacagatgcttcctggaggagaacttcaccatccagggcgacgtggccctgcccccctactaccagcccgaggaggacgacgagatgcccttcatctgcagcctgagcggcgacaacggcatcatgggctgccacgagatcccccccctgaaggagcagggcagagagtgctgcctgagcaaggacgacgtgtacgacttcggcgccggcagacaggacctgaacgccagcggcctgtgcgtgaactggaacagatactacaacgtgtgcagaaccggcagcgccaacccccacaagggcgccatcaacttcgacaacatcggctacgcctggatcgtgatcttccaggtgatcaccctggagggctgggtggagatcatgtactacgtgatggacgcccacagcttctacaacttcatctacttcatcctgctgatcatcgtgggcagcttcttcatgatcaacctgtgcctggtggtgatcgccacccagttcagcgagaccaagcagagagagcacagactgatgctggagcagagacagagatacctgagcagcagcaccgtggccagctacgccgagcccggcgactgctacgaggagatcttccagtacgtgtgccacatcctgagaaaggccaagagaagagccctgggcctgtaccaggccctgcagagcagaagacaggccctgggccccgaggcccccgcccccgccaagcccggcccccacgccaaggagcccagacactaccacggcaagaccaagggccagggcgacgagggcagacacctgggcagcagacactgccagaccctgcacggccccgccagccccggcaacgaccacagcggcagagagctgtgcccccagcacagccccctggacgccaccccccacaccctggtgcagcccatccccgccaccctggccagcgaccccgccagctgcccctgctgccagcacgaggacggcagaagacccagcggcctgggcagcaccgacagcggccaggagggcagcggcagcggcagcagcgccggcggcgaggacgaggccgacggcgacggcgccagaagcagcgaggacggcgccagcagcgagctgggcaaggaggaggaggaggaggagcaggccgacggcgccgtgtggctgtgcggcgacgtgtggagagagaccagagccaagctgagaggcatcgtggacagcaagtacttcaacagaggcatcatgatggccatcctggtgaacaccgtgagcatgggcatcgagcaccacgagcagcccgaggagctgaccaacatcctggagatctgcaacgtggtgttcaccagcatgttcgccctggagatgatcctgaagctggccgccttcggcctgttcgactacctgagaaacccctacaacatcttcgacagcatcatcgtgatcatcagcatctgggagatcgtgggccaggccgacggcggcctgagcgtgctgagaaccttcagactgctgagagtgctgaagctggtgagattcatgcccgccctgagaagacagctggtggtgctgatgaagaccatggacaacgtggccaccttctgcatgctgctgatgctgttcatcttcatcttcagcatcctgggcatgcacatcttcggctgcaagttcagcctgagaaccgacaccggcgacaccgtgcccgacagaaagaacttcgacagcctgctgtgggccatcgtgaccgtgttccagatcctgacccaggaggactggaacgtggtgctgtacaacggcatggccagcaccagcccctgggccagcctgtacttcgtggccctgatgaccttcggcaactacgtgctgttcaacctgctggtggccatcctggtggagggcttccaggccgagggcgacgccaacagaagctacagcgacgaggaccagagcagcagcaacatcgaggagttcgacaagctgcaggagggcctggacagcagcggcgaccccaagctgtgccccatccccatgacccccaacggccacctggaccccagcctgcccctgggcggccacctgggccccgccggcgccgccggccccgcccccagactgagcctgcagcccgaccccatgctggtggccctgggcagcagaaagagcagcgtgatgagcctgggcagaatgagctacgaccagagaagcctgagcagcagcagaagcagctactacggcccctggggcagaagcgccgcctgggccagcagaagaagcagctggaacagcctgaagcacaagccccccagcgccgagcacgagagcctgctgagcgccgagagaggcggcggcgccagagtgtgcgaggtggccgccgacgagggcccccccagagccgcccccctgcacaccccccacgcccaccacatccaccacggcccccacctggcccacagacacagacaccacagaagaaccctgagcctggacaacagagacagcgtggacctggccgagctggtgcccgccgtgggcgcccaccccagagccgcctggagagccgccggccccgcccccggccacgaggactgcaacggcagaatgcccagcatcgccaaggacgtgttcaccaagatgggcgacagaggcgacagaggcgaggacgaggaggagatcgactacaccctgtgcttcagagtgagaaagatgatcgacgtgtacaagcccgactggtgcgaggtgagagaggactggagcgtgtacctgttcagccccgagaacagattcagagtgctgtgccagaccatcatcgcccacaagctgttcgactacgtggtgctggccttcatcttcctgaactgcatcaccatcgccctggagagaccccagatcgaggccggcagcaccgagagaatcttcctgaccgtgagcaactacatcttcaccgccatcttcgtgggcgagatgaccctgaaggtggtgagcctgggcctgtacttcggcgagcaggcctacctgagaagcagctggaacgtgctggacggcttcctggtgttcgtgagcatcatcgacatcgtggtgagcctggccagcgccggcggcgccaagatcctgggcgtgctgagagtgctgagactgctgagaaccctgagacccctgagagtgatcagcagagcccccggcctgaagctggtggtggagaccctgatcagcagcctgaagcccatcggcaacatcgtgctgatctgctgcgccttcttcatcatcttcggcatcctgggcgtgcagctgttcaagggcaagttctaccactgcctgggcgtggacaccagaaacatcaccaacagaagcgactgcatggccgccaactacagatgggtgcaccacaagtacaacttcgacaacctgggccaggccctgatgagcctgttcgtgctggccagcaaggacggctgggtgaacatcatgtacaacggcctggacgccgtggccgtggaccagcagcccgtgaccaaccacaacccctggatgctgctgtacttcatcagcttcctgctgatcgtgagcttcttcgtgctgaacatgttcgtgggcgtggtggtggagaacttccacaagtgcagacagcaccaggaggccgaggaggccagaagaagagaggagaagagactgagaagactggagaagaagagaagaaaggcccagagactgccctactacgccacctactgccacaccagactgctgatccacagcatgtgcaccagccactacctggacatcttcatcaccttcatcatctgcctgaacgtggtgaccatgagcctggagcactacaaccagcccaccagcctggagaccgccctgaagtactgcaactacatgttcaccaccgtgttcgtgctggaggccgtgctgaagctggtggccttcggcctgagaagattcttcaaggacagatggaaccagctggacctggccatcgtgctgctgagcgtgatgggcatcaccctggaggagatcgagatcaacgccgccctgcccatcaaccccaccatcatcagaatcatgagagtgctgagaatcgccagagtgctgaagctgctgaagatggccaccggcatgagagccctgctggacaccgtggtgcaggccctgccccaggtgggcaacctgggcctgctgttcatgctgctgttcttcatctacgccgccctgggcgtggagctgttcggcaagctggtgtgcaacgacgagaacccctgcgagggcatgagcagacacgccaccttcgagaacttcggcatggccttcctgaccctgttccaggtgagcaccggcgacaactggaacggcatcatgaaggacaccctgagagactgcacccacgacgagagaagctgcctgagcagcctgcagttcgtgagccccctgtacttcgtgagcttcgtgctgaccgcccagttcgtgctgatcaacgtggtggtggccgtgctgatgaagcacctggacgacagcaacaaggaggcccaggaggacgccgagatggacgccgagctggagctggagatggcccacggcctgggccccggccccagactgcccaccggcagccccggcgcccccggcagaggccccggcggcgccggcggcggcggcgacaccgagggcggcctgtgcagaagatgctacagccccgcccaggagaacctgtggctggacagcgtgagcctgatcatcaaggacagcctggagggcgagctgaccatcatcgacaacctgagcggcagcatcttccaccactacagcagccccgccggctgcaagaagtgccaccacgacaagcaggaggtgcagctggccgagaccgaggccttcagcctgaacagcgacagaagcagcagcatcctgctgggcgacgacctgagcctggaggaccccaccgcctgcccccccggcagaaaggacagcaagggcgagctggacccccccgagcccatgagagtgggcgacctgggcgagtgcttcttccccctgagcagcaccgccgtgagccccgaccccgagaacttcctgtgcgagatggaggagatccccttcaaccccgtgagaagctggctgaagcacgacagcagccaggccccccccagccccttcagccccgacgccagcagccccctgctgcccatgcccgccgagttcttccaccccgccgtgagcgccagccagaagggccccgagaagggcaccggcaccggcaccctgcccaagatcgccctgcagggcagctgggccagcctgagaagccccagagtgaactgcaccctgctgagacaggtgcccaccccccccagaccctag

SEQ ID NO: 75078 - DNA, 6672 bp, Artificial Sequence
  Description of Artificial Sequence: Synthetic coding sequence
atggccgagagcgccagcccccccagcagcagcgccgccgcccccgccgccgagcccggcgtgaccaccgagcagcccggccccagaagcccccccagcagcccccccggcctggaggagcccctggacggcgccgacccccacgtgccccaccccgacctggcccccatcgccttcttctgcctgagacagaccaccagccccagaaactggtgcatcaagatggtgtgcaacccctggttcgagtgcgtgagcatgctggtgatcctgctgaactgcgtgaccctgggcatgtaccagccctgcgacgacatggactgcctgagcgacagatgcaagatcctgcaggtgttcgacgacttcatcttcatcttcttcgccatggagatggtgctgaagatggtggccctgggcatcttcggcaagaagtgctacctgggcgacacctggaacagactggacttcttcatcgtgatggccggcatggtggagtacagcctggacctgcagaacatcaacctgagcgccatcagaaccgtgagagtgctgagacccctgaaggccatcaacagagtgcccagcatgagaatcctggtgaacctgctgctggacaccctgcccatgctgggcaacgtgctgctgctgtgcttcttcgtgttcttcatcttcggcatcatcggcgtgcagctgtgggccggcctgctgagaaacagatgcttcctggaggagaacttcaccatccagggcgacgtggccctgcccccctactaccagcccgaggaggacgacgagatgcccttcatctgcagcctgagcggcgacaacggcatcatgggctgccacgagatcccccccctgaaggagcagggcagagagtgctgcctgagcaaggacgacgtgtacgacttcggcgccggcagacaggacctgaacgccagcggcctgtgcgtgaactggaacagatactacaacgtgtgcagaaccggcagcgccaacccccacaagggcgccatcaacttcgacaacatcggctacgcctggatcgtgatcttccaggtgatcaccctggagggctgggtggagatcatgtactacgtgatggacgcccacagcttctacaacttcatctacttcatcctgctgatcatcgtgggcagcttcttcatgatcaacctgtgcctggtggtgatcgccacccagttcagcgagaccaagcagagagagcacagactgatgctggagcagagacagagatacctgagcagcagcaccgtggccagctacgccgagcccggcgactgctacgaggagatcttccagtacgtgtgccacatcctgagaaaggccaagagaagagccctgggcctgtaccaggccctgcagagcagaagacaggccctgggccccgaggcccccgcccccgccaagcccggcccccacgccaaggagcccagacactaccacggcaagaccaagggccagggcgacgagggcagacacctgggcagcagacactgccagaccctgcacggccccgccagccccggcaacgaccacagcggcagagagctgtgcccccagcacagccccctggacgccaccccccacaccctggtgcagcccatccccgccaccctggccagcgaccccgccagctgcccctgctgccagcacgaggacggcagaagacccagcggcctgggcagcaccgacagcggccaggagggcagcggcagcggcagcagcgccggcggcgaggacgaggccgacggcgacggcgccagaagcagcgaggacggcgccagcagcgagctgggcaaggaggaggaggaggaggagcaggccgacggcgccgtgtggctgtgcggcgacgtgtggagagagaccagagccaagctgagaggcatcgtggacagcaagtacttcaacagaggcatcatgatggccatcctggtgaacaccgtgagcatgggcatcgagcaccacgagcagcccgaggagctgaccaacatcctggagatctgcaacgtggtgttcaccagcatgttcgccctggagatgatcctgaagctggccgccttcggcctgttcgactacctgagaaacccctacaacatcttcgacagcatcatcgtgatcatcagcatctgggagatcgtgggccaggccgacggcggcctgagcgtgctgagaaccttcagactgctgagagtgctgaagctggtgagattcatgcccgccctgagaagacagctggtggtgctgatgaagaccatggacaacgtggccaccttctgcatgctgctgatgctgttcatcttcatcttcagcatcctgggcatgcacatcttcggctgcaagttcagcctgagaaccgacaccggcgacaccgtgcccgacagaaagaacttcgacagcctgctgtgggccatcgtgaccgtgttccagatcctgacccaggaggactggaacgtggtgctgtacaacggcatggccagcaccagcccctgggccagcctgtacttcgtggccctgatgaccttcggcaactacgtgctgttcaacctgctggtggccatcctggtggagggcttccaggccgagggcgacgccaacagaagctacagcgacgaggaccagagcagcagcaacatcgaggagttcgacaagctgcaggagggcctggacagcagcggcgaccccaagctgtgccccatccccatgacccccaacggccacctggaccccagcctgcccctgggcggccacctgggccccgccggcgccgccggccccgcccccagactgagcctgcagcccgaccccatgctggtggccctgggcagcagaaagagcagcgtgatgagcctgggcagaatgagctacgaccagagaagcctgagcagcagcagaagcagctactacggcccctggggcagaagcgccgcctgggccagcagaagaagcagctggaacagcctgaagcacaagccccccagcgccgagcacgagagcctgctgagcgccgagagaggcggcggcgccagagtgtgcgaggtggccgccgacgagggcccccccagagccgcccccctgcacaccccccacgcccaccacatccaccacggcccccacctggcccacagacacagacaccacagaagaaccctgagcctggacaacagagacagcgtggacctggccgagctggtgcccgccgtgggcgcccaccccagagccgcctggagagccgccggccccgcccccggccacgaggactgcaacggcagaatgcccagcatcgccaaggacgtgttcaccaagatgggcgacagaggcgacagaggcgaggacgaggaggagatcgactacaccctgtgcttcagagtgagaaagatgatcgacgtgtacaagcccgactggtgcgaggtgagagaggactggagcgtgtacctgttcagccccgagaacagattcagagtgctgtgccagaccatcatcgcccacaagctgttcgactacgtggtgctggccttcatcttcctgaactgcatcaccatcgccctggagagaccccagatcgaggccggcagcaccgagagaatcttcctgaccgtgagcaactacatcttcaccgccatcttcgtgggcgagatgaccctgaaggtggtgagcctgggcctgtacttcggcgagcaggcctacctgagaagcagctggaacgtgctggacggcttcctggtgttcgtgagcatcatcgacatcgtggtgagcctggccagcgccggcggcgccaagatcctgggcgtgctgagagtgctgagactgctgagaaccctgagacccctgagagtgatcagcagagcccccggcctgaagctggtggtggagaccctgatcagcagcctgaagcccatcggcaacatcgtgctgatctgctgcgccttcttcatcatcttcggcatcctgggcgtgcagctgttcaagggcaagttctaccactgcctgggcgtggacaccagaaacatcaccaacagaagcgactgcatggccgccaactacagatgggtgcaccacaagtacaacttcgacaacctgggccaggccctgatgagcctgttcgtgctggccagcaaggacggctgggtgaacatcatgtacaacggcctggacgccgtggccgtggaccagcagcccgtgaccaaccacaacccctggatgctgctgtacttcatcagcttcctgctgatcgtgagcttcttcgtgctgaacatgttcgtgggcgtggtggtggagaacttccacaagtgcagacagcaccaggaggccgaggaggccagaagaagagaggagaagagactgagaagactggagaagaagagaagaaaggcccagagactgccctactacgccacctactgccacaccagactgctgatccacagcatgtgcaccagccactacctggacatcttcatcaccttcatcatctgcctgaacgtggtgaccatgagcctggagcactacaaccagcccaccagcctggagaccgccctgaagtactgcaactacatgttcaccaccgtgttcgtgctggaggccgtgctgaagctggtggccttcggcctgagaagattcttcaaggacagatggaaccagctggacctggccatcgtgctgctgagcgtgatgggcatcaccctggaggagatcgagatcaacgccgccctgcccatcaaccccaccatcatcagaatcatgagagtgctgagaatcgccagagtgctgaagctgctgaagatggccaccggcatgagagccctgctggacaccgtggtgcaggccctgccccaggtgggcaacctgggcctgctgttcatgctgctgttcttcatctacgccgccctgggcgtggagctgttcggcaagctggtgtgcaacgacgagaacccctgcgagggcatgagcagacacgccaccttcgagaacttcggcatggccttcctgaccctgttccaggtgagcaccggcgacaactggaacggcatcatgaaggacaccctgagagactgcacccacgacgagagaagctgcctgagcagcctgcagttcgtgagccccctgtacttcgtgagcttcgtgctgaccgcccagttcgtgctgatcaacgtggtggtggccgtgctgatgaagcacctggacgacagcaacaaggaggcccaggaggacgccgagatggacgccgagctggagctggagatggcccacggcctgggccccggccccagactgcccaccggcagccccggcgcccccggcagaggccccggcggcgccggcggcggcggcgacaccgagggcggcctgtgcagaagatgctacagccccgcccaggagaacctgtggctggacagcgtgagcctgatcatcaaggacagcctggagggcgagctgaccatcatcgacaacctgagcggcagcatcttccaccactacagcagccccgccggctgcaagaagtgccaccacgacaagcaggaggtgcagctggccgagaccgaggccttcagcctgaacagcgacagaagcagcagcatcctgctgggcgacgacctgagcctggaggaccccaccgcctgcccccccggcagaaaggacagcaagggcgagctggacccccccgagcccatgagagtgggcgacctgggcgagtgcttcttccccctgagcagcaccgccgtgagccccgaccccgagaacttcctgtgcgagatggaggagatccccttcaaccccgtgagaagctggctgaagcacgacagcagccaggccccccccagccccttcagccccgacgccagcagccccctgctgcccatgcccgccgagttcttccaccccgccgtgagcgccagccagaagggccccgagaagggcaccggcaccggcaccctgcccaagatcgccctgcagggcagctgggccagcctgagaagccccagagtgaactgcaccctgctgagacaggccaccggcagcgacaccagcctggacgccagccccagcagcagcgccggcagcctgcagaccaccctggaggacagcctgaccctgagcgacagccccagaagagccctgggcccccccgcccccgcccccggccccagagccggcctgagccccgccgccagaagaagactgagcctgagaggcagaggcctgttcagcctgagaggcctgagagcccaccagagaagccacagcagcggcggcagcaccagccccggctgcacccaccacgacagcatggaccccagcgacgaggagggcagaggcggcgccggcggcggcggcgccggcagcgagcacagcgagaccctgagcagcctgagcctgaccagcctgttctgcccccccccccccccccccgcccccggcctgacccccgccagaaagttcagcagcaccagcagcctggccgcccccggcagaccccacgccgccgccctggcccacggcctggccagaagccccagctgggccgccgacagaagcaaggacccccccggcagagcccccctgcccatgggcctgggccccctggccccccccccccagcccctgcccggcgagctggagcccggcgacgccgccagcaagagaaagagatag

SEQ ID NO: 75079 - DNA, 6567 bp, Artificial Sequence
  Description of Artificial Sequence: Synthetic coding sequence
atggccgagagcgccagcccccccagcagcagcgccgccgcccccgccgccgagcccggcgtgaccaccgagcagcccggccccagaagcccccccagcagcccccccggcctggaggagcccctggacggcgccgacccccacgtgccccaccccgacctggcccccatcgccttcttctgcctgagacagaccaccagccccagaaactggtgcatcaagatggtgtgcaacccctggttcgagtgcgtgagcatgctggtgatcctgctgaactgcgtgaccctgggcatgtaccagccctgcgacgacatggactgcctgagcgacagatgcaagatcctgcaggtgttcgacgacttcatcttcatcttcttcgccatggagatggtgctgaagatggtggccctgggcatcttcggcaagaagtgctacctgggcgacacctggaacagactggacttcttcatcgtgatggccggcatggtggagtacagcctggacctgcagaacatcaacctgagcgccatcagaaccgtgagagtgctgagacccctgaaggccatcaacagagtgcccagcatgagaatcctggtgaacctgctgctggacaccctgcccatgctgggcaacgtgctgctgctgtgcttcttcgtgttcttcatcttcggcatcatcggcgtgcagctgtgggccggcctgctgagaaacagatgcttcctggaggagaacttcaccatccagggcgacgtggccctgcccccctactaccagcccgaggaggacgacgagatgcccttcatctgcagcctgagcggcgacaacggcatcatgggctgccacgagatcccccccctgaaggagcagggcagagagtgctgcctgagcaaggacgacgtgtacgacttcggcgccggcagacaggacctgaacgccagcggcctgtgcgtgaactggaacagatactacaacgtgtgcagaaccggcagcgccaacccccacaagggcgccatcaacttcgacaacatcggctacgcctggatcgtgatcttccaggtgatcaccctggagggctgggtggagatcatgtactacgtgatggacgcccacagcttctacaacttcatctacttcatcctgctgatcatcgtgggcagcttcttcatgatcaacctgtgcctggtggtgatcgccacccagttcagcgagaccaagcagagagagcacagactgatgctggagcagagacagagatacctgagcagcagcaccgtggccagctacgccgagcccggcgactgctacgaggagatcttccagtacgtgtgccacatcctgagaaaggccaagagaagagccctgggcctgtaccaggccctgcagagcagaagacaggccctgggccccgaggcccccgcccccgccaagcccggcccccacgccaaggagcccagacactaccagctgtgcccccagcacagccccctggacgccaccccccacaccctggtgcagcccatccccgccaccctggccagcgaccccgccagctgcccctgctgccagcacgaggacggcagaagacccagcggcctgggcagcaccgacagcggccaggagggcagcggcagcggcagcagcgccggcggcgaggacgaggccgacggcgacggcgccagaagcagcgaggacggcgccagcagcgagctgggcaaggaggaggaggaggaggagcaggccgacggcgccgtgtggctgtgcggcgacgtgtggagagagaccagagccaagctgagaggcatcgtggacagcaagtacttcaacagaggcatcatgatggccatcctggtgaacaccgtgagcatgggcatcgagcaccacgagcagcccgaggagctgaccaacatcctggagatctgcaacgtggtgttcaccagcatgttcgccctggagatgatcctgaagctggccgccttcggcctgttcgactacctgagaaacccctacaacatcttcgacagcatcatcgtgatcatcagcatctgggagatcgtgggccaggccgacggcggcctgagcgtgctgagaaccttcagactgctgagagtgctgaagctggtgagattcatgcccgccctgagaagacagctggtggtgctgatgaagaccatggacaacgtggccaccttctgcatgctgctgatgctgttcatcttcatcttcagcatcctgggcatgcacatcttcggctgcaagttcagcctgagaaccgacaccggcgacaccgtgcccgacagaaagaacttcgacagcctgctgtgggccatcgtgaccgtgttccagatcctgacccaggaggactggaacgtggtgctgtacaacggcatggccagcaccagcccctgggccagcctgtacttcgtggccctgatgaccttcggcaactacgtgctgttcaacctgctggtggccatcctggtggagggcttccaggccgagggcgacgccaacagaagctacagcgacgaggaccagagcagcagcaacatcgaggagttcgacaagctgcaggagggcctggacagcagcggcgaccccaagctgtgccccatccccatgacccccaacggccacctggaccccagcctgcccctgggcggccacctgggccccgccggcgccgccggccccgcccccagactgagcctgcagcccgaccccatgctggtggccctgggcagcagaaagagcagcgtgatgagcctgggcagaatgagctacgaccagagaagcctgagcagcagcagaagcagctactacggcccctggggcagaagcgccgcctgggccagcagaagaagcagctggaacagcctgaagcacaagccccccagcgccgagcacgagagcctgctgagcgccgagagaggcggcggcgccagagtgtgcgaggtggccgccgacgagggcccccccagagccgcccccctgcacaccccccacgcccaccacatccaccacggcccccacctggcccacagacacagacaccacagaagaaccctgagcctggacaacagagacagcgtggacctggccgagctggtgcccgccgtgggcgcccaccccagagccgcctggagagccgccggccccgcccccggccacgaggactgcaacggcagaatgcccagcatcgccaaggacgtgttcaccaagatgggcgacagaggcgacagaggcgaggacgaggaggagatcgactacaccctgtgcttcagagtgagaaagatgatcgacgtgtacaagcccgactggtgcgaggtgagagaggactggagcgtgtacctgttcagccccgagaacagattcagagtgctgtgccagaccatcatcgcccacaagctgttcgactacgtggtgctggccttcatcttcctgaactgcatcaccatcgccctggagagaccccagatcgaggccggcagcaccgagagaatcttcctgaccgtgagcaactacatcttcaccgccatcttcgtgggcgagatgaccctgaaggtggtgagcctgggcctgtacttcggcgagcaggcctacctgagaagcagctggaacgtgctggacggcttcctggtgttcgtgagcatcatcgacatcgtggtgagcctggccagcgccggcggcgccaagatcctgggcgtgctgagagtgctgagactgctgagaaccctgagacccctgagagtgatcagcagagcccccggcctgaagctggtggtggagaccctgatcagcagcctgaagcccatcggcaacatcgtgctgatctgctgcgccttcttcatcatcttcggcatcctgggcgtgcagctgttcaagggcaagttctaccactgcctgggcgtggacaccagaaacatcaccaacagaagcgactgcatggccgccaactacagatgggtgcaccacaagtacaacttcgacaacctgggccaggccctgatgagcctgttcgtgctggccagcaaggacggctgggtgaacatcatgtacaacggcctggacgccgtggccgtggaccagcagcccgtgaccaaccacaacccctggatgctgctgtacttcatcagcttcctgctgatcgtgagcttcttcgtgctgaacatgttcgtgggcgtggtggtggagaacttccacaagtgcagacagcaccaggaggccgaggaggccagaagaagagaggagaagagactgagaagactggagaagaagagaagaaaggcccagagactgccctactacgccacctactgccacaccagactgctgatccacagcatgtgcaccagccactacctggacatcttcatcaccttcatcatctgcctgaacgtggtgaccatgagcctggagcactacaaccagcccaccagcctggagaccgccctgaagtactgcaactacatgttcaccaccgtgttcgtgctggaggccgtgctgaagctggtggccttcggcctgagaagattcttcaaggacagatggaaccagctggacctggccatcgtgctgctgagcgtgatgggcatcaccctggaggagatcgagatcaacgccgccctgcccatcaaccccaccatcatcagaatcatgagagtgctgagaatcgccagagtgctgaagctgctgaagatggccaccggcatgagagccctgctggacaccgtggtgcaggccctgccccaggtgggcaacctgggcctgctgttcatgctgctgttcttcatctacgccgccctgggcgtggagctgttcggcaagctggtgtgcaacgacgagaacccctgcgagggcatgagcagacacgccaccttcgagaacttcggcatggccttcctgaccctgttccaggtgagcaccggcgacaactggaacggcatcatgaaggacaccctgagagactgcacccacgacgagagaagctgcctgagcagcctgcagttcgtgagccccctgtacttcgtgagcttcgtgctgaccgcccagttcgtgctgatcaacgtggtggtggccgtgctgatgaagcacctggacgacagcaacaaggaggcccaggaggacgccgagatggacgccgagctggagctggagatggcccacggcctgggccccggccccagactgcccaccggcagccccggcgcccccggcagaggccccggcggcgccggcggcggcggcgacaccgagggcggcctgtgcagaagatgctacagccccgcccaggagaacctgtggctggacagcgtgagcctgatcatcaaggacagcctggagggcgagctgaccatcatcgacaacctgagcggcagcatcttccaccactacagcagccccgccggctgcaagaagtgccaccacgacaagcaggaggtgcagctggccgagaccgaggccttcagcctgaacagcgacagaagcagcagcatcctgctgggcgacgacctgagcctggaggaccccaccgcctgcccccccggcagaaaggacagcaagggcgagctggacccccccgagcccatgagagtgggcgacctgggcgagtgcttcttccccctgagcagcaccgccgtgagccccgaccccgagaacttcctgtgcgagatggaggagatccccttcaaccccgtgagaagctggctgaagcacgacagcagccaggccccccccagccccttcagccccgacgccagcagccccctgctgcccatgcccgccgagttcttccaccccgccgtgagcgccagccagaagggccccgagaagggcaccggcaccggcaccctgcccaagatcgccctgcagggcagctgggccagcctgagaagccccagagtgaactgcaccctgctgagacaggccaccggcagcgacaccagcctggacgccagccccagcagcagcgccggcagcctgcagaccaccctggaggacagcctgaccctgagcgacagccccagaagagccctgggcccccccgcccccgcccccggccccagagccggcctgagccccgccgccagaagaagactgagcctgagaggcagaggcctgttcagcctgagaggcctgagagcccaccagagaagccacagcagcggcggcagcaccagccccggctgcacccaccacgacagcatggaccccagcgacgaggagggcagaggcggcgccggcggcggcggcgccggcagcgagcacagcgagaccctgagcagcctgagcctgaccagcctgttctgcccccccccccccccccccgcccccggcctgacccccgccagaaagttcagcagcaccagcagcctggccgcccccggcagaccccacgccgccgccctggcccacggcctggccagaagccccagctgggccgccgacagaagcaaggacccccccggcagagcccccctgcccatgggcctgggccccctggccccccccccccagcccctgcccggcgagctggagcccggcgacgccgccagcaagagaaagagatag

SEQ ID NO: 75080 - DNA, 5946 bp, Artificial Sequence
  Description of Artificial Sequence: Synthetic coding sequence
atggccgagagcgccagcccccccagcagcagcgccgccgcccccgccgccgagcccggcgtgaccaccgagcagcccggccccagaagcccccccagcagcccccccggcctggaggagcccctggacggcgccgacccccacgtgccccaccccgacctggcccccatcgccttcttctgcctgagacagaccaccagccccagaaactggtgcatcaagatggtgtgcaacccctggttcgagtgcgtgagcatgctggtgatcctgctgaactgcgtgaccctgggcatgtaccagccctgcgacgacatggactgcctgagcgacagatgcaagatcctgcaggtgttcgacgacttcatcttcatcttcttcgccatggagatggtgctgaagatggtggccctgggcatcttcggcaagaagtgctacctgggcgacacctggaacagactggacttcttcatcgtgatggccggcatggtggagtacagcctggacctgcagaacatcaacctgagcgccatcagaaccgtgagagtgctgagacccctgaaggccatcaacagagtgcccagcatgagaatcctggtgaacctgctgctggacaccctgcccatgctgggcaacgtgctgctgctgtgcttcttcgtgttcttcatcttcggcatcatcggcgtgcagctgtgggccggcctgctgagaaacagatgcttcctggaggagaacttcaccatccagggcgacgtggccctgcccccctactaccagcccgaggaggacgacgagatgcccttcatctgcagcctgagcggcgacaacggcatcatgggctgccacgagatcccccccctgaaggagcagggcagagagtgctgcctgagcaaggacgacgtgtacgacttcggcgccggcagacaggacctgaacgccagcggcctgtgcgtgaactggaacagatactacaacgtgtgcagaaccggcagcgccaacccccacaagggcgccatcaacttcgacaacatcggctacgcctggatcgtgatcttccaggtgatcaccctggagggctgggtggagatcatgtactacgtgatggacgcccacagcttctacaacttcatctacttcatcctgctgatcatcgtgggcagcttcttcatgatcaacctgtgcctggtggtgatcgccacccagttcagcgagaccaagcagagagagcacagactgatgctggagcagagacagagatacctgagcagcagcaccgtggccagctacgccgagcccggcgactgctacgaggagatcttccagtacgtgtgccacatcctgagaaaggccaagagaagagccctgggcctgtaccaggccctgcagagcagaagacaggccctgggccccgaggcccccgcccccgccaagcccggcccccacgccaaggagcccagacactaccagctgtgcccccagcacagccccctggacgccaccccccacaccctggtgcagcccatccccgccaccctggccagcgaccccgccagctgcccctgctgccagcacgaggacggcagaagacccagcggcctgggcagcaccgacagcggccaggagggcagcggcagcggcagcagcgccggcggcgaggacgaggccgacggcgacggcgccagaagcagcgaggacggcgccagcagcgagctgggcaaggaggaggaggaggaggagcaggccgacggcgccgtgtggctgtgcggcgacgtgtggagagagaccagagccaagctgagaggcatcgtggacagcaagtacttcaacagaggcatcatgatggccatcctggtgaacaccgtgagcatgggcatcgagcaccacgagcagcccgaggagctgaccaacatcctggagatctgcaacgtggtgttcaccagcatgttcgccctggagatgatcctgaagctggccgccttcggcctgttcgactacctgagaaacccctacaacatcttcgacagcatcatcgtgatcatcagcatctgggagatcgtgggccaggccgacggcggcctgagcgtgctgagaaccttcagactgctgagagtgctgaagctggtgagattcatgcccgccctgagaagacagctggtggtgctgatgaagaccatggacaacgtggccaccttctgcatgctgctgatgctgttcatcttcatcttcagcatcctgggcatgcacatcttcggctgcaagttcagcctgagaaccgacaccggcgacaccgtgcccgacagaaagaacttcgacagcctgctgtgggccatcgtgaccgtgttccagatcctgacccaggaggactggaacgtggtgctgtacaacggcatggccagcaccagcccctgggccagcctgtacttcgtggccctgatgaccttcggcaactacgtgctgttcaacctgctggtggccatcctggtggagggcttccaggccgagggcgacgccaacagaagctacagcgacgaggaccagagcagcagcaacatcgaggagttcgacaagctgcaggagggcctggacagcagcggcgaccccaagctgtgccccatccccatgacccccaacggccacctggaccccagcctgcccctgggcggccacctgggccccgccggcgccgccggccccgcccccagactgagcctgcagcccgaccccatgctggtggccctgggcagcagaaagagcagcgtgatgagcctgggcagaatgagctacgaccagagaagcctgagcagcagcagaagcagctactacggcccctggggcagaagcgccgcctgggccagcagaagaagcagctggaacagcctgaagcacaagccccccagcgccgagcacgagagcctgctgagcgccgagagaggcggcggcgccagagtgtgcgaggtggccgccgacgagggcccccccagagccgcccccctgcacaccccccacgcccaccacatccaccacggcccccacctggcccacagacacagacaccacagaagaaccctgagcctggacaacagagacagcgtggacctggccgagctggtgcccgccgtgggcgcccaccccagagccgcctggagagccgccggccccgcccccggccacgaggactgcaacggcagaatgcccagcatcgccaaggacgtgttcaccaagatgggcgacagaggcgacagaggcgaggacgaggaggagatcgactacaccctgtgcttcagagtgagaaagatgatcgacgtgtacaagcccgactggtgcgaggtgagagaggactggagcgtgtacctgttcagccccgagaacagattcagagtgctgtgccagaccatcatcgcccacaagctgttcgactacgtggtgctggccttcatcttcctgaactgcatcaccatcgccctggagagaccccagatcgaggccggcagcaccgagagaatcttcctgaccgtgagcaactacatcttcaccgccatcttcgtgggcgagatgaccctgaaggtggtgagcctgggcctgtacttcggcgagcaggcctacctgagaagcagctggaacgtgctggacggcttcctggtgttcgtgagcatcatcgacatcgtggtgagcctggccagcgccggcggcgccaagatcctgggcgtgctgagagtgctgagactgctgagaaccctgagacccctgagagtgatcagcagagcccccggcctgaagctggtggtggagaccctgatcagcagcctgaagcccatcggcaacatcgtgctgatctgctgcgccttcttcatcatcttcggcatcctgggcgtgcagctgttcaagggcaagttctaccactgcctgggcgtggacaccagaaacatcaccaacagaagcgactgcatggccgccaactacagatgggtgcaccacaagtacaacttcgacaacctgggccaggccctgatgagcctgttcgtgctggccagcaaggacggctgggtgaacatcatgtacaacggcctggacgccgtggccgtggaccagcagcccgtgaccaaccacaacccctggatgctgctgtacttcatcagcttcctgctgatcgtgagcttcttcgtgctgaacatgttcgtgggcgtggtggtggagaacttccacaagtgcagacagcaccaggaggccgaggaggccagaagaagagaggagaagagactgagaagactggagaagaagagaagaaaggcccagagactgccctactacgccacctactgccacaccagactgctgatccacagcatgtgcaccagccactacctggacatcttcatcaccttcatcatctgcctgaacgtggtgaccatgagcctggagcactacaaccagcccaccagcctggagaccgccctgaagtactgcaactacatgttcaccaccgtgttcgtgctggaggccgtgctgaagctggtggccttcggcctgagaagattcttcaaggacagatggaaccagctggacctggccatcgtgctgctgagcgtgatgggcatcaccctggaggagatcgagatcaacgccgccctgcccatcaaccccaccatcatcagaatcatgagagtgctgagaatcgccagagtgctgaagctgctgaagatggccaccggcatgagagccctgctggacaccgtggtgcaggccctgccccaggtgggcaacctgggcctgctgttcatgctgctgttcttcatctacgccgccctgggcgtggagctgttcggcaagctggtgtgcaacgacgagaacccctgcgagggcatgagcagacacgccaccttcgagaacttcggcatggccttcctgaccctgttccaggtgagcaccggcgacaactggaacggcatcatgaaggacaccctgagagactgcacccacgacgagagaagctgcctgagcagcctgcagttcgtgagccccctgtacttcgtgagcttcgtgctgaccgcccagttcgtgctgatcaacgtggtggtggccgtgctgatgaagcacctggacgacagcaacaaggaggcccaggaggacgccgagatggacgccgagctggagctggagatggcccacggcctgggccccggccccagactgcccaccggcagccccggcgcccccggcagaggccccggcggcgccggcggcggcggcgacaccgagggcggcctgtgcagaagatgctacagccccgcccaggagaacctgtggctggacagcgtgagcctgatcatcaaggacagcctggagggcgagctgaccatcatcgacaacctgagcggcagcatcttccaccactacagcagccccgccggctgcaagaagtgccaccacgacaagcaggaggtgcagctggccgagaccgaggccttcagcctgaacagcgacagaagcagcagcatcctgctgggcgacgacctgagcctggaggaccccaccgcctgcccccccggcagaaaggacagcaagggcgagctggacccccccgagcccatgagagtgggcgacctgggcgagtgcttcttccccctgagcagcaccgccgtgagccccgaccccgagaacttcctgtgcgagatggaggagatccccttcaaccccgtgagaagctggctgaagcacgacagcagccaggccccccccagccccttcagccccgacgccagcagccccctgctgcccatgcccgccgagttcttccaccccgccgtgagcgccagccagaagggccccgagaagggcaccggcaccggcaccctgcccaagatcgccctgcagggcagctgggccagcctgagaagccccagagtgaactgcaccctgctgagacaggtgcccaccccccccagaccctag

SEQ ID NO: 75081 - DNA, 1041 bp, Artificial Sequence
  Description of Artificial Sequence: Synthetic coding sequence
atgatggacaagttcagaatgatcttccagttcctgcagagcaaccaggagagcttcatgaacggcatctgcggcatcatggccctggccagcgcccagatgtacagcgccttcgacttcaactgcccctgcctgcccggctacaacgccgcctacagcgccggcatcctgctggccccccccctggtgctgttcctgctgggcctggtgatgaacaacaacgtgagcatgctggccgaggagtggaagagacccctgggcagaagagccaaggaccccgccgtgctgagatacatgttctgcagcatggcccagagagccctgatcgcccccgtggtgtgggtggccgtgaccctgctggacggcaagtgcttcctgtgcgccttctgcaccgccgtgcccgtgagcgccctgggcaacggcagcctggcccccggcctgcccgcccccgagctggccagactgctggccagagtgccctgccccgagatctacgacggcgactggctgctggccagagaggtggccgtgagatacctgagatgcatcagccaggccctgggctggagcttcgtgctgctgaccaccctgctggccttcgtggtgagaagcgtgagaccctgcttcacccaggccgccttcctgaagagcaagtactggagccactacatcgacatcgagagaaagctgttcgacgagacctgcaccgagcacgccaaggccttcgccaaggtgtgcatccagcagttcttcgaggccatgaaccacgacctggagctgggccacacccacggcaccctggccaccgcccccgccagcgccgccgcccccaccacccccgacggcgccgaggaggagagagagaagctgagaggcatcaccgaccagggcaccatgaacagactgctgaccagctggcacaagtgcaagccccccctgagactgggccaggaggagccccccctgatgggcaacggctgggccggcggcggccccagaccccccagaaaggaggtggccacctacttcagcaaggtgtag

SEQ ID NO: 75082 - DNA, 972 bp, Artificial Sequence
  Description of Artificial Sequence: Synthetic coding sequence
atggccgccctgatcgccgagaacttcagattcctgagcctgttcttcaagagcaaggacgtgatgatcttcaacggcctggtggccctgggcaccgtgggcagccaggagctgttcagcgtggtggccttccactgcccctgcagccccgccagaaactacctgtacggcctggccgccatcggcgtgcccgccctggtgctgttcatcatcggcatcatcctgaacaaccacacctggaacctggtggccgagtgccagcacagaagaaccaagaactgcagcgccgcccccaccttcctgctgctgagcagcatcctgggcagagccgccgtggcccccgtgacctggagcgtgatcagcctgctgagaggcgaggcctacgtgtgcgccctgagcgagttcgtggaccccagcagcctgaccgccagagaggagcacttccccagcgcccacgccaccgagatcctggccagattcccctgcaaggagaaccccgacaacctgagcgacttcagagaggaggtgagcagaagactgagatacgagagccagctgttcggctggctgctgatcggcgtggtggccatcctggtgttcctgaccaagtgcctgaagcactactgcagccccctgagctacagacaggaggcctactgggcccagtacagagccaacgaggaccagctgttccagagaaccgccgaggtgcacagcagagtgctggccgccaacaacgtgagaagattcttcggcttcgtggccctgaacaaggacgacgaggagctgatcgccaacttccccgtggagggcacccagcccagaccccagtggaacgccatcaccggcgtgtacctgtacagagagaaccagggcctgcccctgtacagcagactgcacaagtgggcccagggcctggccggcaacggcgccgcccccgacaacgtggagatggccctgctgcccagctag

SEQ ID NO: 75083 - DNA, 972 bp, Artificial Sequence; identical to SEQ ID NO: 75082
  Description of Artificial Sequence: Synthetic coding sequence

SEQ ID NO: 75084 - DNA, 657 bp, Artificial Sequence
  Description of Artificial Sequence: Synthetic coding sequence
atggccgccctgatcgccgagaacttcagattcctgagcctgttcttcaagagcaaggacgtgatgatcttcaacggcctggtggccctgggcaccgtgggcagccaggagctgttcagcgtggtggccttccactgcccctgcagccccgccagaaactacctgtacggcctggccgccatcggcgtgcccgccctggtgctgttcatcatcggcatcatcctgaacaaccacacctggaacctggtggccgagtgccagcacagaagaaccaagaactgcagcgccgcccccaccttcctgctgctgagcagcatcctgggcagagccgccgtggcccccgtgacctggagcgtgatcagcctgctgagaggcgaggcctacgtgtgcgccctgagcgagttcgtggaccccagcagcctgaccgccagagaggagcacttccccagcgcccacgccaccgagatcctggccagattcccctgcaaggagaaccccgacaacctgagcgacttcagagaggaggtgagcagaagactgagatacgagagccaggtgagaagctgcgccaagggcagcagcagcagcctggtggtggccggcgagagaagcggcgacggcctggtgctgaagctgggcctggtgctgagaggctag

SEQ ID NO: 75085 - DNA, 891 bp, Artificial Sequence
  Description of Artificial Sequence: Synthetic coding sequence
atggagagcatggccgtggccaccgacggcggcgagagacccggcgtgcccgccggcagcggcctgagcgccagccagagaagagccgagctgagaagaagaaagctgctgatgaacagcgagcagagaatcaacagaatcatgggcttccacagacccggcagcggcgccgaggaggagagccagaccaagagcaagcagcaggacagcgacaagctgaacagcctgagcgtgcccagcgtgagcaagagagtggtgctgggcgacagcgtgagcaccggcaccaccgaccagcagggcggcgtggccgaggtgaagggcacccagctgggcgacaagctggacagcttcatcaagccccccgagtgcagcagcgacgtgaacctggagctgagacagagaaacagaggcgacctgaccgccgacagcgtgcagagaggcagcagacacggcctggagcagtacctgagcagattcgaggaggccatgaagctgagaaagcagctgatcagcgagaagcccagccaggaggacggcaacaccaccgaggagttcgacagcttcagaatcttcagactggtgggctgcgccctgctggccctgggcgtgagagccttcgtgtgcaagtacctgagcatcttcgcccccttcctgaccctgcagctggcctacatgggcctgtacaagtacttccccaagagcgagaagaagatcaagaccaccgtgctgaccgccgccctgctgctgagcggcatccccgccgaggtgatcaacagaagcatggacacctacagcaagatgggcgaggtgttcaccgacctgtgcgtgtacttcttcaccttcatcttctgccacgagctgctggactactggggcagcgaggtgccctag

SEQ ID NO: 75086 - DNA, 1113 bp, Artificial Sequence
  Description of Artificial Sequence: Synthetic coding sequence
atgctgggcgccgtggagggccccagatggaagcaggccgaggacatcagagacatctacgacttcagagacgtgctgggcaccggcgccttcagcgaggtgatcctggccgaggacaagagaacccagaagctggtggccatcaagtgcatcgccaaggaggccctggagggcaaggagggcagcatggagaacgagatcgccgtgctgcacaagatcaagcaccccaacatcgtggccctggacgacatctacgagagcggcggccacctgtacctgatcatgcagctggtgagcggcggcgagctgttcgacagaatcgtggagaagggcttctacaccgagagagacgccagcagactgatcttccaggtgctggacgccgtgaagtacctgcacgacctgggcatcgtgcacagagacctgaagcccgagaacctgctgtactacagcctggacgaggacagcaagatcatgatcagcgacttcggcctgagcaagatggaggaccccggcagcgtgctgagcaccgcctgcggcacccccggctacgtggcccccgaggtgctggcccagaagccctacagcaaggccgtggactgctggagcatcggcgtgatcgcctacatcctgctgtgcggctacccccccttctacgacgagaacgacgccaagctgttcgagcagatcctgaaggccgagtacgagttcgacagcccctactgggacgacatcagcgacagcgccaaggacttcatcagacacctgatggagaaggaccccgagaagagattcacctgcgagcaggccctgcagcacccctggatcgccggcgacaccgccctggacaagaacatccaccagagcgtgagcgagcagatcaagaagaacttcgccaagagcaagtggaagcaggccttcaacgccaccgccgtggtgagacacatgagaaagctgcagctgggcaccagccaggagggccagggccagaccgccagccacggcgagctgctgacccccgtggccggcggccccgccgccggctgctgctgcagagactgctgcgtggagcccggcaccgagctgagccccaccctgccccaccagctgtag

SEQ ID NO: 75087 - DNA, 1437 bp, Artificial Sequence
  Description of Artificial Sequence: Synthetic coding sequence
atggccaccatcacctgcaccagattcaccgaggagtaccagctgttcgaggagctgggcaagggcgccttcagcgtggtgagaagatgcgtgaaggtgctggccggccaggagtacgccgccaagatcatcaacaccaagaagctgagcgccagagaccaccagaagctggagagagaggccagaatctgcagactgctgaagcaccccaacatcgtgagactgcacgacagcatcagcgaggagggccaccactacctgatcttcgacctggtgaccggcggcgagctgttcgaggacatcgtggccagagagtactacagcgaggccgacgccagccactgcatccagcagatcctggaggccgtgctgcactgccaccagatgggcgtggtgcacagagacctgaagcccgagaacctgctgctggccagcaagctgaagggcgccgccgtgaagctggccgacttcggcctggccatcgaggtggagggcgagcagcaggcctggttcggcttcgccggcacccccggctacctgagccccgaggtgctgagaaaggacccctacggcaagcccgtggacctgtgggcctgcggcgtgatcctgtacatcctgctggtgggctacccccccttctgggacgaggaccagcacagactgtaccagcagatcaaggccggcgcctacgacttccccagccccgagtgggacaccgtgacccccgaggccaaggacctgatcaacaagatgctgaccatcaaccccagcaagagaatcaccgccgccgaggccctgaagcacccctggatcagccacagaagcaccgtggccagctgcatgcacagacaggagaccgtggactgcctgaagaagttcaacgccagaagaaagctgaagggcgccatcctgaccaccatgctggccaccagaaacttcagcggcggcaagagcggcggcaacaagaagagcgacggcgtgaaggagagcagcgagagcaccaacaccaccatcgaggacgaggacaccaaggtgagaaagcaggagatcatcaaggtgaccgagcagctgatcgaggccatcagcaacggcgacttcgagagctacaccaagatgtgcgaccccggcatgaccgccttcgagcccgaggccctgggcaacctggtggagggcctggacttccacagattctacttcgagaacctgtggagcagaaacagcaagcccgtgcacaccaccatcctgaacccccacatccacctgatgggcgacgagagcgcctgcatcgcctacatcagaatcacccagtacctggacgccggcggcatccccagaaccgcccagagcgaggagaccagagtgtggcacagaagagacggcaagtggcagatcgtgcacttccacagaagcggcgcccccagcgtgctgccccactag

SEQ ID NO: 75088 - DNA, 1470 bp, Artificial Sequence
  Description of Artificial Sequence: Synthetic coding sequence
atggccaccatcacctgcaccagattcaccgaggagtaccagctgttcgaggagctgggcaagggcgccttcagcgtggtgagaagatgcgtgaaggtgctggccggccaggagtacgccgccaagatcatcaacaccaagaagctgagcgccagagaccaccagaagctggagagagaggccagaatctgcagactgctgaagcaccccaacatcgtgagactgcacgacagcatcagcgaggagggccaccactacctgatcttcgacctggtgaccggcggcgagctgttcgaggacatcgtggccagagagtactacagcgaggccgacgccagccactgcatccagcagatcctggaggccgtgctgcactgccaccagatgggcgtggtgcacagagacctgaagcccgagaacctgctgctggccagcaagctgaagggcgccgccgtgaagctggccgacttcggcctggccatcgaggtggagggcgagcagcaggcctggttcggcttcgccggcacccccggctacctgagccccgaggtgctgagaaaggacccctacggcaagcccgtggacctgtgggcctgcggcgtgatcctgtacatcctgctggtgggctacccccccttctgggacgaggaccagcacagactgtaccagcagatcaaggccggcgcctacgacttccccagccccgagtgggacaccgtgacccccgaggccaaggacctgatcaacaagatgctgaccatcaaccccagcaagagaatcaccgccgccgaggccctgaagcacccctggatcagccacagaagcaccgtggccagctgcatgcacagacaggagaccgtggactgcctgaagaagttcaacgccagaagaaagctgaagggcgccatcctgaccaccatgctggccaccagaaacttcagcggcggcaagagcggcggcaacaagaagagcgacggcgtgaagaagagaaagagcagcagcagcgtgcagctgatggagagcagcgagagcaccaacaccaccatcgaggacgaggacaccaaggtgagaaagcaggagatcatcaaggtgaccgagcagctgatcgaggccatcagcaacggcgacttcgagagctacaccaagatgtgcgaccccggcatgaccgccttcgagcccgaggccctgggcaacctggtggagggcctggacttccacagattctacttcgagaacctgtggagcagaaacagcaagcccgtgcacaccaccatcctgaacccccacatccacctgatgggcgacgagagcgcctgcatcgcctacatcagaatcacccagtacctggacgccggcggcatccccagaaccgcccagagcgaggagaccagagtgtggcacagaagagacggcaagtggcagatcgtgcacttccacagaagcggcgcccccagcgtgctgccccactag

SEQ ID NO: 75089 - DNA, 276 bp, Artificial Sequence
  Description of Artificial Sequence: Synthetic coding sequence
atggccaccatcacctgcaccagattcaccgaggagtaccagctgttcgaggagctgggcaagggcgccttcagcgtggtgagaagatgcgtgaaggtgctggccggccaggagtacgccgccaagatcatcaacaccaagaagctgagcgccagagaccaccagaagctggagagagaggccagaatctgcagactgctgaagcaccccaacatcgtgagactgcacgacagcatcagcgaggagggccaccactacctgatcttcgacctgtag

SEQ ID NO: 75090 - DNA, 1554 bp, Artificial Sequence
  Description of Artificial Sequence: Synthetic coding sequence
atggccaccaccgtgacctgcaccagattcaccgacgagtaccagctgtacgaggacatcggcaagggcgccttcagcgtggtgagaagatgcgtgaagctgtgcaccggccacgagtacgccgccaagatcatcaacaccaagaagctgagcgccagagaccaccagaagctggagagagaggccagaatctgcagactgctgaagcacagcaacatcgtgagactgcacgacagcatcagcgaggagggcttccactacctggtgttcgacctggtgaccggcggcgagctgttcgaggacatcgtggccagagagtactacagcgaggccgacgccagccactgcatccagcagatcctggaggccgtgctgcactgccaccagatgggcgtggtgcacagagacctgaagcccgagaacctgctgctggccagcaagtgcaagggcgccgccgtgaagctggccgacttcggcctggccatcgaggtgcagggcgaccagcaggcctggttcggcttcgccggcacccccggctacctgagccccgaggtgctgagaaaggaggcctacggcaagcccgtggacatctgggcctgcggcgtgatcctgtacatcctgctggtgggctacccccccttctgggacgaggaccagcacaagctgtaccagcagatcaaggccggcgcctacgacttccccagccccgagtgggacaccgtgacccccgaggccaagaacctgatcaaccagatgctgaccatcaaccccgccaagagaatcaccgcccacgaggccctgaagcacccctgggtgtgccagagaagcaccgtggccagcatgatgcacagacaggagaccgtggagtgcctgaagaagttcaacgccagaagaaagctgaagggcgccatcctgaccaccatgctggccaccagaaacttcagcgccaagagcctgctgaacaagaaggccgacggcgtgaagccccagaccaacagcaccaagaacagcgccgccgccaccagccccaagggcaccctgccccccgccgccctggagccccagaccaccgtgatccacaaccccgtggacggcatcaaggagagcagcgacagcgccaacaccaccatcgaggacgaggacgccaaggccagaaagcaggagatcatcaagaccaccgagcagctgatcgaggccgtgaacaacggcgacttcgaggcctacgccaagatctgcgaccccggcctgaccagcttcgagcccgaggccctgggcaacctggtggagggcatggacttccacagattctacttcgagaacctgctggccaagaacagcaagcccatccacaccaccatcctgaacccccacgtgcacgtgatcggcgaggacgccgcctgcatcgcctacatcagactgacccagtacatcgacggccagggcagacccagaaccagccagagcgaggagaccagagtgtggcacagaagagacggcaagtggcagaacgtgcacttccactgcagcggcgcccccgtggcccccctgcagtag

SEQ ID NO: 75091 - DNA, 1350 bp, Artificial Sequence
  Description of Artificial Sequence: Synthetic coding sequence
atggccaccaccgtgacctgcaccagattcaccgacgagtaccagctgtacgaggacatcggcaagggcgccttcagcgtggtgagaagatgcgtgaagctgtgcaccggccacgagtacgccgccaagatcatcaacaccaagaagctgagcgccagagaccaccagaagctggagagagaggccagaatctgcagactgctgaagcacagcaacatcgtgagactgcacgacagcatcagcgaggagggcttccactacctggtgttcgacctggtgaccggcggcgagctgttcgaggacatcgtggccagagagtactacagcgaggccgacgccagccactgcatccagcagatcctggaggccgtgctgcactgccaccagatgggcgtggtgcacagagacctgaagcccgagaacctgctgctggccagcaagtgcaagggcgccgccgtgaagctggccgacttcggcctggccatcgaggtgcagggcgaccagcaggcctggttcggcttcgccggcacccccggctacctgagccccgaggtgctgagaaaggaggcctacggcaagcccgtggacatctgggcctgcggcgtgatcctgtacatcctgctggtgggctacccccccttctgggacgaggaccagcacaagctgtaccagcagatcaaggccggcgcctacgacttccccagccccgagtgggacaccgtgacccccgaggccaagaacctgatcaaccagatgctgaccatcaaccccgccaagagaatcaccgcccacgaggccctgaagcacccctgggtgtgccagagaagcaccgtggccagcatgatgcacagacaggagaccgtggagtgcctgaagaagttcaacgccagaagaaagctgaagggcgccatcctgaccaccatgctggccaccagaaacttcagcgccagaaagcaggagatcatcaagaccaccgagcagctgatcgaggccgtgaacaacggcgacttcgaggcctacgccaagatctgcgaccccggcctgaccagcttcgagcccgaggccctgggcaacctggtggagggcatggacttccacagattctacttcgagaacctgctggccaagaacagcaagcccatccacaccaccatcctgaacccccacgtgcacgtgatcggcgaggacgccgcctgcatcgcctacatcagactgacccagtacatcgacggccagggcagacccagaaccagccagagcgaggagaccagagtgtggcacagaagagacggcaagtggcagaacgtgcacttccactgcagcggcgcccccgtggcccccctgcagtag

SEQ ID NO: 75092 - DNA, 1479 bp, Artificial Sequence
  Description of Artificial Sequence: Synthetic coding sequence
atggccaccaccgtgacctgcaccagattcaccgacgagtaccagctgtacgaggacatcggcaagggcgccttcagcgtggtgagaagatgcgtgaagctgtgcaccggccacgagtacgccgccaagatcatcaacaccaagaagctgagcgccagagaccaccagaagctggagagagaggccagaatctgcagactgctgaagcacagcaacatcgtgagactgcacgacagcatcagcgaggagggcttccactacctggtgttcgacctggtgaccggcggcgagctgttcgaggacatcgtggccagagagtactacagcgaggccgacgccagccactgcatccagcagatcctggaggccgtgctgcactgccaccagatgggcgtggtgcacagagacctgaagcccgagaacctgctgctggccagcaagtgcaagggcgccgccgtgaagctggccgacttcggcctggccatcgaggtgcagggcgaccagcaggcctggttcggcttcgccggcacccccggctacctgagccccgaggtgctgagaaaggaggcctacggcaagcccgtggacatctgggcctgcggcgtgatcctgtacatcctgctggtgggctacccccccttctgggacgaggaccagcacaagctgtaccagcagatcaaggccggcgcctacgacttccccagccccgagtgggacaccgtgacccccgaggccaagaacctgatcaaccagatgctgaccatcaaccccgccaagagaatcaccgcccacgaggccctgaagcacccctgggtgtgccagagaagcaccgtggccagcatgatgcacagacaggagaccgtggagtgcctgaagaagttcaacgccagaagaaagctgaagggcgccatcctgaccaccatgctggccaccagaaacttcagcgtgggcagacagaccaccgcccccgccaccatgagcaccgccgccagcggcaccaccatgggcctggtggagcaggccaagagcctgctgaacaagaaggccgacggcgtgaaggagccccagaccaccgtgatccacaaccccgtggacggcatcaaggagagcagcgacagcgccaacaccaccatcgaggacgaggacgccaaggccagaaagcaggagatcatcaagaccaccgagcagctgatcgaggccgtgaacaacggcgacttcgaggcctacgccttctacttcgagaacctgctggccaagaacagcaagcccatccacaccaccatcctgaacccccacgtgcacgtgatcggcgaggacgccgcctgcatcgcctacatcagactgacccagtacatcgacggccagggcagacccagaaccagccagagcgaggagaccagagtgtggcacagaagagacggcaagtggcagaacgtgcacttccactgcagcggcgcccccgtggcccccctgcagtag

SEQ ID NO: 75093 - DNA, 1629 bp, Artificial Sequence
  Description of Artificial Sequence: Synthetic coding sequence
atggccaccaccgtgacctgcaccagattcaccgacgagtaccagctgtacgaggacatcggcaagggcgccttcagcgtggtgagaagatgcgtgaagctgtgcaccggccacgagtacgccgccaagatcatcaacaccaagaagctgagcgccagagaccaccagaagctggagagagaggccagaatctgcagactgctgaagcacagcaacatcgtgagactgcacgacagcatcagcgaggagggcttccactacctggtgttcgacctggtgaccggcggcgagctgttcgaggacatcgtggccagagagtactacagcgaggccgacgccagccactgcatccagcagatcctggaggccgtgctgcactgccaccagatgggcgtggtgcacagagacctgaagcccgagaacctgctgctggccagcaagtgcaagggcgccgccgtgaagctggccgacttcggcctggccatcgaggtgcagggcgaccagcaggcctggttcggcttcgccggcacccccggctacctgagccccgaggtgctgagaaaggaggcctacggcaagcccgtggacatctgggcctgcggcgtgatcctgtacatcctgctggtgggctacccccccttctgggacgaggaccagcacaagctgtaccagcagatcaaggccggcgcctacgacttccccagccccgagtgggacaccgtgacccccgaggccaagaacctgatcaaccagatgctgaccatcaaccccgccaagagaatcaccgcccacgaggccctgaagcacccctgggtgtgccagagaagcaccgtggccagcatgatgcacagacaggagaccgtggagtgcctgaagaagttcaacgccagaagaaagctgaagggcgccatcctgaccaccatgctggccaccagaaacttcagcgtgggcagacagaccaccgcccccgccaccatgagcaccgccgccagcggcaccaccatgggcctggtggagcaggccaagagcctgctgaacaagaaggccgacggcgtgaagccccagaccaacagcaccaagaacagcgccgccgccaccagccccaagggcaccctgccccccgccgccctggagccccagaccaccgtgatccacaaccccgtggacggcatcaaggagagcagcgacagcgccaacaccaccatcgaggacgaggacgccaaggccagaaagcaggagatcatcaagaccaccgagcagctgatcgaggccgtgaacaacggcgacttcgaggcctacgccaagatctgcgaccccggcctgaccagcttcgagcccgaggccctgggcaacctggtggagggcatggacttccacagattctacttcgagaacctgctggccaagaacagcaagcccatccacaccaccatcctgaacccccacgtgcacgtgatcggcgaggacgccgcctgcatcgcctacatcagactgacccagtacatcgacggccagggcagacccagaaccagccagagcgaggagaccagagtgtggcacagaagagacggcaagtggcagaacgtgcacttccactgcagcggcgcccccgtggcccccctgcagtag

SEQ ID NO: 75094 - DNA, 1440 bp, Artificial Sequence
  Description of Artificial Sequence: Synthetic coding sequence
atggccaccaccgtgacctgcaccagattcaccgacgagtaccagctgtacgaggacatcggcaagggcgccttcagcgtggtgagaagatgcgtgaagctgtgcaccggccacgagtacgccgccaagatcatcaacaccaagaagctgagcgccagagaccaccagaagctggagagagaggccagaatctgcagactgctgaagcacagcaacatcgtgagactgcacgacagcatcagcgaggagggcttccactacctggtgttcgacctggtgaccggcggcgagctgttcgaggacatcgtggccagagagtactacagcgaggccgacgccagccactgcatccagcagatcctggaggccgtgctgcactgccaccagatgggcgtggtgcacagagacctgaagcccgagaacctgctgctggccagcaagtgcaagggcgccgccgtgaagctggccgacttcggcctggccatcgaggtgcagggcgaccagcaggcctggttcggcttcgccggcacccccggctacctgagccccgaggtgctgagaaaggaggcctacggcaagcccgtggacatctgggcctgcggcgtgatcctgtacatcctgctggtgggctacccccccttctgggacgaggaccagcacaagctgtaccagcagatcaaggccggcgcctacgacttccccagccccgagtgggacaccgtgacccccgaggccaagaacctgatcaaccagatgctgaccatcaaccccgccaagagaatcaccgcccacgaggccctgaagcacccctgggtgtgccagagaagcaccgtggccagcatgatgcacagacaggagaccgtggagtgcctgaagaagttcaacgccagaagaaagctgaagggcgccatcctgaccaccatgctggccaccagaaacttcagcgccgccaagagcctgctgaacaagaaggccgacggcgtgaaggagagcagcgacagcgccaacaccaccatcgaggacgaggacgccaaggccagaaagcaggagatcatcaagaccaccgagcagctgatcgaggccgtgaacaacggcgacttcgaggcctacgccaagatctgcgaccccggcctgaccagcttcgagcccgaggccctgggcaacctggtggagggcatggacttccacagattctacttcgagaacctgctggccaagaacagcaagcccatccacaccaccatcctgaacccccacgtgcacgtgatcggcgaggacgccgcctgcatcgcctacatcagactgacccagtacatcgacggccagggcagacccagaaccagccagagcgaggagaccagagtgtggcacagaagagacggcaagtggcagaacgtgcacttccactgcagcggcgcccccgtggcccccctgcagtag

SEQ ID NO: 75095 - DNA, 1512 bp, Artificial Sequence
  Description of Artificial Sequence: Synthetic coding sequence
atggccaccaccgtgacctgcaccagattcaccgacgagtaccagctgtacgaggacatcggcaagggcgccttcagcgtggtgagaagatgcgtgaagctgtgcaccggccacgagtacgccgccaagatcatcaacaccaagaagctgagcgccagagaccaccagaagctggagagagaggccagaatctgcagactgctgaagcacagcaacatcgtgagactgcacgacagcatcagcgaggagggcttccactacctggtgttcgacctggtgaccggcggcgagctgttcgaggacatcgtggccagagagtactacagcgaggccgacgccagccactgcatccagcagatcctggaggccgtgctgcactgccaccagatgggcgtggtgcacagagacctgaagcccgagaacctgctgctggccagcaagtgcaagggcgccgccgtgaagctggccgacttcggcctggccatcgaggtgcagggcgaccagcaggcctggttcggcttcgccggcacccccggctacctgagccccgaggtgctgagaaaggaggcctacggcaagcccgtggacatctgggcctgcggcgtgatcctgtacatcctgctggtgggctacccccccttctgggacgaggaccagcacaagctgtaccagcagatcaaggccggcgcctacgacttccccagccccgagtgggacaccgtgacccccgaggccaagaacctgatcaaccagatgctgaccatcaaccccgccaagagaatcaccgcccacgaggccctgaagcacccctgggtgtgccagagaagcaccgtggccagcatgatgcacagacaggagaccgtggagtgcctgaagaagttcaacgccagaagaaagctgaagggcgccatcctgaccaccatgctggccaccagaaacttcagcgccgccaagagcctgctgaacaagaaggccgacggcgtgaagccccagaccaacagcaccaagaacagcgccgccgccaccagccccaagggcaccctgccccccgccgccctggagagcagcgacagcgccaacaccaccatcgaggacgaggacgccaaggccagaaagcaggagatcatcaagaccaccgagcagctgatcgaggccgtgaacaacggcgacttcgaggcctacgccaagatctgcgaccccggcctgaccagcttcgagcccgaggccctgggcaacctggtggagggcatggacttccacagattctacttcgagaacctgctggccaagaacagcaagcccatccacaccaccatcctgaacccccacgtgcacgtgatcggcgaggacgccgcctgcatcgcctacatcagactgacccagtacatcgacggccagggcagacccagaaccagccagagcgaggagaccagagtgtggcacagaagagacggcaagtggcagaacgtgcacttccactgcagcggcgcccccgtggcccccctgcagtag

SEQ ID NO: 75096 - DNA, 1557 bp, Artificial Sequence
  Description of Artificial Sequence: Synthetic coding sequence
atggccaccaccgtgacctgcaccagattcaccgacgagtaccagctgtacgaggacatcggcaagggcgccttcagcgtggtgagaagatgcgtgaagctgtgcaccggccacgagtacgccgccaagatcatcaacaccaagaagctgagcgccagagaccaccagaagctggagagagaggccagaatctgcagactgctgaagcacagcaacatcgtgagactgcacgacagcatcagcgaggagggcttccactacctggtgttcgacctggtgaccggcggcgagctgttcgaggacatcgtggccagagagtactacagcgaggccgacgccagccactgcatccagcagatcctggaggccgtgctgcactgccaccagatgggcgtggtgcacagagacctgaagcccgagaacctgctgctggccagcaagtgcaagggcgccgccgtgaagctggccgacttcggcctggccatcgaggtgcagggcgaccagcaggcctggttcggcttcgccggcacccccggctacctgagccccgaggtgctgagaaaggaggcctacggcaagcccgtggacatctgggcctgcggcgtgatcctgtacatcctgctggtgggctacccccccttctgggacgaggaccagcacaagctgtaccagcagatcaaggccggcgcctacgacttccccagccccgagtgggacaccgtgacccccgaggccaagaacctgatcaaccagatgctgaccatcaaccccgccaagagaatcaccgcccacgaggccctgaagcacccctgggtgtgccagagaagcaccgtggccagcatgatgcacagacaggagaccgtggagtgcctgaagaagttcaacgccagaagaaagctgaagggcgccatcctgaccaccatgctggccaccagaaacttcagcgccgccaagagcctgctgaacaagaaggccgacggcgtgaagccccagaccaacagcaccaagaacagcgccgccgccaccagccccaagggcaccctgccccccgccgccctggagccccagaccaccgtgatccacaaccccgtggacggcatcaaggagagcagcgacagcgccaacaccaccatcgaggacgaggacgccaaggccagaaagcaggagatcatcaagaccaccgagcagctgatcgaggccgtgaacaacggcgacttcgaggcctacgccaagatctgcgaccccggcctgaccagcttcgagcccgaggccctgggcaacctggtggagggcatggacttccacagattctacttcgagaacctgctggccaagaacagcaagcccatccacaccaccatcctgaacccccacgtgcacgtgatcggcgaggacgccgcctgcatcgcctacatcagactgacccagtacatcgacggccagggcagacccagaaccagccagagcgaggagaccagagtgtggcacagaagagacggcaagtggcagaacgtgcacttccactgcagcggcgcccccgtggcccccctgcagtag

SEQ ID NO: 75097 - DNA, 2001 bp, Artificial Sequence
  Description of Artificial Sequence: Synthetic coding sequence
atggccaccaccgtgacctgcaccagattcaccgacgagtaccagctgtacgaggacatcggcaagggcgccttcagcgtggtgagaagatgcgtgaagctgtgcaccggccacgagtacgccgccaagatcatcaacaccaagaagctgagcgccagagaccaccagaagctggagagagaggccagaatctgcagactgctgaagcacagcaacatcgtgagactgcacgacagcatcagcgaggagggcttccactacctggtgttcgacctggtgaccggcggcgagctgttcgaggacatcgtggccagagagtactacagcgaggccgacgccagccactgcatccagcagatcctggaggccgtgctgcactgccaccagatgggcgtggtgcacagagacctgaagcccgagaacctgctgctggccagcaagtgcaagggcgccgccgtgaagctggccgacttcggcctggccatcgaggtgcagggcgaccagcaggcctggttcggcttcgccggcacccccggctacctgagccccgaggtgctgagaaaggaggcctacggcaagcccgtggacatctgggcctgcggcgtgatcctgtacatcctgctggtgggctacccccccttctgggacgaggaccagcacaagctgtaccagcagatcaaggccggcgcctacgacttccccagccccgagtgggacaccgtgacccccgaggccaagaacctgatcaaccagatgctgaccatcaaccccgccaagagaatcaccgcccacgaggccctgaagcacccctgggtgtgccagagaagcaccgtggccagcatgatgcacagacaggagaccgtggagtgcctgaagaagttcaacgccagaagaaagctgaagggcgccatcctgaccaccatgctggccaccagaaacttcagcgtgggcagacagaccaccgcccccgccaccatgagcaccgccgccagcggcaccaccatgggcctggtggagcaggccaagagcctgctgaacaagaaggccgacggcgtgaagccccagaccaacagcaccaagaacagcgccgccgccaccagccccaagggcaccctgccccccgccgccctggagccccagaccaccgtgatccacaaccccgtggacggcatcaaggagagcagcgacagcgccaacaccaccatcgaggacgaggacgccaaggcccccagagtgcccgacatcctgagcagcgtgagaagaggcagcggcgcccccgaggccgagggccccctgccctgccccagccccgcccccttcagccccctgcccgcccccagccccagaatcagcgacatcctgaacagcgtgagaagaggcagcggcacccccgaggccgagggccccctgagcgccggcccccccccctgcctgagccccgccctgctgggccccctgagcagccccagccccagaatcagcgacatcctgaacagcgtgagaagaggcagcggcacccccgaggccgagggccccagccccgtgggcccccccccctgccccagccccaccatccccggccccctgcccacccccagcagaaagcaggagatcatcaagaccaccgagcagctgatcgaggccgtgaacaacggcgacttcgaggcctacgccaagatctgcgaccccggcctgaccagcttcgagcccgaggccctgggcaacctggtggagggcatggacttccacagattctacttcgagaacctgctggccaagaacagcaagcccatccacaccaccatcctgaacccccacgtgcacgtgatcggcgaggacgccgcctgcatcgcctacatcagactgacccagtacatcgacggccagggcagacccagaaccagccagagcgaggagaccagagtgtggcacagaagagacggcaagtggcagaacgtgcacttccactgcagcggcgcccccgtggcccccctgcagtag

SEQ ID NO: 75098 - DNA, 1629 bp, Artificial Sequence; identical to SEQ ID NO: 75093
  Description of Artificial Sequence: Synthetic coding sequence

SEQ ID NO: 75099 - DNA, 1557 bp, Artificial Sequence; identical to SEQ ID NO: 75096
  Description of Artificial Sequence: Synthetic coding sequence

SEQ ID NO: 75100 - DNA, 918 bp, Artificial Sequence
  Description of Artificial Sequence: Synthetic coding sequence
atgggcgtggtgcacagagacctgaagcccgagaacctgctgctggccagcaagtgcaagggcgccgccgtgaagctggccgacttcggcctggccatcgaggtgcagggcgaccagcaggcctggttcggcttcgccggcacccccggctacctgagccccgaggtgctgagaaaggaggcctacggcaagcccgtggacatctgggcctgcggcgtgatcctgtacatcctgctggtgggctacccccccttctgggacgaggaccagcacaagctgtaccagcagatcaaggccggcgcctacgacttccccagccccgagtgggacaccgtgacccccgaggccaagaacctgatcaaccagatgctgaccatcaaccccgccaagagaatcaccgcccacgaggccctgaagcacccctgggtgtgccagagaagcaccgtggccagcatgatgcacagacaggagaccgtggagtgcctgaagaagttcaacgccagaagaaagctgaagggcgccatcctgaccaccatgctggccaccagaaacttcagcgtgggcagacagaccaccgcccccgccaccatgagcaccgccgccagcggcaccaccatgggcctggtggagcaggccaagagcctgctgaacaagaaggccgacggcgtgaagccccagaccaacagcaccaagaacagcgccgccgccaccagccccaagggcaccctgccccccgccgccctggagccccagaccaccgtgatccacaaccccgtggacggcatcaaggagagcagcgacagcgccaacaccaccatcgaggacgaggacgccaaggccagaaagcaggagatcatcaagaccaccgagcagctgatcgaggccgtgaacaacggcgacttcgaggcctacgcctag

SEQ ID NO: 75101 - DNA, 1437 bp, Artificial Sequence
  Description of Artificial Sequence: Synthetic coding sequence
atggccagcaccaccacctgcaccagattcaccgacgagtaccagctgttcgaggagctgggcaagggcgccttcagcgtggtgagaagatgcatgaagatccccaccggccaggagtacgccgccaagatcatcaacaccaagaagctgagcgccagagaccaccagaagctggagagagaggccagaatctgcagactgctgaagcaccccaacatcgtgagactgcacgacagcatcagcgaggagggcttccactacctggtgttcgacctggtgaccggcggcgagctgttcgaggacatcgtggccagagagtactacagcgaggccgacgccagccactgcatccagcagatcctggagagcgtgaaccactgccacctgaacggcatcgtgcacagagacctgaagcccgagaacctgctgctggccagcaagagcaagggcgccgccgtgaagctggccgacttcggcctggccatcgaggtgcagggcgaccagcaggcctggttcggcttcgccggcacccccggctacctgagccccgaggtgctgagaaaggacccctacggcaagcccgtggacatgtgggcctgcggcgtgatcctgtacatcctgctggtgggctacccccccttctgggacgaggaccagcacagactgtaccagcagatcaaggccggcgcctacgacttccccagccccgagtgggacaccgtgacccccgaggccaaggacctgatcaacaagatgctgaccatcaaccccgccaagagaatcaccgccagcgaggccctgaagcacccctggatctgccagagaagcaccgtggccagcatgatgcacagacaggagaccgtggactgcctgaagaagttcaacgccagaagaaagctgaagggcgccatcctgaccaccatgctggccaccagaaacttcagcgccgccaagagcctgctgaagaagcccgacggcgtgaaggagagcaccgagagcagcaacaccaccatcgaggacgaggacgtgaaggccagaaagcaggagatcatcaaggtgaccgagcagctgatcgaggccatcaacaacggcgacttcgaggcctacaccaagatctgcgaccccggcctgaccgccttcgagcccgaggccctgggcaacctggtggagggcatggacttccacagattctacttcgagaacgccctgagcaagagcaacaagcccatccacaccatcatcctgaacccccacgtgcacctggtgggcgacgacgccgcctgcatcgcctacatcagactgacccagtacatggacggcagcggcatgcccaagaccatgcagagcgaggagaccagagtgtggcacagaagagacggcaagtggcagaacgtgcacttccacagaagcggcagccccaccgtgcccatcaagtag

SEQ ID NO: 75102 - DNA, 1500 bp, Artificial Sequence
  Description of Artificial Sequence: Synthetic coding sequence
atggccagcaccaccacctgcaccagattcaccgacgagtaccagctgttcgaggagctgggcaagggcgccttcagcgtggtgagaagatgcatgaagatccccaccggccaggagtacgccgccaagatcatcaacaccaagaagctgagcgccagagaccaccagaagctggagagagaggccagaatctgcagactgctgaagcaccccaacatcgtgagactgcacgacagcatcagcgaggagggcttccactacctggtgttcgacctggtgaccggcggcgagctgttcgaggacatcgtggccagagagtactacagcgaggccgacgccagccactgcatccagcagatcctggagagcgtgaaccactgccacctgaacggcatcgtgcacagagacctgaagcccgagaacctgctgctggccagcaagagcaagggcgccgccgtgaagctggccgacttcggcctggccatcgaggtgcagggcgaccagcaggcctggttcggcttcgccggcacccccggctacctgagccccgaggtgctgagaaaggacccctacggcaagcccgtggacatgtgggcctgcggcgtgatcctgtacatcctgctggtgggctacccccccttctgggacgaggaccagcacagactgtaccagcagatcaaggccggcgcctacgacttccccagccccgagtgggacaccgtgacccccgaggccaaggacctgatcaacaagatgctgaccatcaaccccgccaagagaatcaccgccagcgaggccctgaagcacccctggatctgccagagaagcaccgtggccagcatgatgcacagacaggagaccgtggactgcctgaagaagttcaacgccagaagaaagctgaagggcgccatcctgaccaccatgctggccaccagaaacttcagcgccgccaagagcctgctgaagaagcccgacggcgtgaaggagagcaccgagagcagcaacaccaccatcgaggacgaggacgtgaaggccagaaagcaggagatcatcaaggtgaccgagcagctgatcgaggccatcaacaacggcgacttcgaggcctacaccaagatctgcgaccccggcctgaccgccttcgagcccgaggccctgggcaacctggtggagggcatggacttccacagattctacttcgagaacgccctgagcaagagcaacaagcccatccacaccatcatcctgaacccccacgtgcacctggtgggcgacgacgccgcctgcatcgcctacatcagactgacccagtacatggacggcagcggcatgcccaagaccatgcagagcgaggagaccagagtgtggcacagaagagacggcaagtggcagaacgtgcacttccacagaagcggcagccccaccgtgcccatcaagcccccctgcatccccaacggcaaggagaacttcagcggcggcaccagcctgtggcagaacatctag

SEQ ID NO: 75103 - DNA, 1437 bp, Artificial Sequence; identical to SEQ ID NO: 75101
  Description of Artificial Sequence: Synthetic coding sequence

SEQ ID NO: 75104 - DNA, 1479 bp, Artificial Sequence
  Description of Artificial Sequence: Synthetic coding sequence
atggccagcaccaccacctgcaccagattcaccgacgagtaccagctgttcgaggagctgggcaagggcgccttcagcgtggtgagaagatgcatgaagatccccaccggccaggagtacgccgccaagatcatcaacaccaagaagctgagcgccagagaccaccagaagctggagagagaggccagaatctgcagactgctgaagcaccccaacatcgtgagactgcacgacagcatcagcgaggagggcttccactacctggtgttcgacctggtgaccggcggcgagctgttcgaggacatcgtggccagagagtactacagcgaggccgacgccagccactgcatccagcagatcctggagagcgtgaaccactgccacctgaacggcatcgtgcacagagacctgaagcccgagaacctgctgctggccagcaagagcaagggcgccgccgtgaagctggccgacttcggcctggccatcgaggtgcagggcgaccagcaggcctggttcggcttcgccggcacccccggctacctgagccccgaggtgctgagaaaggacccctacggcaagcccgtggacatgtgggcctgcggcgtgatcctgtacatcctgctggtgggctacccccccttctgggacgaggaccagcacagactgtaccagcagatcaaggccggcgcctacgacttccccagccccgagtgggacaccgtgacccccgaggccaaggacctgatcaacaagatgctgaccatcaaccccgccaagagaatcaccgccagcgaggccctgaagcacccctggatctgccagagaagcaccgtggccagcatgatgcacagacaggagaccgtggactgcctgaagaagttcaacgccagaagaaagctgaagggcgccatcctgaccaccatgctggccaccagaaacttcagcgccgccaagagcctgctgaagaagcccgacggcgtgaaggagccccagaccaccgtgatccacaaccccgacggcaacaaggagagcaccgagagcagcaacaccaccatcgaggacgaggacgtgaaggccagaaagcaggagatcatcaaggtgaccgagcagctgatcgaggccatcaacaacggcgacttcgaggcctacaccaagatctgcgaccccggcctgaccgccttcgagcccgaggccctgggcaacctggtggagggcatggacttccacagattctacttcgagaacgccctgagcaagagcaacaagcccatccacaccatcatcctgaacccccacgtgcacctggtgggcgacgacgccgcctgcatcgcctacatcagactgacccagtacatggacggcagcggcatgcccaagaccatgcagagcgaggagaccagagtgtggcacagaagagacggcaagtggcagaacgtgcacttccacagaagcggcagccccaccgtgcccatcaagtag

SEQ ID NO: 75105 - DNA, 1533 bp, Artificial Sequence
  Description of Artificial Sequence: Synthetic coding sequence
atggccagcaccaccacctgcaccagattcaccgacgagtaccagctgttcgaggagctgggcaagggcgccttcagcgtggtgagaagatgcatgaagatccccaccggccaggagtacgccgccaagatcatcaacaccaagaagctgagcgccagagaccaccagaagctggagagagaggccagaatctgcagactgctgaagcaccccaacatcgtgagactgcacgacagcatcagcgaggagggcttccactacctggtgttcgacctggtgaccggcggcgagctgttcgaggacatcgtggccagagagtactacagcgaggccgacgccagccactgcatccagcagatcctggagagcgtgaaccactgccacctgaacggcatcgtgcacagagacctgaagcccgagaacctgctgctggccagcaagagcaagggcgccgccgtgaagctggccgacttcggcctggccatcgaggtgcagggcgaccagcaggcctggttcggcttcgccggcacccccggctacctgagccccgaggtgctgagaaaggacccctacggcaagcccgtggacatgtgggcctgcggcgtgatcctgtacatcctgctggtgggctacccccccttctgggacgaggaccagcacagactgtaccagcagatcaaggccggcgcctacgacttccccagccccgagtgggacaccgtgacccccgaggccaaggacctgatcaacaagatgctgaccatcaaccccgccaagagaatcaccgccagcgaggccctgaagcacccctggatctgccagagaagcaccgtggccagcatgatgcacagacaggagaccgtggactgcctgaagaagttcaacgccagaagaaagctgaagggcgccatcctgaccaccatgctggccaccagaaacttcagcgccgccaagagcctgctgaagaagcccgacggcgtgaagaagagaaagagcagcagcagcgtgcagatgatggagagcaccgagagcagcaacaccaccatcgaggacgaggacgtgaaggccagaaagcaggagatcatcaaggtgaccgagcagctgatcgaggccatcaacaacggcgacttcgaggcctacaccaagatctgcgaccccggcctgaccgccttcgagcccgaggccctgggcaacctggtggagggcatggacttccacagattctacttcgagaacgccctgagcaagagcaacaagcccatccacaccatcatcctgaacccccacgtgcacctggtgggcgacgacgccgcctgcatcgcctacatcagactgacccagtacatggacggcagcggcatgcccaagaccatgcagagcgaggagaccagagtgtggcacagaagagacggcaagtggcagaacgtgcacttccacagaagcggcagccccaccgtgcccatcaagcccccctgcatccccaacggcaaggagaacttcagcggcggcaccagcctgtggcagaacatctag

SEQ ID NO: 75106 - DNA, 1542 bp, Artificial Sequence
  Description of Artificial Sequence: Synthetic coding sequence
atggccagcaccaccacctgcaccagattcaccgacgagtaccagctgttcgaggagctgggcaagggcgccttcagcgtggtgagaagatgcatgaagatccccaccggccaggagtacgccgccaagatcatcaacaccaagaagctgagcgccagagaccaccagaagctggagagagaggccagaatctgcagactgctgaagcaccccaacatcgtgagactgcacgacagcatcagcgaggagggcttccactacctggtgttcgacctggtgaccggcggcgagctgttcgaggacatcgtggccagagagtactacagcgaggccgacgccagccactgcatccagcagatcctggagagcgtgaaccactgccacctgaacggcatcgtgcacagagacctgaagcccgagaacctgctgctggccagcaagagcaagggcgccgccgtgaagctggccgacttcggcctggccatcgaggtgcagggcgaccagcaggcctggttcggcttcgccggcacccccggctacctgagccccgaggtgctgagaaaggacccctacggcaagcccgtggacatgtgggcctgcggcgtgatcctgtacatcctgctggtgggctacccccccttctgggacgaggaccagcacagactgtaccagcagatcaaggccggcgcctacgacttccccagccccgagtgggacaccgtgacccccgaggccaaggacctgatcaacaagatgctgaccatcaaccccgccaagagaatcaccgccagcgaggccctgaagcacccctggatctgccagagaagcaccgtggccagcatgatgcacagacaggagaccgtggactgcctgaagaagttcaacgccagaagaaagctgaagggcgccatcctgaccaccatgctggccaccagaaacttcagcgccgccaagagcctgctgaagaagcccgacggcgtgaaggagccccagaccaccgtgatccacaaccccgacggcaacaaggagagcaccgagagcagcaacaccaccatcgaggacgaggacgtgaaggccagaaagcaggagatcatcaaggtgaccgagcagctgatcgaggccatcaacaacggcgacttcgaggcctacaccaagatctgcgaccccggcctgaccgccttcgagcccgaggccctgggcaacctggtggagggcatggacttccacagattctacttcgagaacgccctgagcaagagcaacaagcccatccacaccatcatcctgaacccccacgtgcacctggtgggcgacgacgccgcctgcatcgcctacatcagactgacccagtacatggacggcagcggcatgcccaagaccatgcagagcgaggagaccagagtgtggcacagaagagacggcaagtggcagaacgtgcacttccacagaagcggcagccccaccgtgcccatcaagcccccctgcatccccaacggcaaggagaacttcagcggcggcaccagcctgtggcagaacatctag

SEQ ID NO: 75107 - DNA, 1560 bp, Artificial Sequence
  Description of Artificial Sequence: Synthetic coding sequence
atggccagcaccaccacctgcaccagattcaccgacgagtaccagctgttcgaggagctgggcaagggcgccttcagcgtggtgagaagatgcatgaagatccccaccggccaggagtacgccgccaagatcatcaacaccaagaagctgagcgccagagaccaccagaagctggagagagaggccagaatctgcagactgctgaagcaccccaacatcgtgagactgcacgacagcatcagcgaggagggcttccactacctggtgttcgacctggtgaccggcggcgagctgttcgaggacatcgtggccagagagtactacagcgaggccgacgccagccactgcatccagcagatcctggagagcgtgaaccactgccacctgaacggcatcgtgcacagagacctgaagcccgagaacctgctgctggccagcaagagcaagggcgccgccgtgaagctggccgacttcggcctggccatcgaggtgcagggcgaccagcaggcctggttcggcttcgccggcacccccggctacctgagccccgaggtgctgagaaaggacccctacggcaagcccgtggacatgtgggcctgcggcgtgatcctgtacatcctgctggtgggctacccccccttctgggacgaggaccagcacagactgtaccagcagatcaaggccggcgcctacgacttccccagccccgagtgggacaccgtgacccccgaggccaaggacctgatcaacaagatgctgaccatcaaccccgccaagagaatcaccgccagcgaggccctgaagcacccctggatctgccagagaagcaccgtggccagcatgatgcacagacaggagaccgtggactgcctgaagaagttcaacgccagaagaaagctgaagggcgccatcctgaccaccatgctggccaccagaaacttcagcgccgccaagagcctgctgaagaagcccgacggcgtgaagatcaacaacaaggccaacgtggtgaccagccccaaggagaacatccccacccccgccctggagagcaccgagagcagcaacaccaccatcgaggacgaggacgtgaaggccagaaagcaggagatcatcaaggtgaccgagcagctgatcgaggccatcaacaacggcgacttcgaggcctacaccaagatctgcgaccccggcctgaccgccttcgagcccgaggccctgggcaacctggtggagggcatggacttccacagattctacttcgagaacgccctgagcaagagcaacaagcccatccacaccatcatcctgaacccccacgtgcacctggtgggcgacgacgccgcctgcatcgcctacatcagactgacccagtacatggacggcagcggcatgcccaagaccatgcagagcgaggagaccagagtgtggcacagaagagacggcaagtggcagaacgtgcacttccacagaagcggcagccccaccgtgcccatcaagcccccctgcatccccaacggcaaggagaacttcagcggcggcaccagcctgtggcagaacatctag

SEQ ID NO: 75108 - DNA, 1575 bp, Artificial Sequence
  Description of Artificial Sequence: Synthetic coding sequence
atggccagcaccaccacctgcaccagattcaccgacgagtaccagctgttcgaggagctgggcaagggcgccttcagcgtggtgagaagatgcatgaagatccccaccggccaggagtacgccgccaagatcatcaacaccaagaagctgagcgccagagaccaccagaagctggagagagaggccagaatctgcagactgctgaagcaccccaacatcgtgagactgcacgacagcatcagcgaggagggcttccactacctggtgttcgacctggtgaccggcggcgagctgttcgaggacatcgtggccagagagtactacagcgaggccgacgccagccactgcatccagcagatcctggagagcgtgaaccactgccacctgaacggcatcgtgcacagagacctgaagcccgagaacctgctgctggccagcaagagcaagggcgccgccgtgaagctggccgacttcggcctggccatcgaggtgcagggcgaccagcaggcctggttcggcttcgccggcacccccggctacctgagccccgaggtgctgagaaaggacccctacggcaagcccgtggacatgtgggcctgcggcgtgatcctgtacatcctgctggtgggctacccccccttctgggacgaggaccagcacagactgtaccagcagatcaaggccggcgcctacgacttccccagccccgagtgggacaccgtgacccccgaggccaaggacctgatcaacaagatgctgaccatcaaccccgccaagagaatcaccgccagcgaggccctgaagcacccctggatctgccagagaagcaccgtggccagcatgatgcacagacaggagaccgtggactgcctgaagaagttcaacgccagaagaaagctgaagggcgccatcctgaccaccatgctggccaccagaaacttcagcgccgccaagagcctgctgaagaagcccgacggcgtgaagaagagaaagagcagcagcagcgtgcagatgatggagccccagaccaccgtgatccacaaccccgacggcaacaaggagagcaccgagagcagcaacaccaccatcgaggacgaggacgtgaaggccagaaagcaggagatcatcaaggtgaccgagcagctgatcgaggccatcaacaacggcgacttcgaggcctacaccaagatctgcgaccccggcctgaccgccttcgagcccgaggccctgggcaacctggtggagggcatggacttccacagattctacttcgagaacgccctgagcaagagcaacaagcccatccacaccatcatcctgaacccccacgtgcacctggtgggcgacgacgccgcctgcatcgcctacatcagactgacccagtacatggacggcagcggcatgcccaagaccatgcagagcgaggagaccagagtgtggcacagaagagacggcaagtggcagaacgtgcacttccacagaagcggcagccccaccgtgcccatcaagcccccctgcatccccaacggcaaggagaacttcagcggcggcaccagcctgtggcagaacatctag

SEQ ID NO: 75109 - DNA, 1470 bp, Artificial Sequence
  Description of Artificial Sequence: Synthetic coding sequence
atggccagcaccaccacctgcaccagattcaccgacgagtaccagctgttcgaggagctgggcaagggcgccttcagcgtggtgagaagatgcatgaagatccccaccggccaggagtacgccgccaagatcatcaacaccaagaagctgagcgccagagaccaccagaagctggagagagaggccagaatctgcagactgctgaagcaccccaacatcgtgagactgcacgacagcatcagcgaggagggcttccactacctggtgttcgacctggtgaccggcggcgagctgttcgaggacatcgtggccagagagtactacagcgaggccgacgccagccactgcatccagcagatcctggagagcgtgaaccactgccacctgaacggcatcgtgcacagagacctgaagcccgagaacctgctgctggccagcaagagcaagggcgccgccgtgaagctggccgacttcggcctggccatcgaggtgcagggcgaccagcaggcctggttcggcttcgccggcacccccggctacctgagccccgaggtgctgagaaaggacccctacggcaagcccgtggacatgtgggcctgcggcgtgatcctgtacatcctgctggtgggctacccccccttctgggacgaggaccagcacagactgtaccagcagatcaaggccggcgcctacgacttccccagccccgagtgggacaccgtgacccccgaggccaaggacctgatcaacaagatgctgaccatcaaccccgccaagagaatcaccgccagcgaggccctgaagcacccctggatctgccagagaagcaccgtggccagcatgatgcacagacaggagaccgtggactgcctgaagaagttcaacgccagaagaaagctgaagggcgccatcctgaccaccatgctggccaccagaaacttcagcgccgccaagagcctgctgaagaagcccgacggcgtgaagaagagaaagagcagcagcagcgtgcagatgatggagagcaccgagagcagcaacaccaccatcgaggacgaggacgtgaaggccagaaagcaggagatcatcaaggtgaccgagcagctgatcgaggccatcaacaacggcgacttcgaggcctacaccaagatctgcgaccccggcctgaccgccttcgagcccgaggccctgggcaacctggtggagggcatggacttccacagattctacttcgagaacgccctgagcaagagcaacaagcccatccacaccatcatcctgaacccccacgtgcacctggtgggcgacgacgccgcctgcatcgcctacatcagactgacccagtacatggacggcagcggcatgcccaagaccatgcagagcgaggagaccagagtgtggcacagaagagacggcaagtggcagaacgtgcacttccacagaagcggcagccccaccgtgcccatcaagtag

SEQ ID NO: 75110 - DNA, 549 bp, Artificial Sequence
  Description of Artificial Sequence: Synthetic coding sequence
tgaagaaagctgaagggcgccatcctgaccaccatgctggccaccagaaacttcagcgccgccaagagcctgctgaagaagcccgacggcgtgaaggagagcaccgagagcagcaacaccaccatcgaggacgaggacgtgaaggccagaaagcaggagatcatcaaggtgaccgagcagctgatcgaggccatcaacaacggcgacttcgaggcctacaccaagatctgcgaccccggcctgaccgccttcgagcccgaggccctgggcaacctggtggagggcatggacttccacagattctacttcgagaacgccctgagcaagagcaacaagcccatccacaccatcatcctgaacccccacgtgcacctggtgggcgacgacgccgcctgcatcgcctacatcagactgacccagtacatggacggcagcggcatgcccaagaccatgcagagcgaggagaccagagtgtggcacagaagagacggcaagtggcagaacgtgcacttccacagaagcggcagccccaccgtgcccatcaagtag

SEQ ID NO: 75111 - DNA, 1437 bp, Artificial Sequence
  Description of Artificial Sequence: Synthetic coding sequence
atggccagcaccaccacctgcaccagattcaccgacgagtaccagctgttcgaggagctgggcaagggcgccttcagcgtggtgagaagatgcatgaagatccccaccggccaggagtacgccgccaagatcatcaacaccaagaagctgagcgccagagaccaccagaagctggagagagaggccagaatctgcagactgctgaagcaccccaacatcgtgagactgcacgacagcatcagcgaggagggcttccactacctggtgttcgacctggtgaccggcggcgagctgttcgaggacatcgtggccagagagtactacagcgaggccgacgccagccactgcatccagcagatcctggagagcgtgaaccactgccacctgaacggcatcgtgcacagagacctgaagcccgagaacctgctgctggccagcaagagcaagggcgccgccgtgaagctggccgacttcggcctggccatcgaggtgcagggcgaccagcaggcctggttcggcttcgccggcacccccggctacctgagccccgaggtgctgagaaaggacccctacggcaagcccgtggacatgtgggcctgcggcgtgatcctgtacatcctgctggtgggctacccccccttctgggacgaggaccagcacagactgtaccagcagatcaaggccggcgcctacgacttccccagccccgagtgggacaccgtgacccccgaggccaaggacctgatcaacaagatgctgaccatcaaccccgccaagagaatcaccgccagcgaggccctgaagcacccctggatctgccagagaagcaccgtggccagcatgatgcacagacaggagaccgtggactgcctgaagaagttcaacgccagaagaaagctgaagggcgccatcctgaccaccatgctggccaccagaaacttcagcgccgccaagagcctgctgaagaagcccgacggcgtgaaggagagcaccgagagcagcaacaccaccatcgaggacgaggacgtgaaggccagaaagcaggagatcatcaaggtgaccgagcagctgatcgaggccatcaacaacggcgacttcgaggcctacaccaagatctgcgaccccggcctgaccgccttcgagcccgaggccctgggcaacctggtggagggcatggacttccacagattctacttcgagaacgccctgagcaagagcaacaagcccatccacaccatcatcctgaacccccacgtgcacctggtgggcgacgacgccgcctgcatcgcctacatcagactgacccagtacatggacggcagcggcatgcccaagaccatgcagagcgaggagaccagagtgtggcacagaagagacggcaagtggcagaacgtgcacttccacagaagcggcagccccaccgtgcccatcaactag

SEQ ID NO: 75112 - DNA, 1590 bp, Artificial Sequence
  Description of Artificial Sequence: Synthetic coding sequence
atggccaccaccgccacctgcaccagattcaccgacgactaccagctgttcgaggagctgggcaagggcgccttcagcgtggtgagaagatgcgtgaagaagaccagcacccaggagtacgccgccaagatcatcaacaccaagaagctgagcgccagagaccaccagaagctggagagagaggccagaatctgcagactgctgaagcaccccaacatcgtgagactgcacgacagcatcagcgaggagggcttccactacctggtgttcgacctggtgaccggcggcgagctgttcgaggacatcgtggccagagagtactacagcgaggccgacgccagccactgcatccaccagatcctggagagcgtgaaccacatccaccagcacgacatcgtgcacagagacctgaagcccgagaacctgctgctggccagcaagtgcaagggcgccgccgtgaagctggccgacttcggcctggccatcgaggtgcagggcgagcagcaggcctggttcggcttcgccggcacccccggctacctgagccccgaggtgctgagaaaggacccctacggcaagcccgtggacatctgggcctgcggcgtgatcctgtacatcctgctggtgggctacccccccttctgggacgaggaccagcacaagctgtaccagcagatcaaggccggcgcctacgacttccccagccccgagtgggacaccgtgacccccgaggccaagaacctgatcaaccagatgctgaccatcaaccccgccaagagaatcaccgccgaccaggccctgaagcacccctgggtgtgccagagaagcaccgtggccagcatgatgcacagacaggagaccgtggagtgcctgagaaagttcaacgccagaagaaagctgaagggcgccatcctgaccaccatgctggtgagcagaaacttcagcgccgccaagagcctgctgaacaagaagagcgacggcggcgtgaagaagagaaagagcagcagcagcgtgcacctgatgccccagagcaacaacaagaacagcctggtgagccccgcccaggagcccgcccccctgcagaccgccatggagccccagaccaccgtggtgcacaacgccaccgacggcatcaagggcagcaccgagagctgcaacaccaccaccgaggacgaggacctgaaggtgagaaagcaggagatcatcaagatcaccgagcagctgatcgaggccatcaacaacggcgacttcgaggcctacaccaagatctgcgaccccggcctgaccagcttcgagcccgaggccctgggcaacctggtggagggcatggacttccacaagttctacttcgagaacctgctgagcaagaacagcaagcccatccacaccaccatcctgaacccccacgtgcacgtgatcggcgaggacgccgcctgcatcgcctacatcagactgacccagtacatcgacggccagggcagacccagaaccagccagagcgaggagaccagagtgtggcacagaagagacggcaagtggctgaacgtgcactaccactgcagcggcgcccccgccgcccccctgcagtag

SEQ ID NO: 75113 - DNA, 1584 bp, Artificial Sequence
  Description of Artificial Sequence: Synthetic coding sequence
atggccaccaccgccacctgcaccagattcaccgacgactaccagctgttcgaggagctgggcaagggcgccttcagcgtggtgagaagatgcgtgaagaagaccagcacccaggagtacgccgccaagatcatcaacaccaagaagctgagcgccagagaccaccagaagctggagagagaggccagaatctgcagactgctgaagcaccccaacatcgtgagactgcacgacagcatcagcgaggagggcttccactacctggtgttcgacctggtgaccggcggcgagctgttcgaggacatcgtggccagagagtactacagcgaggccgacgccagccactgcatccaccagatcctggagagcgtgaaccacatccaccagcacgacatcgtgcacagagacctgaagcccgagaacctgctgctggccagcaagtgcaagggcgccgccgtgaagctggccgacttcggcctggccatcgaggtgcagggcgagcagcaggcctggttcggcttcgccggcacccccggctacctgagccccgaggtgctgagaaaggacccctacggcaagcccgtggacatctgggcctgcggcgtgatcctgtacatcctgctggtgggctacccccccttctgggacgaggaccagcacaagctgtaccagcagatcaaggccggcgcctacgacttccccagccccgagtgggacaccgtgacccccgaggccaagaacctgatcaaccagatgctgaccatcaaccccgccaagagaatcaccgccgaccaggccctgaagcacccctgggtgtgccagagaagcaccgtggccagcatgatgcacagacaggagaccgtggagtgcctgagaaagttcaacgccagaagaaagctgaagggcgccatcctgaccaccatgctggtgagcagaaacttcagcgtgggcagacagagcagcgcccccgccagccccgccgccagcgccgccggcctggccggccaggccgccaagagcctgctgaacaagaagagcgacggcggcgtgaagaagagaaagagcagcagcagcgtgcacctgatggagccccagaccaccgtggtgcacaacgccaccgacggcatcaagggcagcaccgagagctgcaacaccaccaccgaggacgaggacctgaaggtgagaaagcaggagatcatcaagatcaccgagcagctgatcgaggccatcaacaacggcgacttcgaggcctacaccaagatctgcgaccccggcctgaccagcttcgagcccgaggccctgggcaacctggtggagggcatggacttccacaagttctacttcgagaacctgctgagcaagaacagcaagcccatccacaccaccatcctgaacccccacgtgcacgtgatcggcgaggacgccgcctgcatcgcctacatcagactgacccagtacatcgacggccagggcagacccagaaccagccagagcgaggagaccagagtgtggcacagaagagacggcaagtggctgaacgtgcactaccactgcagcggcgcccccgccgcccccctgcagtag

SEQ ID NO: 75114 - DNA, 1671 bp, Artificial Sequence
  Description of Artificial Sequence: Synthetic coding sequence
atggccaccaccgccacctgcaccagattcaccgacgactaccagctgttcgaggagctgggcaagggcgccttcagcgtggtgagaagatgcgtgaagaagaccagcacccaggagtacgccgccaagatcatcaacaccaagaagctgagcgccagagaccaccagaagctggagagagaggccagaatctgcagactgctgaagcaccccaacatcgtgagactgcacgacagcatcagcgaggagggcttccactacctggtgttcgacctggtgaccggcggcgagctgttcgaggacatcgtggccagagagtactacagcgaggccgacgccagccactgcatccaccagatcctggagagcgtgaaccacatccaccagcacgacatcgtgcacagagacctgaagcccgagaacctgctgctggccagcaagtgcaagggcgccgccgtgaagctggccgacttcggcctggccatcgaggtgcagggcgagcagcaggcctggttcggcttcgccggcacccccggctacctgagccccgaggtgctgagaaaggacccctacggcaagcccgtggacatctgggcctgcggcgtgatcctgtacatcctgctggtgggctacccccccttctgggacgaggaccagcacaagctgtaccagcagatcaaggccggcgcctacgacttccccagccccgagtgggacaccgtgacccccgaggccaagaacctgatcaaccagatgctgaccatcaaccccgccaagagaatcaccgccgaccaggccctgaagcacccctgggtgtgccagagaagcaccgtggccagcatgatgcacagacaggagaccgtggagtgcctgagaaagttcaacgccagaagaaagctgaagggcgccatcctgaccaccatgctggtgagcagaaacttcagcgccgccaagagcctgctgaacaagaagagcgacggcggcgtgaagccccagagcaacaacaagaacagcctggtgagccccgcccaggagcccgcccccctgcagaccgccatggagccccagaccaccgtggtgcacaacgccaccgacggcatcaagggcagcaccgagagctgcaacaccaccaccgaggacgaggacctgaaggccgcccccctgagaaccggcaacggcagcagcgtgcccgagggcagaagcagcagagacagaaccgcccccagcgccggcatgcagccccagcccagcctgtgcagcagcgccatgagaaagcaggagatcatcaagatcaccgagcagctgatcgaggccatcaacaacggcgacttcgaggcctacaccaagatctgcgaccccggcctgaccagcttcgagcccgaggccctgggcaacctggtggagggcatggacttccacaagttctacttcgagaacctgctgagcaagaacagcaagcccatccacaccaccatcctgaacccccacgtgcacgtgatcggcgaggacgccgcctgcatcgcctacatcagactgacccagtacatcgacggccagggcagacccagaaccagccagagcgaggagaccagagtgtggcacagaagagacggcaagtggctgaacgtgcactaccactgcagcggcgcccccgccgcccccctgcagtag

SEQ ID NO: 75115 - DNA, 1488 bp, Artificial Sequence
  Description of Artificial Sequence: Synthetic coding sequence
atggccaccaccgccacctgcaccagattcaccgacgactaccagctgttcgaggagctgggcaagggcgccttcagcgtggtgagaagatgcgtgaagaagaccagcacccaggagtacgccgccaagatcatcaacaccaagaagctgagcgccagagaccaccagaagctggagagagaggccagaatctgcagactgctgaagcaccccaacatcgtgagactgcacgacagcatcagcgaggagggcttccactacctggtgttcgacctggtgaccggcggcgagctgttcgaggacatcgtggccagagagtactacagcgaggccgacgccagccactgcatccaccagatcctggagagcgtgaaccacatccaccagcacgacatcgtgcacagagacctgaagcccgagaacctgctgctggccagcaagtgcaagggcgccgccgtgaagctggccgacttcggcctggccatcgaggtgcagggcgagcagcaggcctggttcggcttcgccggcacccccggctacctgagccccgaggtgctgagaaaggacccctacggcaagcccgtggacatctgggcctgcggcgtgatcctgtacatcctgctggtgggctacccccccttctgggacgaggaccagcacaagctgtaccagcagatcaaggccggcgcctacgacttccccagccccgagtgggacaccgtgacccccgaggccaagaacctgatcaaccagatgctgaccatcaaccccgccaagagaatcaccgccgaccaggccctgaagcacccctgggtgtgccagagaagcaccgtggccagcatgatgcacagacaggagaccgtggagtgcctgagaaagttcaacgccagaagaaagctgaagggcgccatcctgaccaccatgctggtgagcagaaacttcagcgccgccaagagcctgctgaacaagaagagcgacggcggcgtgaaggagccccagaccaccgtggtgcacaacgccaccgacggcatcaagggcagcaccgagagctgcaacaccaccaccgaggacgaggacctgaaggtgagaaagcaggagatcatcaagatcaccgagcagctgatcgaggccatcaacaacggcgacttcgaggcctacaccaagatctgcgaccccggcctgaccagcttcgagcccgaggccctgggcaacctggtggagggcatggacttccacaagttctacttcgagaacctgctgagcaagaacagcaagcccatccacaccaccatcctgaacccccacgtgcacgtgatcggcgaggacgccgcctgcatcgcctacatcagactgacccagtacatcgacggccagggcagacccagaaccagccagagcgaggagaccagagtgtggcacagaagagacggcaagtggctgaacgtgcactaccactgcagcggcgcccccgccgcccccctgcagtag

SEQ ID NO: 75116 - DNA, 1551 bp, Artificial Sequence
  Description of Artificial Sequence: Synthetic coding sequence
atggccaccaccgccacctgcaccagattcaccgacgactaccagctgttcgaggagctgggcaagggcgccttcagcgtggtgagaagatgcgtgaagaagaccagcacccaggagtacgccgccaagatcatcaacaccaagaagctgagcgccagagaccaccagaagctggagagagaggccagaatctgcagactgctgaagcaccccaacatcgtgagactgcacgacagcatcagcgaggagggcttccactacctggtgttcgacctggtgaccggcggcgagctgttcgaggacatcgtggccagagagtactacagcgaggccgacgccagccactgcatccaccagatcctggagagcgtgaaccacatccaccagcacgacatcgtgcacagagacctgaagcccgagaacctgctgctggccagcaagtgcaagggcgccgccgtgaagctggccgacttcggcctggccatcgaggtgcagggcgagcagcaggcctggttcggcttcgccggcacccccggctacctgagccccgaggtgctgagaaaggacccctacggcaagcccgtggacatctgggcctgcggcgtgatcctgtacatcctgctggtgggctacccccccttctgggacgaggaccagcacaagctgtaccagcagatcaaggccggcgcctacgacttccccagccccgagtgggacaccgtgacccccgaggccaagaacctgatcaaccagatgctgaccatcaaccccgccaagagaatcaccgccgaccaggccctgaagcacccctgggtgtgccagagaagcaccgtggccagcatgatgcacagacaggagaccgtggagtgcctgagaaagttcaacgccagaagaaagctgaagggcgccatcctgaccaccatgctggtgagcagaaacttcagcgtgggcagacagagcagcgcccccgccagccccgccgccagcgccgccggcctggccggccaggccgccaagagcctgctgaacaagaagagcgacggcggcgtgaaggagccccagaccaccgtggtgcacaacgccaccgacggcatcaagggcagcaccgagagctgcaacaccaccaccgaggacgaggacctgaaggtgagaaagcaggagatcatcaagatcaccgagcagctgatcgaggccatcaacaacggcgacttcgaggcctacaccaagatctgcgaccccggcctgaccagcttcgagcccgaggccctgggcaacctggtggagggcatggacttccacaagttctacttcgagaacctgctgagcaagaacagcaagcccatccacaccaccatcctgaacccccacgtgcacgtgatcggcgaggacgccgcctgcatcgcctacatcagactgacccagtacatcgacggccagggcagacccagaaccagccagagcgaggagaccagagtgtggcacagaagagacggcaagtggctgaacgtgcactaccactgcagcggcgcccccgccgcccccctgcagtag

SEQ ID NO: 75117 - DNA, 1602 bp, Artificial Sequence
  Description of Artificial Sequence: Synthetic coding sequence
atggccaccaccgccacctgcaccagattcaccgacgactaccagctgttcgaggagctgggcaagggcgccttcagcgtggtgagaagatgcgtgaagaagaccagcacccaggagtacgccgccaagatcatcaacaccaagaagctgagcgccagagaccaccagaagctggagagagaggccagaatctgcagactgctgaagcaccccaacatcgtgagactgcacgacagcatcagcgaggagggcttccactacctggtgttcgacctggtgaccggcggcgagctgttcgaggacatcgtggccagagagtactacagcgaggccgacgccagccactgcatccaccagatcctggagagcgtgaaccacatccaccagcacgacatcgtgcacagagacctgaagcccgagaacctgctgctggccagcaagtgcaagggcgccgccgtgaagctggccgacttcggcctggccatcgaggtgcagggcgagcagcaggcctggttcggcttcgccggcacccccggctacctgagccccgaggtgctgagaaaggacccctacggcaagcccgtggacatctgggcctgcggcgtgatcctgtacatcctgctggtgggctacccccccttctgggacgaggaccagcacaagctgtaccagcagatcaaggccggcgcctacgacttccccagccccgagtgggacaccgtgacccccgaggccaagaacctgatcaaccagatgctgaccatcaaccccgccaagagaatcaccgccgaccaggccctgaagcacccctgggtgtgccagagaagcaccgtggccagcatgatgcacagacaggagaccgtggagtgcctgagaaagttcaacgccagaagaaagctgaagggcgccatcctgaccaccatgctggtgagcagaaacttcagcgccgccaagagcctgctgaacaagaagagcgacggcggcgtgaaggagccccagaccaccgtggtgcacaacgccaccgacggcatcaagggcagcaccgagagctgcaacaccaccaccgaggacgaggacctgaaggccgcccccctgagaaccggcaacggcagcagcgtgcccgagggcagaagcagcagagacagaaccgcccccagcgccggcatgcagccccagcccagcctgtgcagcagcgccatgagaaagcaggagatcatcaagatcaccgagcagctgatcgaggccatcaacaacggcgacttcgaggcctacaccaagatctgcgaccccggcctgaccagcttcgagcccgaggccctgggcaacctggtggagggcatggacttccacaagttctacttcgagaacctgctgagcaagaacagcaagcccatccacaccaccatcctgaacccccacgtgcacgtgatcggcgaggacgccgcctgcatcgcctacatcagactgacccagtacatcgacggccagggcagacccagaaccagccagagcgaggagaccagagtgtggcacagaagagacggcaagtggctgaacgtgcactaccactgcagcggcgcccccgccgcccccctgcagtag

SEQ ID NO: 75118 - DNA, 1677 bp, Artificial Sequence
  Description of Artificial Sequence: Synthetic coding sequence
atggccaccaccgccacctgcaccagattcaccgacgactaccagctgttcgaggagctgggcaagggcgccttcagcgtggtgagaagatgcgtgaagaagaccagcacccaggagtacgccgccaagatcatcaacaccaagaagctgagcgccagagaccaccagaagctggagagagaggccagaatctgcagactgctgaagcaccccaacatcgtgagactgcacgacagcatcagcgaggagggcttccactacctggtgttcgacctggtgaccggcggcgagctgttcgaggacatcgtggccagagagtactacagcgaggccgacgccagccactgcatccaccagatcctggagagcgtgaaccacatccaccagcacgacatcgtgcacagagacctgaagcccgagaacctgctgctggccagcaagtgcaagggcgccgccgtgaagctggccgacttcggcctggccatcgaggtgcagggcgagcagcaggcctggttcggcttcgccggcacccccggctacctgagccccgaggtgctgagaaaggacccctacggcaagcccgtggacatctgggcctgcggcgtgatcctgtacatcctgctggtgggctacccccccttctgggacgaggaccagcacaagctgtaccagcagatcaaggccggcgcctacgacttccccagccccgagtgggacaccgtgacccccgaggccaagaacctgatcaaccagatgctgaccatcaaccccgccaagagaatcaccgccgaccaggccctgaagcacccctgggtgtgccagagaagcaccgtggccagcatgatgcacagacaggagaccgtggagtgcctgagaaagttcaacgccagaagaaagctgaagggcgccatcctgaccaccatgctggtgagcagaaacttcagcgccgccaagagcctgctgaacaagaagagcgacggcggcgtgaagaagagaaagagcagcagcagcgtgcacctgatgccccagagcaacaacaagaacagcctggtgagccccgcccaggagcccgcccccctgcagaccgccatggagccccagaccaccgtggtgcacaacgccaccgacggcatcaagggcagcaccgagagctgcaacaccaccaccgaggacgaggacctgaagggcagcgtgcccgagggcagaagcagcagagacagaaccgcccccagcgccggcatgcagccccagcccagcctgtgcagcagcgccatgagaaagcaggagatcatcaagatcaccgagcagctgatcgaggccatcaacaacggcgacttcgaggcctacaccaagatctgcgaccccggcctgaccagcttcgagcccgaggccctgggcaacctggtggagggcatggacttccacaagttctacttcgagaacctgctgagcaagaacagcaagcccatccacaccaccatcctgaacccccacgtgcacgtgatcggcgaggacgccgcctgcatcgcctacatcagactgacccagtacatcgacggccagggcagacccagaaccagccagagcgaggagaccagagtgtggcacagaagagacggcaagtggctgaacgtgcactaccactgcagcggcgcccccgccgcccccctgcagtag

SEQ ID NO: 75119 - DNA, 1767 bp, Artificial Sequence
  Description of Artificial Sequence: Synthetic coding sequence
atggccaccaccgccacctgcaccagattcaccgacgactaccagctgttcgaggagctgggcaagggcgccttcagcgtggtgagaagatgcgtgaagaagaccagcacccaggagtacgccgccaagatcatcaacaccaagaagctgagcgccagagaccaccagaagctggagagagaggccagaatctgcagactgctgaagcaccccaacatcgtgagactgcacgacagcatcagcgaggagggcttccactacctggtgttcgacctggtgaccggcggcgagctgttcgaggacatcgtggccagagagtactacagcgaggccgacgccagccactgcatccaccagatcctggagagcgtgaaccacatccaccagcacgacatcgtgcacagagacctgaagcccgagaacctgctgctggccagcaagtgcaagggcgccgccgtgaagctggccgacttcggcctggccatcgaggtgcagggcgagcagcaggcctggttcggcttcgccggcacccccggctacctgagccccgaggtgctgagaaaggacccctacggcaagcccgtggacatctgggcctgcggcgtgatcctgtacatcctgctggtgggctacccccccttctgggacgaggaccagcacaagctgtaccagcagatcaaggccggcgcctacgacttccccagccccgagtgggacaccgtgacccccgaggccaagaacctgatcaaccagatgctgaccatcaaccccgccaagagaatcaccgccgaccaggccctgaagcacccctgggtgtgccagagaagcaccgtggccagcatgatgcacagacaggagaccgtggagtgcctgagaaagttcaacgccagaagaaagctgaagggcgccatcctgaccaccatgctggtgagcagaaacttcagcgtgggcagacagagcagcgcccccgccagccccgccgccagcgccgccggcctggccggccaggccgccaagagcctgctgaacaagaagagcgacggcggcgtgaagaagagaaagagcagcagcagcgtgcacctgatgccccagagcaacaacaagaacagcctggtgagccccgcccaggagcccgcccccctgcagaccgccatggagccccagaccaccgtggtgcacaacgccaccgacggcatcaagggcagcaccgagagctgcaacaccaccaccgaggacgaggacctgaaggccgcccccctgagaaccggcaacggcagcagcgtgcccgagggcagaagcagcagagacagaaccgcccccagcgccggcatgcagccccagcccagcctgtgcagcagcgccatgagaaagcaggagatcatcaagatcaccgagcagctgatcgaggccatcaacaacggcgacttcgaggcctacaccaagatctgcgaccccggcctgaccagcttcgagcccgaggccctgggcaacctggtggagggcatggacttccacaagttctacttcgagaacctgctgagcaagaacagcaagcccatccacaccaccatcctgaacccccacgtgcacgtgatcggcgaggacgccgcctgcatcgcctacatcagactgacccagtacatcgacggccagggcagacccagaaccagccagagcgaggagaccagagtgtggcacagaagagacggcaagtggctgaacgtgcactaccactgcagcggcgcccccgccgcccccctgcagtag

SEQ ID NO: 75120 - DNA, 1362 bp, Artificial Sequence
  Description of Artificial Sequence: Synthetic coding sequence
agactgctgaagcaccccaacatcgtgagactgcacgacagcatcagcgaggagggcttccactacctggtgttcgacctggtgaccggcggcgagctgttcgaggacatcgtggccagagagtactacagcgaggccgacgccagccactgcatccaccagatcctggagagcgtgaaccacatccaccagcacgacatcgtgcacagagacctgaagcccgagaacctgctgctggccagcaagtgcaagggcgccgccgtgaagctggccgacttcggcctggccatcgaggtgcagggcgagcagcaggcctggttcggcttcgccggcacccccggctacctgagccccgaggtgctgagaaaggacccctacggcaagcccgtggacatctgggcctgcggcgtgatcctgtacatcctgctggtgggctacccccccttctgggacgaggaccagcacaagctgtaccagcagatcaaggccggcgcctacgacttccccagccccgagtgggacaccgtgacccccgaggccaagaacctgatcaaccagatgctgaccatcaaccccgccaagagaatcaccgccgaccaggccctgaagcacccctgggtgtgccagagaagcaccgtggccagcatgatgcacagacaggagaccgtggagtgcctgagaaagttcaacgccagaagaaagctgaagggcgccatcctgaccaccatgctggtgagcagaaacttcagcgccgccaagagcctgctgaacaagaagagcgacggcggcgtgaagccccagagcaacaacaagaacagcctggtgagccccgcccaggagcccgcccccctgcagaccgccatggagccccagaccaccgtggtgcacaacgccaccgacggcatcaagggcagcaccgagagctgcaacaccaccaccgaggacgaggacctgaaggtgagaaagcaggagatcatcaagatcaccgagcagctgatcgaggccatcaacaacggcgacttcgaggcctacaccaagatctgcgaccccggcctgaccagcttcgagcccgaggccctgggcaacctggtggagggcatggacttccacaagttctacttcgagaacctgctgagcaagaacagcaagcccatccacaccaccatcctgaacccccacgtgcacgtgatcggcgaggacgccgcctgcatcgcctacatcagactgacccagtacatcgacggccagggcagacccagaaccagccagagcgaggagaccagagtgtggcacagaagagacggcaagtggctgaacgtgcactaccactgcagcggcgcccccgccgcccccctgcagtag

SEQ ID NO: 75121 - DNA, 1008 bp, Artificial Sequence
  Description of Artificial Sequence: Synthetic coding sequence
tgataccagcagatcaaggccggcgcctacgacttccccagccccgagtgggacaccgtgacccccgaggccaagaacctgatcaaccagatgctgaccatcaaccccgccaagagaatcaccgccgaccaggccctgaagcacccctgggtgtgccagagaagcaccgtggccagcatgatgcacagacaggagaccgtggagtgcctgagaaagttcaacgccagaagaaagctgaagggcgccatcctgaccaccatgctggtgagcagaaacttcagcgccgccaagagcctgctgaacaagaagagcgacggcggcgtgaagccccagagcaacaacaagaacagcctggtgagccccgcccaggagcccgcccccctgcagaccgccatggagccccagaccaccgtggtgcacaacgccaccgacggcatcaagggcagcaccgagagctgcaacaccaccaccgaggacgaggacctgaaggccgcccccctgagaaccggcaacggcagcagcgtgcccgagggcagaagcagcagagacagaaccgcccccagcgccggcatgcagccccagcccagcctgtgcagcagcgccatgagaaagcaggagatcatcaagatcaccgagcagctgatcgaggccatcaacaacggcgacttcgaggcctacaccaagatctgcgaccccggcctgaccagcttcgagcccgaggccctgggcaacctggtggagggcatggacttccacaagttctacttcgagaacctgctgagcaagaacagcaagcccatccacaccaccatcctgaacccccacgtgcacgtgatcggcgaggacgccgcctgcatcgcctacatcagactgacccagtacatcgacggccagggcagacccagaaccagccagagcgaggagaccagagtgtggcacagaagagacggcaagtggctgaacgtgcactaccactgcagcggcgcccccgccgcccccctgcagtag

SEQ ID NO: 75122 - DNA, 543 bp, Artificial Sequence
  Description of Artificial Sequence: Synthetic coding sequence
atggccaccaccgccacctgcaccagattcaccgacgactaccagctgttcgaggagctgggcaagggcgccttcagcgtggtgagaagatgcgtgaagaagaccagcacccaggagtacgccgccaagatcatcaacaccaagaagctgagcgccagagaccaccagaagctggagagagaggccagaatctgcagactgctgaagcaccccaacatcgccaccatccacggcggcatccacgacgccagcagcggcgactgcggcgtgttcgcccaggtgcagtgccccgagaagaccgagggctgccacccccacgaccacgcctgcctgcaggagctgctgagctgccagaagcccatcgagcaggaggtgggctggagatgccaggccaccgagcagcagcagaagcagagcagaaagcccagccccagagccagagccctggccgacggccacggcgccaccaaccactgcggcacccagagatacagatgggaccagggcctgcacagagagctgcagcaccaccacagaagatag

SEQ ID NO: 75123 - DNA, 240 bp, Artificial Sequence
  Description of Artificial Sequence: Synthetic coding sequence
atgagcgagatcctgccctacagcgaggacaagatgggcagattcggcgccgaccccgagggcagcgacctgagcttcagctgcagactgcaggacaccaacagcttcttcgccggcaaccaggccaagagaccccccaagctgggccagatcggcagagccaagagagtggtgatcgaggacgacagaatcgacgacgtgctgaagggcatgggcgagaagccccccagcggcgtgtag

SEQ ID NO: 75124 - DNA, 1422 bp, Artificial Sequence
  Description of Artificial Sequence: Synthetic coding sequence
atgctgaaggtgaccgtgcccagctgcagcgccagcagctgcagcagcgtgaccgccagcgccgcccccggcaccgccagcctggtgcccgactactggatcgacggcagcaacagagacgccctgagcgacttcttcgaggtggagagcgagctgggcagaggcgccaccagcatcgtgtacagatgcaagcagaagggcacccagaagccctacgccctgaaggtgctgaagaagaccgtggacaagaagatcgtgagaaccgagatcggcgtgctgctgagactgagccaccccaacatcatcaagctgaaggagatcttcgagacccccaccgagatcagcctggtgctggagctggtgaccggcggcgagctgttcgacagaatcgtggagaagggctactacagcgagagagacgccgccgacgccgtgaagcagatcctggaggccgtggcctacctgcacgagaacggcatcgtgcacagagacctgaagcccgagaacctgctgtacgccacccccgcccccgacgcccccctgaagatcgccgacttcggcctgagcaagatcgtggagcaccaggtgctgatgaagaccgtgtgcggcacccccggctactgcgcccccgagatcctgagaggctgcgcctacggccccgaggtggacatgtggagcgtgggcatcatcacctacatcctgctgtgcggcttcgagcccttctacgacgagagaggcgaccagttcatgttcagaagaatcctgaactgcgagtactacttcatcagcccctggtgggacgaggtgagcctgaacgccaaggacctggtgagaaagctgatcgtgctggaccccaagaagagactgaccaccttccaggccctgcagcacccctgggtgaccggcaaggccgccaacttcgtgcacatggacaccgcccagaagaagctgcaggagttcaacgccagaagaaagctgaaggccgccgtgaaggccgtggtggccagcagcagactgggcagcgccagcagcagccacggcagcatccaggagagccacaaggccagcagagaccccagccccatccaggacggcaacgaggacatgaaggccatccccgagggcgagaagatccagggcgacggcgcccaggccgccgtgaagggcgcccaggccgagctgatgaaggtgcaggccctggagaaggtgaagggcgccgacatcaacgccgaggaggcccccaagatggtgcccaaggccgtggaggacggcatcaaggtggccgacctggagctggaggagggcctggccgaggagaagctgaagaccgtggaggaggccgccgcccccagagagggccagggcagcagcgccgtgggcttcgaggtgccccagcaggacgtgatcctgcccgagtactag

SEQ ID NO: 75125 - DNA, 429 bp, Artificial Sequence
  Description of Artificial Sequence: Synthetic coding sequence
atgctgaaggtgaccgtgcccagctgcagcgccagcagctgcagcagcgtgaccgccagcgccgcccccggcaccgccagcctggtgcccgactactggatcgacggcagcaacagagacgccctgagcgacttcttcgaggtggagagcgagctgggcagaggcgccaccagcatcgtgtacagatgcaagcagaagggcacccagaagccctacgccctgaaggtgctgaagaagaccgtggacaagaagatcgtgagaaccgagatcggcgtgctgctgagactgagccaccccaacatcatcaagctgaaggagatcttcgagacccccaccgagatcagcctggtgctggagctggtgaccggcggcgagctgttcgacagaatcgtggagaagggctactacagcgagagagacgccgcctag

SEQ ID NO: 75126 - DNA, 1422 bp, Artificial Sequence; identical to SEQ ID NO: 75124
  Description of Artificial Sequence: Synthetic coding sequence

SEQ ID NO: 75127 - DNA, 2766 bp, Artificial Sequence
  Description of Artificial Sequence: Synthetic coding sequence
atggccgacgacgacgtgctgttcgaggacgtgtacgagctgtgcgaggtgatcggcaagggccccttcagcgtggtgagaagatgcatcaacagagagaccggccagcagttcgccgtgaagatcgtggacgtggccaagttcaccagcagccccggcctgagcaccgaggacctgaagagagaggccagcatctgccacatgctgaagcacccccacatcgtggagctgctggagacctacagcagcgacggcatgctgtacatggtgttcgagttcatggacggcgccgacctgtgcttcgagatcgtgaagagagccgacgccggcttcgtgtacagcgaggccgtggccagccactacatgagacagatcctggaggccctgagatactgccacgacaacaacatcatccacagagacgtgaagccccactgcgtgctgctggccagcaaggagaacagcgcccccgtgaagctgggcggcttcggcgtggccatccagctgggcgagagcggcctggtggccggcggcagagtgggcaccccccacttcatggcccccgaggtggtgaagagagagccctacggcaagcccgtggacgtgtggggctgcggcgtgatcctgttcatcctgctgagcggctgcctgcccttctacggcaccaaggagagactgttcgagggcatcatcaagggcaagtacaagatgaaccccagacagtggagccacatcagcgagagcgccaaggacctggtgagaagaatgctgatgctggaccccgccgagagaatcaccgtgtacgaggccctgaaccacccctggctgaaggagagagacagatacgcctacaagatccacctgcccgagaccgtggagcagctgagaaagttcaacgccagaagaaagctgaagggcgccgtgctggccgccgtgagcagccacaagttcaacagcttctacggcgacccccccgaggagctgcccgacttcagcgaggaccccaccagcagcgtgctgctgatcgtgagcagagccgtgagccaggtgctggacagcctggaggagatccacgccctgaccgactgcagcgagaaggacctggacttcctgcacagcgtgttccaggaccagcacctgcacaccctgctggacctgtacgacaagatcaacaccaagagcagcccccagatcagaaacccccccagcgacgccgtgcagagagccaaggaggtgctggaggagatcagctgctaccccgagaacaacgacgccaaggagctgaagagaatcctgacccagccccacttcatggccctgctgcagacccacgacgtggtggcccacgaggtgtacagcgacgaggccctgagagtgacccccccccccaccagcccctacctgaacggcgacagccccgagagcgccaacggcgacatggacatggagaacgtgaccagagtgagactggtgcagttccagaagaacaccgacgagcccatgggcatcaccctgaagatgaacgagctgaaccactgcatcgtggccagaatcatgcacggcggcatgatccacagacagggcaccctgcacgtgggcgacgagatcagagagatcaacggcatcagcgtggccaaccagaccgtggagcagctgcagaagatgctgagagagatgagaggcagcatcaccttcaagatcgtgcccagctacagaacccagagcagcagctgcgagagagacagccccagcaccagcagacagagccccgccaacggccacagcagcaccaacaacagcgtgagcgacctgcccagcaccacccagcccaagggcagacagatctacgtgagagcccagttcgagtacgaccccgccaaggacgacctgatcccctgcaaggaggccggcatcagattcagagtgggcgacatcatccagatcatcagcaaggacgaccacaactggtggcagggcaagctggagaacagcaagaacggcaccgccggcctgatccccagccccgagctgcaggagtggagagtggcctgcatcgccatggagaagaccaagcaggagcagcaggccagctgcacctggttcggcaagaagaagaagcagtacaaggacaagtacctggccaagcacaacgccgacctggtgacctacgaggaggtggtgaagctgcccgccttcaagagaaagaccctggtgctgctgggcgcccacggcgtgggcagaagacacatcaagaacaccctgatcaccaagcaccccgacagattcgcctaccccatcccccacaccaccagaccccccaagaaggacgaggagaacggcaagaactactacttcgtgagccacgaccagatgatgcaggacatcagcaacaacgagtacctggagtacggcagccacgaggacgccatgtacggcaccaagctggagaccatcagaaagatccacgagcagggcctgatcgccatcctggacgtggagccccaggccctgaaggtgctgagaaccgccgagttcgcccccttcgtggtgttcatcgccgcccccaccatcacccccggcctgaacgaggacgagagcctgcagagactgcagaaggagagcgacatcctgcagagaacctacgcccactacttcgacctgaccatcatcaacaacgagatcgacgagaccatcagacacctggaggaggccgtggagctggtgtgcaccgccccccagtgggtgcccgtgagctgggtgtactag

SEQ ID NO: 75128 - DNA, 2730 bp, Artificial Sequence
  Description of Artificial Sequence: Synthetic coding sequence
atggccgacgacgacgtgctgttcgaggacgtgtacgagctgtgcgaggtgatcggcaagggccccttcagcgtggtgagaagatgcatcaacagagagaccggccagcagttcgccgtgaagatcgtggacgtggccaagttcaccagcagccccggcctgagcaccgaggacctgaagagagaggccagcatctgccacatgctgaagcacccccacatcgtggagctgctggagacctacagcagcgacggcatgctgtacatggtgttcgagttcatggacggcgccgacctgtgcttcgagatcgtgaagagagccgacgccggcttcgtgtacagcgaggccgtggccagccactacatgagacagatcctggaggccctgagatactgccacgacaacaacatcatccacagagacgtgaagccccactgcgtgctgctggccagcaaggagaacagcgcccccgtgaagctgggcggcttcggcgtggccatccagctgggcgagagcggcctggtggccggcggcagagtgggcaccccccacttcatggcccccgaggtggtgaagagagagccctacggcaagcccgtggacgtgtggggctgcggcgtgatcctgttcatcctgctgagcggctgcctgcccttctacggcaccaaggagagactgttcgagggcatcatcaagggcaagtacaagatgaaccccagacagtggagccacatcagcgagagcgccaaggacctggtgagaagaatgctgatgctggaccccgccgagagaatcaccgtgtacgaggccctgaaccacccctggctgaaggagagagacagatacgcctacaagatccacctgcccgagaccgtggagcagctgagaaagttcaacgccagaagaaagctgaagggcgccgtgctggccgccgtgagcagccacaagttcaacagcttctacggcgacccccccgaggagctgcccgacttcagcgaggaccccaccagcagcgtgctgctgatcgtgagcagagccgtgagccaggtgctggacagcctggaggagatccacgccctgaccgactgcagcgagaaggacctggacttcctgcacagcgtgttccaggaccagcacctgcacaccctgctggacctgtacgacaagatcaacaccaagagcagcccccagatcagaaacccccccagcgacgccgtgcagagagccaaggaggtgctggaggagatcagctgctaccccgagaacaacgacgccaaggagctgaagagaatcctgacccagccccacttcatggccctgctgcagacccacgacgtggtggcccacgaggtgtacagcgacgaggccctgagagtgacccccccccccaccagcccctacctgaacggcgacagccccgagagcgccaacggcgacatggacatggagaacgtgaccagagtgagactggtgcagttccagaagaacaccgacgagcccatgggcatcaccctgaagatgaacgagctgaaccactgcatcgtggccagaatcatgcacggcggcatgatccacagacagggcaccctgcacgtgggcgacgagatcagagagatcaacggcatcagcgtggccaaccagaccgtggagcagctgcagaagatgctgagagagatgagaggcagcatcaccttcaagatcgtgcccagctacagaacccagagcagcagctgcgagagagacagccccagcaccagcagacagagccccgccaacggccacagcagcaccaacaacagcgtgagcatctacgtgagagcccagttcgagtacgaccccgccaaggacgacctgatcccctgcaaggaggccggcatcagattcagagtgggcgacatcatccagatcatcagcaaggacgaccacaactggtggcagggcaagctggagaacagcaagaacggcaccgccggcctgatccccagccccgagctgcaggagtggagagtggcctgcatcgccatggagaagaccaagcaggagcagcaggccagctgcacctggttcggcaagaagaagaagcagtacaaggacaagtacctggccaagcacaacgccgacctggtgacctacgaggaggtggtgaagctgcccgccttcaagagaaagaccctggtgctgctgggcgcccacggcgtgggcagaagacacatcaagaacaccctgatcaccaagcaccccgacagattcgcctaccccatcccccacaccaccagaccccccaagaaggacgaggagaacggcaagaactactacttcgtgagccacgaccagatgatgcaggacatcagcaacaacgagtacctggagtacggcagccacgaggacgccatgtacggcaccaagctggagaccatcagaaagatccacgagcagggcctgatcgccatcctggacgtggagccccaggccctgaaggtgctgagaaccgccgagttcgcccccttcgtggtgttcatcgccgcccccaccatcacccccggcctgaacgaggacgagagcctgcagagactgcagaaggagagcgacatcctgcagagaacctacgcccactacttcgacctgaccatcatcaacaacgagatcgacgagaccatcagacacctggaggaggccgtggagctggtgtgcaccgccccccagtgggtgcccgtgagctgggtgtactag

SEQ ID NO: 75129 - DNA, 1773 bp, Artificial Sequence
  Description of Artificial Sequence: Synthetic coding sequence
atggccgacgacgacgtgctgttcgaggacgtgtacgagctgtgcgaggtgatcggcaagggccccttcagcgtggtgagaagatgcatcaacagagagaccggccagcagttcgccgtgaagatcgtggacgtggccaagttcaccagcagccccggcctgagcaccgaggacctgaagagagaggccagcatctgccacatgctgaagcacccccacatcgtggagctgctggagacctacagcagcgacggcatgctgtacatggtgttcgagttcatggacggcgccgacctgtgcttcgagatcgtgaagagagccgacgccggcttcgtgtacagcgaggccgtggccagccactacatgagacagatcctggaggccctgagatactgccacgacaacaacatcatccacagagacgtgaagccccactgcgtgctgctggccagcaaggagaacagcgcccccgtgaagctgggcggcttcggcgtggccatccagctgggcgagagcggcctggtggccggcggcagagtgggcaccccccacttcatggcccccgaggtggtgaagagagagccctacggcaagcccgtggacgtgtggggctgcggcgtgatcctgttcatcctgctgagcggctgcctgcccttctacggcaccaaggagagactgttcgagggcatcatcaagggcaagtacaagatgaaccccagacagtggagccacatcagcgagagcgccaaggacctggtgagaagaatgctgatgctggaccccgccgagagaatcaccgtgtacgaggccctgaaccacccctggctgaaggagagagacagatacgcctacaagatccacctgcccgagaccgtggagcagctgagaaagttcaacgccagaagaaagctgaagggcgccgtgctggccgccgtgagcagccacaagttcaacagcttctacggcgacccccccgaggagctgcccgacttcagcgaggaccccaccagcagcggcctgctggccgccgagagagccgtgagccaggtgctggacagcctggaggagatccacgccctgaccgactgcagcgagaaggacctggacttcctgcacagcgtgttccaggaccagcacctgcacaccctgctggacctgtacgacaagatcaacaccaagagcagcccccagatcagaaacccccccagcgacgccgtgcagagagccaaggaggtgctggaggagatcagctgctaccccgagaacaacgacgccaaggagctgaagagaatcctgacccagccccacttcatggccctgctgcagacccacgacgtggtggcccacgaggtgtacagcgacgaggccctgagagtgacccccccccccaccagcccctacctgaacggcgacagccccgagagcgccaacggcgacatggacatggagaacgtgaccagagtgagactggtgcagttccagaagaacaccgacgagcccatgggcatcaccctgaagatgaacgagctgaaccactgcatcgtggccagaatcatgcacggcggcatgatccacagacagggcaccctgcacgtgggcgacgagatcagagagatcaacggcatcagcgtggccaaccagaccgtggagcagctgcagaagatgctgagagagatgagaggcagcatcaccttcaagatcgtgcccagctacagaacccagagcagcagctgcgaggtgatgaccctgaccaaccacccccacctgctgtag

SEQ ID NO: 75130 - DNA, 2730 bp, Artificial Sequence
  Description of Artificial Sequence: Synthetic coding sequence
atggccgacgacgacgtgctgttcgaggacgtgtacgagctgtgcgaggtgatcggcaagggccccttcagcgtggtgagaagatgcatcaacagagagaccggccagcagttcgccgtgaagatcgtggacgtggccaagttcaccagcagccccggcctgagcaccgaggacctgaagagagaggccagcatctgccacatgctgaagcacccccacatcgtggagctgctggagacctacagcagcgacggcatgctgtacatggtgttcgagttcatggacggcgccgacctgtgcttcgagatcgtgaagagagccgacgccggcttcgtgtacagcgaggccgtggccagccactacatgagacagatcctggaggccctgagatactgccacgacaacaacatcatccacagagacgtgaagccccactgcgtgctgctggccagcaaggagaacagcgcccccgtgaagctgggcggcttcggcgtggccatccagctgggcgagagcggcctggtggccggcggcagagtgggcaccccccacttcatggcccccgaggtggtgaagagagagccctacggcaagcccgtggacgtgtggggctgcggcgtgatcctgttcatcctgctgagcggctgcctgcccttctacggcaccaaggagagactgttcgagggcatcatcaagggcaagtacaagatgaaccccagacagtggagccacatcagcgagagcgccaaggacctggtgagaagaatgctgatgctggaccccgccgagagaatcaccgtgtacgaggccctgaaccacccctggctgaaggagagagacagatacgcctacaagatccacctgcccgagaccgtggagcagctgagaaagttcaacgccagaagaaagctgaagggcgccgtgctggccgccgtgagcagccacaagttcaacagcttctacggcgacccccccgaggagctgcccgacttcagcgaggaccccaccagcagcggcctgctggccgccgagagagccgtgagccaggtgctggacagcctggaggagatccacgccctgaccgactgcagcgagaaggacctggacttcctgcacagcgtgttccaggaccagcacctgcacaccctgctggacctgtacgacaagatcaacaccaagagcagcccccagatcagaaacccccccagcgacgccgtgcagagagccaaggaggtgctggaggagatcagctgctaccccgagaacaacgacgccaaggagctgaagagaatcctgacccagccccacttcatggccctgctgcagacccacgacgtggtggcccacgaggtgtacagcgacgaggccctgagagtgacccccccccccaccagcccctacctgaacggcgacagccccgagagcgccaacggcgacatggacatggagaacgtgaccagagtgagactggtgcagttccagaagaacaccgacgagcccatgggcatcaccctgaagatgaacgagctgaaccactgcatcgtggccagaatcatgcacggcggcatgatccacagacagggcaccctgcacgtgggcgacgagatcagagagatcaacggcatcagcgtggccaaccagaccgtggagcagctgcagaagatgctgagagagatgagaggcagcatcaccttcaagatcgtgcccagctacagaacccagagcagcagctgcgagagagacagccccagcaccagcagacagagccccgccaacggccacagcagcaccaacaacagcgtgagcatctacgtgagagcccagttcgagtacgaccccgccaaggacgacctgatcccctgcaaggaggccggcatcagattcagagtgggcgacatcatccagatcatcagcaaggacgaccacaactggtggcagggcaagctggagaacagcaagaacggcaccgccggcctgatccccagccccgagctgcaggagtggagagtggcctgcatcgccatggagaagaccaagcaggagcagcaggccagctgcacctggttcggcaagaagaagaagcagtacaaggacaagtacctggccaagcacaacgccgacctggtgacctacgaggaggtggtgaagctgcccgccttcaagagaaagaccctggtgctgctgggcgcccacggcgtgggcagaagacacatcaagaacaccctgatcaccaagcaccccgacagattcgcctaccccatcccccacaccaccagaccccccaagaaggacgaggagaacggcaagaactactacttcgtgagccacgaccagatgatgcaggacatcagcaacaacgagtacctggagtacggcagccacgaggacgccatgtacggcaccaagctggagaccatcagaaagatccacgagcagggcctgatcgccatcctggacgtggagccccaggccctgaaggtgctgagaaccgccgagttcgcccccttcgtggtgttcatcgccgcccccaccatcacccccggcctgaacgaggacgagagcctgcagagactgcagaaggagagcgacatcctgcagagaacctacgcccactacttcgacctgaccatcatcaacaacgagatcgacgagaccatcagacacctggaggaggccgtggagctggtgtgcaccgccccccagtgggtgcccgtgagctgggtgtactag

SEQ ID NO: 75131 - DNA, 2781 bp, Artificial Sequence
  Description of Artificial Sequence: Synthetic coding sequence
atggccgacgacgacgtgctgttcgaggacgtgtacgagctgtgcgaggtgatcggcaagggccccttcagcgtggtgagaagatgcatcaacagagagaccggccagcagttcgccgtgaagatcgtggacgtggccaagttcaccagcagccccggcctgagcaccgaggacctgaagagagaggccagcatctgccacatgctgaagcacccccacatcgtggagctgctggagacctacagcagcgacggcatgctgtacatggtgttcgagttcatggacggcgccgacctgtgcttcgagatcgtgaagagagccgacgccggcttcgtgtacagcgaggccgtggccagccactacatgagacagatcctggaggccctgagatactgccacgacaacaacatcatccacagagacgtgaagccccactgcgtgctgctggccagcaaggagaacagcgcccccgtgaagctgggcggcttcggcgtggccatccagctgggcgagagcggcctggtggccggcggcagagtgggcaccccccacttcatggcccccgaggtggtgaagagagagccctacggcaagcccgtggacgtgtggggctgcggcgtgatcctgttcatcctgctgagcggctgcctgcccttctacggcaccaaggagagactgttcgagggcatcatcaagggcaagtacaagatgaaccccagacagtggagccacatcagcgagagcgccaaggacctggtgagaagaatgctgatgctggaccccgccgagagaatcaccgtgtacgaggccctgaaccacccctggctgaaggagagagacagatacgcctacaagatccacctgcccgagaccgtggagcagctgagaaagttcaacgccagaagaaagctgaagggcgccgtgctggccgccgtgagcagccacaagttcaacagcttctacggcgacccccccgaggagctgcccgacttcagcgaggaccccaccagcagcggcctgctggccgccgagagagccgtgagccaggtgctggacagcctggaggagatccacgccctgaccgactgcagcgagaaggacctggacttcctgcacagcgtgttccaggaccagcacctgcacaccctgctggacctgtacgacaagatcaacaccaagagcagcccccagatcagaaacccccccagcgacgccgtgcagagagccaaggaggtgctggaggagatcagctgctaccccgagaacaacgacgccaaggagctgaagagaatcctgacccagccccacttcatggccctgctgcagacccacgacgtggtggcccacgaggtgtacagcgacgaggccctgagagtgacccccccccccaccagcccctacctgaacggcgacagccccgagagcgccaacggcgacatggacatggagaacgtgaccagagtgagactggtgcagttccagaagaacaccgacgagcccatgggcatcaccctgaagatgaacgagctgaaccactgcatcgtggccagaatcatgcacggcggcatgatccacagacagggcaccctgcacgtgggcgacgagatcagagagatcaacggcatcagcgtggccaaccagaccgtggagcagctgcagaagatgctgagagagatgagaggcagcatcaccttcaagatcgtgcccagctacagaacccagagcagcagctgcgagagagacagccccagcaccagcagacagagccccgccaacggccacagcagcaccaacaacagcgtgagcgacctgcccagcaccacccagcccaagggcagacagatctacgtgagagcccagttcgagtacgaccccgccaaggacgacctgatcccctgcaaggaggccggcatcagattcagagtgggcgacatcatccagatcatcagcaaggacgaccacaactggtggcagggcaagctggagaacagcaagaacggcaccgccggcctgatccccagccccgagctgcaggagtggagagtggcctgcatcgccatggagaagaccaagcaggagcagcaggccagctgcacctggttcggcaagaagaagaagcagtacaaggacaagtacctggccaagcacaacgccgtgttcgaccagctggacctggtgacctacgaggaggtggtgaagctgcccgccttcaagagaaagaccctggtgctgctgggcgcccacggcgtgggcagaagacacatcaagaacaccctgatcaccaagcaccccgacagattcgcctaccccatcccccacaccaccagaccccccaagaaggacgaggagaacggcaagaactactacttcgtgagccacgaccagatgatgcaggacatcagcaacaacgagtacctggagtacggcagccacgaggacgccatgtacggcaccaagctggagaccatcagaaagatccacgagcagggcctgatcgccatcctggacgtggagccccaggccctgaaggtgctgagaaccgccgagttcgcccccttcgtggtgttcatcgccgcccccaccatcacccccggcctgaacgaggacgagagcctgcagagactgcagaaggagagcgacatcctgcagagaacctacgcccactacttcgacctgaccatcatcaacaacgagatcgacgagaccatcagacacctggaggaggccgtggagctggtgtgcaccgccccccagtgggtgcccgtgagctgggtgtactag

SEQ ID NO: 75132 - DNA, 2766 bp, Artificial Sequence
  Description of Artificial Sequence: Synthetic coding sequence
atggccgacgacgacgtgctgttcgaggacgtgtacgagctgtgcgaggtgatcggcaagggccccttcagcgtggtgagaagatgcatcaacagagagaccggccagcagttcgccgtgaagatcgtggacgtggccaagttcaccagcagccccggcctgagcaccgaggacctgaagagagaggccagcatctgccacatgctgaagcacccccacatcgtggagctgctggagacctacagcagcgacggcatgctgtacatggtgttcgagttcatggacggcgccgacctgtgcttcgagatcgtgaagagagccgacgccggcttcgtgtacagcgaggccgtggccagccactacatgagacagatcctggaggccctgagatactgccacgacaacaacatcatccacagagacgtgaagccccactgcgtgctgctggccagcaaggagaacagcgcccccgtgaagctgggcggcttcggcgtggccatccagctgggcgagagcggcctggtggccggcggcagagtgggcaccccccacttcatggcccccgaggtggtgaagagagagccctacggcaagcccgtggacgtgtggggctgcggcgtgatcctgttcatcctgctgagcggctgcctgcccttctacggcaccaaggagagactgttcgagggcatcatcaagggcaagtacaagatgaaccccagacagtggagccacatcagcgagagcgccaaggacctggtgagaagaatgctgatgctggaccccgccgagagaatcaccgtgtacgaggccctgaaccacccctggctgaaggagagagacagatacgcctacaagatccacctgcccgagaccgtggagcagctgagaaagttcaacgccagaagaaagctgaagggcgccgtgctggccgccgtgagcagccacaagttcaacagcttctacggcgacccccccgaggagctgcccgacttcagcgaggaccccaccagcagcggcctgctggccgccgagagagccgtgagccaggtgctggacagcctggaggagatccacgccctgaccgactgcagcgagaaggacctggacttcctgcacagcgtgttccaggaccagcacctgcacaccctgctggacctgtacgacaagatcaacaccaagagcagcccccagatcagaaacccccccagcgacgccgtgcagagagccaaggaggtgctggaggagatcagctgctaccccgagaacaacgacgccaaggagctgaagagaatcctgacccagccccacttcatggccctgctgcagacccacgacgtggtggcccacgaggtgtacagcgacgaggccctgagagtgacccccccccccaccagcccctacctgaacggcgacagccccgagagcgccaacggcgacatggacatggagaacgtgaccagagtgagactggtgcagttccagaagaacaccgacgagcccatgggcatcaccctgaagatgaacgagctgaaccactgcatcgtggccagaatcatgcacggcggcatgatccacagacagggcaccctgcacgtgggcgacgagatcagagagatcaacggcatcagcgtggccaaccagaccgtggagcagctgcagaagatgctgagagagatgagaggcagcatcaccttcaagatcgtgcccagctacagaacccagagcagcagctgcgagagagacagccccagcaccagcagacagagccccgccaacggccacagcagcaccaacaacagcgtgagcgacctgcccagcaccacccagcccaagggcagacagatctacgtgagagcccagttcgagtacgaccccgccaaggacgacctgatcccctgcaaggaggccggcatcagattcagagtgggcgacatcatccagatcatcagcaaggacgaccacaactggtggcagggcaagctggagaacagcaagaacggcaccgccggcctgatccccagccccgagctgcaggagtggagagtggcctgcatcgccatggagaagaccaagcaggagcagcaggccagctgcacctggttcggcaagaagaagaagcagtacaaggacaagtacctggccaagcacaacgccgacctggtgacctacgaggaggtggtgaagctgcccgccttcaagagaaagaccctggtgctgctgggcgcccacggcgtgggcagaagacacatcaagaacaccctgatcaccaagcaccccgacagattcgcctaccccatcccccacaccaccagaccccccaagaaggacgaggagaacggcaagaactactacttcgtgagccacgaccagatgatgcaggacatcagcaacaacgagtacctggagtacggcagccacgaggacgccatgtacggcaccaagctggagaccatcagaaagatccacgagcagggcctgatcgccatcctggacgtggagccccaggccctgaaggtgctgagaaccgccgagttcgcccccttcgtggtgttcatcgccgcccccaccatcacccccggcctgaacgaggacgagagcctgcagagactgcagaaggagagcgacatcctgcagagaacctacgcccactacttcgacctgaccatcatcaacaacgagatcgacgagaccatcagacacctggaggaggccgtggagctggtgtgcaccgccccccagtgggtgcccgtgagctgggtgtactag

SEQ ID NO: 75133 - DNA, 1146 bp, Artificial Sequence
  Description of Artificial Sequence: Synthetic coding sequence
gacgagatcagagagatcaacggcatcagcgtggccaaccagaccgtggagcagctgcagaagatgctgagagagatgagaggcagcatcaccttcaagatcgtgcccagctacagaacccagagcagcagctgcgagagagacagccccagcaccagcagacagagccccgccaacggccacagcagcaccaacaacagcgtgagcatctacgtgagagcccagttcgagtacgaccccgccaaggacgacctgatcccctgcaaggaggccggcatcagattcagagtgggcgacatcatccagatcatcagcaaggacgaccacaactggtggcagggcaagctggagaacagcaagaacggcaccgccggcctgatccccagccccgagctgcaggagtggagagtggcctgcatcgccatggagaagaccaagcaggagcagcaggccagctgcacctggttcggcaagaagaagaagcagtacaaggacaagtacctggccaagcacaacgccgtgttcgaccagctggacctggtgacctacgaggaggtggtgaagctgcccgccttcaagagaaagaccctggtgctgctgggcgcccacggcgtgggcagaagacacatcaagaacaccctgatcaccaagcaccccgacagattcgcctaccccatcccccacaccaccagaccccccaagaaggacgaggagaacggcaagaactactacttcgtgagccacgaccagatgatgcaggacatcagcaacaacgagtacctggagtacggcagccacgaggacgccatgtacggcaccaagctggagaccatcagaaagatccacgagcagggcctgatcgccatcctggacgtggagccccaggccctgaaggtgctgagaaccgccgagttcgcccccttcgtggtgttcatcgccgcccccaccatcacccccggcctgaacgaggacgagagcctgcagagactgcagaaggagagcgacatcctgcagagaacctacgcccactacttcgacctgaccatcatcaacaacgagatcgacgagaccatcagacacctggaggaggccgtggagctggtgtgcaccgccccccagtgggtgcccgtgagctgggtgtactag

SEQ ID NO: 75134 - DNA, 1557 bp, Artificial Sequence
  Description of Artificial Sequence: Synthetic coding sequence
ctgtacgacaagatcaacaccaagagcagcccccagatcagaaacccccccagcgacgccgtgcagagagccaaggaggtgctggaggagatcagctgctaccccgagaacaacgacgccaaggagctgaagagaatcctgacccagccccacttcatggccctgctgcagacccacgacgtggtggcccacgaggtgtacagcgacgaggccctgagagtgacccccccccccaccagcccctacctgaacggcgacagccccgagagcgccaacggcgacatggacatggagaacgtgaccagagtgagactggtgcagttccagaagaacaccgacgagcccatgggcatcaccctgaagatgaacgagctgaaccactgcatcgtggccagaatcatgcacggcggcatgatccacagacagggcaccctgcacgtgggcgacgagatcagagagatcaacggcatcagcgtggccaaccagaccgtggagcagctgcagaagatgctgagagagatgagaggcagcatcaccttcaagatcgtgcccagctacagaacccagagcagcagctgcgaggacctgcccagcaccacccagcccaagggcagacagatctacgtgagagcccagttcgagtacgaccccgccaaggacgacctgatcccctgcaaggaggccggcatcagattcagagtgggcgacatcatccagatcatcagcaaggacgaccacaactggtggcagggcaagctggagaacagcaagaacggcaccgccggcctgatccccagccccgagctgcaggagtggagagtggcctgcatcgccatggagaagaccaagcaggagcagcaggccagctgcacctggttcggcaagaagaagaagcagtacaaggacaagtacctggccaagcacaacgccgtgttcgaccagctggacctggtgacctacgaggaggtggtgaagctgcccgccttcaagagaaagaccctggtgctgctgggcgcccacggcgtgggcagaagacacatcaagaacaccctgatcaccaagcaccccgacagattcgcctaccccatcccccacaccaccagaccccccaagaaggacgaggagaacggcaagaactactacttcgtgagccacgaccagatgatgcaggacatcagcaacaacgagtacctggagtacggcagccacgaggacgccatgtacggcaccaagctggagaccatcagaaagatccacgagcagggcctgatcgccatcctggacgtggagccccaggccctgaaggtgctgagaaccgccgagttcgcccccttcgtggtgttcatcgccgcccccaccatcacccccggcctgaacgaggacgagagcctgcagagactgcagaaggagagcgacatcctgcagagaacctacgcccactacttcgacctgaccatcatcaacaacgagatcgacgagaccatcagacacctggaggaggccgtggagctggtgtgcaccgccccccagtgggtgcccgtgagctgggtgtactag

SEQ ID NO: 75135 - DNA, 2694 bp, Artificial Sequence
  Description of Artificial Sequence: Synthetic coding sequence
atggccgacgacgacgtgctgttcgaggacgtgtacgagctgtgcgaggtgatcggcaagggccccttcagcgtggtgagaagatgcatcaacagagagaccggccagcagttcgccgtgaagatcgtggacgtggccaagttcaccagcagccccggcctgagcaccgaggacctgaagagagaggccagcatctgccacatgctgaagcacccccacatcgtggagctgctggagacctacagcagcgacggcatgctgtacatggtgttcgagttcatggacggcgccgacctgtgcttcgagatcgtgaagagagccgacgccggcttcgtgtacagcgaggccgtggccagccactacatgagacagatcctggaggccctgagatactgccacgacaacaacatcatccacagagacgtgaagccccactgcgtgctgctggccagcaaggagaacagcgcccccgtgaagctgggcggcttcggcgtggccatccagctgggcgagagcggcctggtggccggcggcagagtgggcaccccccacttcatggcccccgaggtggtgaagagagagccctacggcaagcccgtggacgtgtggggctgcggcgtgatcctgttcatcctgctgagcggctgcctgcccttctacggcaccaaggagagactgttcgagggcatcatcaagggcaagtacaagatgaaccccagacagtggagccacatcagcgagagcgccaaggacctggtgagaagaatgctgatgctggaccccgccgagagaatcaccgtgtacgaggccctgaaccacccctggctgaaggagagagacagatacgcctacaagatccacctgcccgagaccgtggagcagctgagaaagttcaacgccagaagaaagctgaagggcgccgtgctggccgccgtgagcagccacaagttcaacagcttctacggcgacccccccgaggagctgcccgacttcagcgaggaccccaccagcagcggcgccgtgagccaggtgctggacagcctggaggagatccacgccctgaccgactgcagcgagaaggacctggacttcctgcacagcgtgttccaggaccagcacctgcacaccctgctggacctgtacgacaagatcaacaccaagagcagcccccagatcagaaacccccccagcgacgccgtgcagagagccaaggaggtgctggaggagatcagctgctaccccgagaacaacgacgccaaggagctgaagagaatcctgacccagccccacttcatggccctgctgcagacccacgacgtggtggcccacgaggtgtacagcgacgaggccctgagagtgacccccccccccaccagcccctacctgaacggcgacagccccgagagcgccaacggcgacatggacatggagaacgtgaccagagtgagactggtgcagttccagaagaacaccgacgagcccatgggcatcaccctgaagatgaacgagctgaaccactgcatcgtggccagaatcatgcacggcggcatgatccacagacagggcaccctgcacgtgggcgacgagatcagagagatcaacggcatcagcgtggccaaccagaccgtggagcagctgcagaagatgctgagagagatgagaggcagcatcaccttcaagatcgtgcccagctacagaacccagagcagcagctgcgaggacctgcccagcaccacccagcccaagggcagacagatctacgtgagagcccagttcgagtacgaccccgccaaggacgacctgatcccctgcaaggaggccggcatcagattcagagtgggcgacatcatccagatcatcagcaaggacgaccacaactggtggcagggcaagctggagaacagcaagaacggcaccgccggcctgatccccagccccgagctgcaggagtggagagtggcctgcatcgccatggagaagaccaagcaggagcagcaggccagctgcacctggttcggcaagaagaagaagcagtacaaggacaagtacctggccaagcacaacgccgtgttcgaccagctggacctggtgacctacgaggaggtggtgaagctgcccgccttcaagagaaagaccctggtgctgctgggcgcccacggcgtgggcagaagacacatcaagaacaccctgatcaccaagcaccccgacagattcgcctaccccatcccccacaccaccagaccccccaagaaggacgaggagaacggcaagaactactacttcgtgagccacgaccagatgatgcaggacatcagcaacaacgagtacctggagtacggcagccacgaggacgccatgtacggcaccaagctggagaccatcagaaagatccacgagcagggcctgatcgccatcctggacgtggagccccaggccctgaaggtgctgagaaccgccgagttcgcccccttcgtggtgttcatcgccgcccccaccatcacccccggcctgaacgaggacgagagcctgcagagactgcagaaggagagcgacatcctgcagagaacctacgcccactacttcgacctgaccatcatcaacaacgagatcgacgagaccatcagacacctggaggaggccgtggagctggtgtgcaccgccccccagtgggtgcccgtgagctgggtgtactag

SEQ ID NO: 75136 - DNA, 2697 bp, Artificial Sequence
  Description of Artificial Sequence: Synthetic coding sequence
atggccgacgacgacgtgctgttcgaggacgtgtacgagctgtgcgaggtgatcggcaagggccccttcagcgtggtgagaagatgcatcaacagagagaccggccagcagttcgccgtgaagatcgtggacgtggccaagttcaccagcagccccggcctgagcaccgaggacctgaagagagaggccagcatctgccacatgctgaagcacccccacatcgtggagctgctggagacctacagcagcgacggcatgctgtacatggtgttcgagttcatggacggcgccgacctgtgcttcgagatcgtgaagagagccgacgccggcttcgtgtacagcgaggccgtggccagccactacatgagacagatcctggaggccctgagatactgccacgacaacaacatcatccacagagacgtgaagccccactgcgtgctgctggccagcaaggagaacagcgcccccgtgaagctgggcggcttcggcgtggccatccagctgggcgagagcggcctggtggccggcggcagagtgggcaccccccacttcatggcccccgaggtggtgaagagagagccctacggcaagcccgtggacgtgtggggctgcggcgtgatcctgttcatcctgctgagcggctgcctgcccttctacggcaccaaggagagactgttcgagggcatcatcaagggcaagtacaagatgaaccccagacagtggagccacatcagcgagagcgccaaggacctggtgagaagaatgctgatgctggaccccgccgagagaatcaccgtgtacgaggccctgaaccacccctggctgaaggagagagacagatacgcctacaagatccacctgcccgagaccgtggagcagctgagaaagttcaacgccagaagaaagctgaagggcgccgtgctggccgccgtgagcagccacaagttcaacagcttctacggcgacccccccgaggagctgcccgacttcagcgaggaccccaccagcagcggcctgctggccgccgagagagccgtgagccaggtgctggacagcctggaggagatccacgccctgaccgactgcagcgagaaggacctggacttcctgcacagcgtgttccaggaccagcacctgcacaccctgctggacctgtacgacaagatcaacaccaagagcagcccccagatcagaaacccccccagcgacgccgtgcagagagccaaggaggtgctggaggagatcagctgctaccccgagaacaacgacgccaaggagctgaagagaatcctgacccagccccacttcatggccctgctgcagacccacgacgtggtggcccacgaggtgtacagcgacgaggccctgagagtgacccccccccccaccagcccctacctgaacggcgacagccccgagagcgccaacggcgacatggacatggagaacgtgaccagagtgagactggtgcagttccagaagaacaccgacgagcccatgggcatcaccctgaagatgaacgagctgaaccactgcatcgtggccagaatcatgcacggcggcatgatccacagacagggcaccctgcacgtgggcgacgagatcagagagatcaacggcatcagcgtggccaaccagaccgtggagcagctgcagaagatgctgagagagatgagaggcagcatcaccttcaagatcgtgcccagctacagaacccagagcagcagctgcgaggacctgcccagcaccacccagcccaagggcagacagatctacgtgagagcccagttcgagtacgaccccgccaaggacgacctgatcccctgcaaggaggccggcatcagattcagagtgggcgacatcatccagatcatcagcaaggacgaccacaactggtggcagggcaagctggagaacagcaagaacggcaccgccggcctgatccccagccccgagctgcaggagtggagagtggcctgcatcgccatggagaagaccaagcaggagcagcaggccagctgcacctggttcggcaagaagaagaagcagtacaaggacaagtacctggccaagcacaacgccgacctggtgacctacgaggaggtggtgaagctgcccgccttcaagagaaagaccctggtgctgctgggcgcccacggcgtgggcagaagacacatcaagaacaccctgatcaccaagcaccccgacagattcgcctaccccatcccccacaccaccagaccccccaagaaggacgaggagaacggcaagaactactacttcgtgagccacgaccagatgatgcaggacatcagcaacaacgagtacctggagtacggcagccacgaggacgccatgtacggcaccaagctggagaccatcagaaagatccacgagcagggcctgatcgccatcctggacgtggagccccaggccctgaaggtgctgagaaccgccgagttcgcccccttcgtggtgttcatcgccgcccccaccatcacccccggcctgaacgaggacgagagcctgcagagactgcagaaggagagcgacatcctgcagagaacctacgcccactacttcgacctgaccatcatcaacaacgagatcgacgagaccatcagacacctggaggaggccgtggagctggtgtgcaccgccccccagtgggtgcccgtgagctgggtgtactag

SEQ ID NO: 75137 - DNA, 3237 bp, Artificial Sequence
  Description of Artificial Sequence: Synthetic coding sequence
atggccttctacagctgctgctgggtgctgctggccctgacctggcacaccagcgcctacggccccgaccagagagcccagaagaagggcgacatcatcctgggcggcctgttccccatccacttcggcgtggccgccaaggaccaggacctgaagagcagacccgagagcgtggagtgcatcagatacaacttcagaggcttcagatggctgcaggccatgatcttcgccatcgaggagatcaacagcagccccgccctgctgcccaacctgaccctgggctacagaatcttcgacacctgcaacaccgtgagcaaggccctggaggccaccctgagcttcgtggcccagaacaagatcgacagcctgaacctggacgagttctgcaactgcagcgagcacatccccagcaccatcgccgtggtgggcgccaccggcagcggcgtgagcaccgccgtggccaacctgctgggcctgttctacatcccccaggtgagctacgccagcagcagcagactgctgagcaacaagaaccagttcaagagcttcctgagaaccatccccaacgacgagcaccaggccaccgccatggccgacatcatcgagtacttcagatggaactgggtgggcaccatcgccgccgacgacgactacggcagacccggcatcgagaagttcagagaggaggccgaggagagagacatctgcatcgacttcagcgagctgatcagccagtacagcgacgaggaggagatccagcacgtggtggaggtgatccagaacagcaccgccaaggtgatcgtggtgttcagcagcggccccgacctggagcccctgatcaaggagatcgtgagaagaaacatcaccggcaagatctggctggccagcgaggcctgggccagcagcagcctgatcgccatgccccagtacttccacgtggtgggcggcaccatcggcttcgccctgaaggccggccagatccccggcttcagagagttcctgaagaaggtgcaccccagaaagagcgtgcacaacggcttcgccaaggagttctgggaggagaccttcaactgccacctgcaggagggcgccaagggccccctgcccgtggacaccttcctgagaggccacgaggagagcggcgacagattcagcaacagcagcaccgccttcagacccctgtgcaccggcgacgagaacatcagcagcgtggagaccccctacatcgactacacccacctgagaatcagctacaacgtgtacctggccgtgtacagcatcgcccacgccctgcaggacatctacacctgcctgcccggcagaggcctgttcaccaacggcagctgcgccgacatcaagaaggtggaggcctggcaggtgctgaagcacctgagacacctgaacttcaccaacaacatgggcgagcaggtgaccttcgacgagtgcggcgacctggtgggcaactacagcatcatcaactggcacctgagccccgaggacggcagcatcgtgttcaaggaggtgggctactacaacgtgtacgccaagaagggcgagagactgttcatcaacgaggagaagatcctgtggagcggcttcagcagagaggtgcccttcagcaactgcagcagagactgcctggccggcaccagaaagggcatcatcgagggcgagcccacctgctgcttcgagtgcgtggagtgccccgacggcgagtacagcgacgagaccgacgccagcgcctgcaacaagtgccccgacgacttctggagcaacgagaaccacaccagctgcatcgccaaggagatcgagttcctgagctggaccgagcccttcggcatcgccctgaccctgttcgccgtgctgggcatcttcctgaccgccttcgtgctgggcgtgttcatcaagttcagaaacacccccatcgtgaaggccaccaacagagagctgagctacctgctgctgttcagcctgctgtgctgcttcagcagcagcctgttcttcatcggcgagccccaggactggacctgcagactgagacagcccgccttcggcatcagcttcgtgctgtgcatcagctgcatcctggtgaagaccaacagagtgctgctggtgttcgaggccaagatccccaccagcttccacagaaagtggtggggcctgaacctgcagttcctgctggtgttcctgtgcaccttcatgcagatcgtgatctgcgtgatctggctgtacaccgccccccccagcagctacagaaaccaggagctggaggacgagatcatcttcatcacctgccacgagggcagcctgatggccctgggcttcctgatcggctacacctgcctgctggccgccatctgcttcttcttcgccttcaagagcagaaagctgcccgagaacttcaacgaggccaagttcatcaccttcagcatgctgatcttcttcatcgtgtggatcagcttcatccccgcctacgccagcacctacggcaagttcgtgagcgccgtggaggtgatcgccatcctggccgccagcttcggcctgctggcctgcatcttcttcaacaagatctacatcatcctgttcaagcccagcagaaacaccatcgaggaggtgagatgcagcaccgccgcccacgccttcaaggtggccgccagagccaccctgagaagaagcaacgtgagcagaaagagaagcagcagcctgggcggcagcaccggcagcacccccagcagcagcatcagcagcaagagcaacagcgaggaccccttcccccagcccgagagacagaagcagcagcagcccctggccctgacccagcaggagcagcagcagcagcccctgaccctgccccagcagcagagaagccagcagcagcccagatgcaagcagaaggtgatcttcggcagcggcaccgtgaccttcagcctgagcttcgacgagccccagaagaacgccatggcccacagaaacagcacccaccagaacagcctggaggcccagaagagcagcgacaccctgaccagacacgagcccctgctgcccctgcagtgcggcgagaccgacctggacctgaccgtgcaggagaccggcctgcagggccccgtgggcggcgaccagagacccgaggtggaggaccccgaggagctgagccccgccctggtggtgagcagcagccagagcttcgtgatcagcggcggcggcagcaccgtgaccgagaacgtggtgaacagctag

SEQ ID NO: 75138 - DNA, 3237 bp, Artificial Sequence; identical to SEQ ID NO: 75137
  Description of Artificial Sequence: Synthetic coding sequence

SEQ ID NO: 75139 - DNA, 3267 bp, Artificial Sequence
  Description of Artificial Sequence: Synthetic coding sequence
atggccttctacagctgctgctgggtgctgctggccctgacctggcacaccagcgcctacggccccgaccagagagcccagaagaagggcgacatcatcctgggcggcctgttccccatccacttcggcgtggccgccaaggaccaggacctgaagagcagacccgagagcgtggagtgcatcagatacaacttcagaggcttcagatggctgcaggccatgatcttcgccatcgaggagatcaacagcagccccgccctgctgcccaacctgaccctgggctacagaatcttcgacacctgcaacaccgtgagcaaggccctggaggccaccctgagcttcgtggcccagaacaagatcgacagcctgaacctggacgagttctgcaactgcagcgagcacatccccagcaccatcgccgtggtgggcgccaccggcagcggcgtgagcaccgccgtggccaacctgctgggcctgttctacatcccccaggtgagctacgccagcagcagcagactgctgagcaacaagaaccagttcaagagcttcctgagaaccatccccaacgacgagcaccaggccaccgccatggccgacatcatcgagtacttcagatggaactgggtgggcaccatcgccgccgacgacgactacggcagacccggcatcgagaagttcagagaggaggccgaggagagagacatctgcatcgacttcagcgagctgatcagccagtacagcgacgaggaggagatccagcacgtggtggaggtgatccagaacagcaccgccaaggtgatcgtggtgttcagcagcggccccgacctggagcccctgatcaaggagatcgtgagaagaaacatcaccggcaagatctggctggccagcgaggcctgggccagcagcagcctgatcgccatgccccagtacttccacgtggtgggcggcaccatcggcttcgccctgaaggccggccagatccccggcttcagagagttcctgaagaaggtgcaccccagaaagagcgtgcacaacggcttcgccaaggagttctgggaggagaccttcaactgccacctgcaggagggcgccaagggccccctgcccgtggacaccttcctgagaggccacgaggagagcggcgacagattcagcaacagcagcaccgccttcagacccctgtgcaccggcgacgagaacatcagcagcgtggagaccccctacatcgactacacccacctgagaatcagctacaacgtgtacctggccgtgtacagcatcgcccacgccctgcaggacatctacacctgcctgcccggcagaggcctgttcaccaacggcagctgcgccgacatcaagaaggtggaggcctggcaggtgctgaagcacctgagacacctgaacttcaccaacaacatgggcgagcaggtgaccttcgacgagtgcggcgacctggtgggcaactacagcatcatcaactggcacctgagccccgaggacggcagcatcgtgttcaaggaggtgggctactacaacgtgtacgccaagaagggcgagagactgttcatcaacgaggagaagatcctgtggagcggcttcagcagagagcccctgaccttcgtgctgagcgtgctgcaggtgcccttcagcaactgcagcagagactgcctggccggcaccagaaagggcatcatcgagggcgagcccacctgctgcttcgagtgcgtggagtgccccgacggcgagtacagcgacgagaccgacgccagcgcctgcaacaagtgccccgacgacttctggagcaacgagaaccacaccagctgcatcgccaaggagatcgagttcctgagctggaccgagcccttcggcatcgccctgaccctgttcgccgtgctgggcatcttcctgaccgccttcgtgctgggcgtgttcatcaagttcagaaacacccccatcgtgaaggccaccaacagagagctgagctacctgctgctgttcagcctgctgtgctgcttcagcagcagcctgttcttcatcggcgagccccaggactggacctgcagactgagacagcccgccttcggcatcagcttcgtgctgtgcatcagctgcatcctggtgaagaccaacagagtgctgctggtgttcgaggccaagatccccaccagcttccacagaaagtggtggggcctgaacctgcagttcctgctggtgttcctgtgcaccttcatgcagatcgtgatctgcgtgatctggctgtacaccgccccccccagcagctacagaaaccaggagctggaggacgagatcatcttcatcacctgccacgagggcagcctgatggccctgggcttcctgatcggctacacctgcctgctggccgccatctgcttcttcttcgccttcaagagcagaaagctgcccgagaacttcaacgaggccaagttcatcaccttcagcatgctgatcttcttcatcgtgtggatcagcttcatccccgcctacgccagcacctacggcaagttcgtgagcgccgtggaggtgatcgccatcctggccgccagcttcggcctgctggcctgcatcttcttcaacaagatctacatcatcctgttcaagcccagcagaaacaccatcgaggaggtgagatgcagcaccgccgcccacgccttcaaggtggccgccagagccaccctgagaagaagcaacgtgagcagaaagagaagcagcagcctgggcggcagcaccggcagcacccccagcagcagcatcagcagcaagagcaacagcgaggaccccttcccccagcccgagagacagaagcagcagcagcccctggccctgacccagcaggagcagcagcagcagcccctgaccctgccccagcagcagagaagccagcagcagcccagatgcaagcagaaggtgatcttcggcagcggcaccgtgaccttcagcctgagcttcgacgagccccagaagaacgccatggcccacagaaacagcacccaccagaacagcctggaggcccagaagagcagcgacaccctgaccagacacgagcccctgctgcccctgcagtgcggcgagaccgacctggacctgaccgtgcaggagaccggcctgcagggccccgtgggcggcgaccagagacccgaggtggaggaccccgaggagctgagccccgccctggtggtgagcagcagccagagcttcgtgatcagcggcggcggcagcaccgtgaccgagaacgtggtgaacagctag

SEQ ID NO: 75140 - DNA, 978 bp, Artificial Sequence
  Description of Artificial Sequence: Synthetic coding sequence
atggccagacccgtgagcgacagaacccccgcccccctgctgctgggcggccccgccggcaccccccccggcggcggcgccctgctgggcctgagaagcctgctgcagggcaccagcaagcccaaggagcccgccagctgcctgctgaaggagaaggagagaaaggccgccctgcccgccgccaccacccccggccccggcctggagaccgccggccccgccgacgcccccgccggcgccgtggtgggcggcggcagccccagaggcagacccggccccgtgcccgcccccggcctgctggcccccctgctgtgggagagaaccctgcccttcggcgacgtggagtacgtggacctggacgccttcctgctggagcacggcctgccccccagcccccccccccccggcggccccagccccgagcccagccccgccagaacccccgcccccagccccggccccggcagctgcggcagcgccagccccagaagcagccccggccacgcccccgccagagccgccctgggcaccgccagcggccacagagccggcctgaccagcagagacacccccagccccgtggaccccgacaccgtggaggtgctgatgaccttcgagcccgaccccgccgacctggccctgagcagcatccccggccacgagaccttcgaccccagaagacacagattcagcgaggaggagctgaagccccagcccatcatgaagaaggccagaaagatccaggtgcccgaggagcagaaggacgagaagtactggagcagaagatacaagaacaacgaggccgccaagagaagcagagacgccagaagactgaaggagaaccagatcagcgtgagagccgccttcctggagaaggagaacgccctgctgagacaggaggtggtggccgtgagacaggagctgagccactacagagccgtgctgagcagataccaggcccagcacggcgccctgtag

SEQ ID NO: 75141 - DNA, 969 bp, Artificial Sequence
  Description of Artificial Sequence: Synthetic coding sequence
agccagagaggcaagggcacctgccccggcagccacagaaaccacgccagcagcctgcccagccacggcctggtgagcatccagggcatcagcgcccccgccggccagtggcccgccccccccccctggagccaggagggcatgcagtgccacagagacctggccctgagccaggccctgtggggctggcagctgagcaagcagagcggctgggcccaccccagcctgccccacagccccctgcccagcaccgtgcacagctgcagctgggcccccccccacctgcagagacacctgcccctggccaccgtgagccccggcaccacccagctgacccagggccccgccggcagaaccctgggccagacccaggccagctgccccgagcccagacccagcatggacgccgtggacgccaccatggagaagctgagagcccagtgcctgagcagaggcgccagcggcatccagggcctggccagattcttcagacagctggacagagacggcagcagaagcctggacgccgacgagttcagacagggcctggccaagctgggcctggtgctggaccaggccgaggccgagggcgtgtgcagaaagtgggacagaaacggcagcggcaccctggacctggaggagttcctgagagccctgagaccccccatgagccaggccagagaggccgtgatcgccgccgccttcgccaagctggacagaagcggcgacggcgtggtgaccgtggacgacctgagaggcgtgtacagcggcagagcccaccccaaggtgagaagcggcgagtggaccgaggacgaggtgctgagaagattcctggacaacttcgacagcagcgagaaggacggccaggtgaccctggccgagttccaggactactacagcggcgtgagcgccagcatgaacaccgacgaggagttcgtggccatgatgaccagcgcctggcagctgtag

SEQ ID NO: 75142 - DNA, 489 bp, Artificial Sequence
  Description of Artificial Sequence: Synthetic coding sequence
atggacgccgtggacgccaccatggagaagctgagagcccagtgcctgagcagaggcgccagcggcatccagggcctggccagattcttcagacagctggacagagacggcagcagaagcctggacgccgacgagttcagacagggcctggccaagctgggcctggtgctggaccaggccgaggccgagggcgtgtgcagaaagtgggacagaaacggcagcggcaccctggacctggaggagttcctgagagccctgagaccccccatgagccaggccagagaggccgtgatcgccgccgccttcgccaagctggacagaagcggcgacggcgtggtgaccgtggacgacctgagaggcgtgtacagcggcagagcccaccccaaggtgaccctggccgagttccaggactactacagcggcgtgagcgccagcatgaacaccgacgaggagttcgtggccatgatgaccagcgcctggcagctgtag

SEQ ID NO: 75143 - DNA, 882 bp, Artificial Sequence
  Description of Artificial Sequence: Synthetic coding sequence
ctgatcaacatcctgtacagagccgtgatcagcgaccccgagcagaacctggccatcgagcagaaggagagcgaccacatcctgcccgacagcaagatgacccccctgagattcagaaagagaaccctgcacgagaccaagatcagaacccacagcaccctgaccgagaacgtgctgagccacaagctgcagttcgacggcagaatcgtgagcagaaccaacgtgctgcccttcatccagaagagcatctacagccaccagtgcggcagaagaaagggcaagcagtacagactgggcgacttctacgtgggcgccaccctgaccttcctgagcagcgaccacctgagcctgcccgagagcatcaaggagaacaccctgctgaagctgagaatcaccaacatcgaccagatcgccctggacagcctgaagaccgccagcatggagcaggaggacgacatcatcatccaggagaccaacgacagactggtgttcaaggccatccaggacgtgctgaaggagaagctgcacaagagaggcgtgagaatcctgaccggcctgggcaagtacttccagcagctggacaaggagggcaacggcctgctggacaaggccgacttcaagcaggccctgaaggtgttccacctggaggtgagcgagaaggacttcgagagcgcctggctgatcctgaacgacaacggcaacggcaaggtggactacggcgagttcaagagaggcatcatcggcgagatgaacgagtacagaaagagctacgtgagaaaggccttcatgaagctggacttcaacaagagcggcagcgtgcccatcatcaacatcagaaagtgctactgcgccaagaagcacagccaggtgatcagcggctag

SEQ ID NO: 75144 - DNA, 1149 bp, Artificial Sequence
  Description of Artificial Sequence: Synthetic coding sequence
atgatcgaccacctgagcagagccgtgatcagcgaccccgagcagaacctggccatcgagcagaaggagagcgaccacatcctgcccgacagcaagatgacccccctgagattcagaaagagaaccctgcacgagaccaagatcagaacccacagcaccctgaccgagaacgtgctgagccacaagctgcagttcgacggcagaatcgtgagcagaaacggcagagacgcctgcagagagctgatcggcttcttcttcacccacgaccagagcctgaccatctacgagtacagacagttcggcaagaacagaaccaacgtgctgcccttcatccagaagagcatctacagccaccagtgcggcagaagaaagggcaagcagtacagactgggcgacttctacgtgggcgccaccctgaccttcctgagcagcgaccacctgagcctgcccgagagcatcaaggagaacaccctgctgaagctgagaatcaccaacatcgaccagatcgccctggacagcctgaagaccgccagcatggagcaggaggacgacatcatcatccaggagaccaacgacagactggtgttcaaggccatccaggacgtgctgaaggagaagctgcacaagagaggcgtgagaatcctgaccggcctgggcaagtacttccagcagctggacaaggagggcaacggcctgctggacaaggccgacttcaagcaggccctgaaggtgttccacctggaggtgagcgagaaggacttcgagagcgcctggctgatcctgaacgacaacggcaacggcaaggtggactacggcgagttcaagagaggcatcatcggcgagatgaacgagtacagaaagagctacgtgagaaaggccttcatgaagctggacttcaacaagagcggcagcgtgcccatcatcaacatcagaaagtgctactgcgccaagaagcacagccaggtgatcagcggccacagcaccgaggaggagatcaagagcagcttcctggagaccctgaaggtggcctgcagcaagagcgacgaggtgagctacggcgagttcgaggactactacgagggcctgagcatcggcatcgtggacgacgaggacttcgtgaacatcctgagaaccccctggggcatctag

SEQ ID NO: 75145 - DNA, 1674 bp, Artificial Sequence
  Description of Artificial Sequence: Synthetic coding sequence
atgggcaacagcttctgctacaccgccgtgtactgcatgatcaacaccggcacccagatggacctggaggtgaagggcgtggccgccaccagcagaagccagatccagcccttcttcggcagaaagaagcccctgcagcagagatggaccagcgagagctggaccaaccagaacagctgcccccccgtggtgcccagactggacctgggcagcctggtggacagcgacgacgaggacaacttcagctacatccccctgagcaccgccaacctgcccaacagcagcagcaccctgggctgggtgaccccctgccagaccccctacacccagtaccacctgaacaagctggaccagaacatcatccccgagaacctgcccgcccccaccgacaagtgcaagctgaagtaccagcagtgcaagaccgagatcaaggagggctacaagcagtacagccagagaaacgccgagaacaccaagagcaacgtgacccacaagcagagccccagaaacaagatcgacgagaagtgcgtgcaggacgaggaggccaacaccgacgacctgaccaccctggacagaaaggccatcctgcagcagggctacgccgacaacagctgcgacaagcagcagagagccagaaagctggacgccgagatcgtggccgccgagaagaagaagcagatcgtggccgagcaggtgatgatcgaccacctgagcagagccgtgatcagcgaccccgagcagaacctggccatcgagcagaaggagagcgaccacatcctgcccgacagcaagatgacccccctgagattcagaaagagaaccctgcacgagaccaagatcagaacccacagcaccctgaccgagaacgtgctgagccacaagctgcagttcgacggcagaatcgtgagcagaaacggcagagacgcctgcagagagctgatcggcttcttcttcacccacgaccagagcctgaccatctacgagtacagacagttcggcaagaacagaaccaacgtgctgcccttcatccagaagagcatctacagccaccagtgcggcagaagaaagggcaagcagtacagactgggcgacttctacgtgggcgccaccctgaccttcctgagcagcgaccacctgagcctgcccgagagcatcaaggagaacaccctgctgaagctgagaatcaccaacatcgaccagatcgccctggacagcctgaagaccgccagcatggagcaggaggacgacatcatcatccaggagaccaacgacagactggtgttcaaggccatccaggacgtgctgaaggagaagctgcacaagagaggcgtgagaatcctgaccggcctgggcaagtacttccagcagctggacaaggagggcaacggcctgctggacaaggccgacttcaagcaggccctgaaggtgttccacctggaggtgagcgagaaggacttcgagagcgcctggctgatcctgaacgacaacggcaacggcaaggtggactacggcgagttcaagagaggcatcatcggcgagatgaacgagtacagaaagagctacgtgagaaaggccttcatgaagctggacttcaacaagagcggcagcgtgcccatcatcaacatcagaaagtgctactgcgccaagaagcacagccaggtgatcagcggctag

SEQ ID NO: 75146 - DNA, 615 bp, Artificial Sequence
  Description of Artificial Sequence: Synthetic coding sequence
atggagcaggaggacgacatcatcatccaggagaccaacgacagactggtgttcaaggccatccaggacgtgctgaaggagaagctgcacaagagaggcgtgagaatcctgaccggcctgggcaagtacttccagcagctggacaaggagggcaacggcctgctggacaaggccgacttcaagcaggccctgaaggtgttccacctggaggtgagcgagaaggacttcgagagcgcctggctgatcctgaacgacaacggcaacggcaaggtggactacggcgagttcaagagaggcatcatcggcgagatgaacgagtacagaaagagctacgtgagaaaggccttcatgaagctggacttcaacaagagcggcagcgtgcccatcatcaacatcagaaagtgctactgcgccaagaagcacagccaggtgatcagcggccacagcaccgaggaggagatcaagagcagcttcctggagaccctgaaggtggcctgcagcaagagcgacgaggtgagctacggcgagttcgaggactactacgagggcctgagcatcggcatcgtggacgacgaggacttcgtgaacatcctgagaaccccctggggcatctag

SEQ ID NO: 75147 - DNA, 3009 bp, Artificial Sequence
  Description of Artificial Sequence: Synthetic coding sequence
atggccgcccacgagtgggactggttccagagagaggagctgatcggccagatcagcgacatcagagtgcagaacctgcaggtggagagagagaacgtgcagaagagaaccttcaccagatggatcaacctgcacctggagaagtgcaacccccccctggaggtgaaggacctgttcgtggacatccaggacggcaagatcctgatggccctgctggaggtgctgagcggcagaaacctgctgcacgagtacaagagcagcagccacagaatcttcagactgaacaacatcgccaaggccctgaagttcctggaggacagcaacgtgaagctggtgagcatcgacgccgccgagatcgccgacggcaaccccagcctggtgctgggcctgatctggaacatcatcctgttcttccagatcaaggagctgaccggcaacctgagcagaaacagccccagcagcagcctgagccccggcagcggcggcaccgacagcgacagcagcttcccccccacccccaccgccgagagaagcgtggccatcagcgtgaaggaccagagaaaggccatcaaggccctgctggcctgggtgcagagaaagaccagaaagtacggcgtggccgtgcaggacttcgccggcagctggagaagcggcctggccttcctggccgtgatcaaggccatcgaccccagcctggtggacatgaagcaggccctggagaacagcaccagagagaacctggagaaggccttcagcatcgcccaggacgccctgcacatccccagactgctggagcccgaggacatcatggtggacacccccgacgagcagagcatcatgacctacgtggcccagttcctggagagattccccgagctggaggccgaggacatcttcgacagcgacaaggaggtgcccatcgagagcaccttcgtgagaatcaaggagacccccagcgagcaggagagcaaggtgttcgtgctgaccgagaacggcgagagaacctacaccgtgaaccacgagaccagccaccccccccccagcaaggtgttcgtgtgcgacaagcccgagagcatgaaggagttcagactggacggcgtgagcagccacgccctgagcgacagcagcaccgagttcatgcaccagatcatcgaccaggtgctgcagggcggccccggcaagaccagcgacatcagcgagcccagccccgagagcagcatcctgagcagcagaaaggagaacggcagaagcaacagcctgcccatcaagaagaccgtgcacttcgaggccgacacctacaaggaccccttctgcagcaagaacctgagcctgtgcttcgagggcagccccagagtggccaaggagagcctgagacaggacggccacgtgctggccgtggaggtggccgaggagaaggagcagaagcaggagagcagcaagatccccgagagcagcagcgacaaggtggccggcgacatcttcctggtggagggcaccaacaacaacagccagagcagcagctgcaacggcgccctggagagcaccgccagacacgacgaggagagccacagcctgagcccccccggcgagaacaccgtgatggccgacagcttccagatcaaggtgaacctgatgaccgtggaggccctggaggagggcgactacttcgaggccatccccctgaaggccagcaagttcaacagcgacctgatcgacttcgccagcaccagccaggccttcaacaaggtgcccagcccccacgagaccaagcccgacgaggacgccgaggccttcgagaaccacgccgagaagctgggcaagagaagcatcaagagcgcccacaagaagaaggacagccccgagccccaggtgaagatggacaagcacgagccccaccaggacagcggcgaggaggccgagggctgccccagcgcccccgaggagacccccgtggacaagaagcccgaggtgcacgagaaggccaagagaaagagcaccagaccccactacgaggaggagggcgaggacgacgacctgcagggcgtgggcgaggagctgagcagcagcccccccagcagctgcgtgagcctggagaccctgggcagccacagcgaggagggcctggacttcaagcccagcccccccctgagcaaggtgagcgtgatcccccacgacctgttctacttcccccactacgaggtgcccctggccgccgtgctggaggcctacgtggaggaccccgaggacctgaagaacgaggagatggacctggaggagcccgagggctacatgcccgacctggacagcagagaggaggaggccgacggcagccagagcagcagcagcagcagcgtgcccggcgagagcctgcccagcgccagcgaccaggtgctgtacctgagcagaggcggcgtgggcaccacccccgccagcgagcccgcccccctggccccccacgaggaccaccagcagagagagaccaaggagaacgaccccatggacagccaccagagccaggagagccccaacctggagaacatcgccaaccccctggaggagaacgtgaccaaggagagcatcagcagcaagaagaaggagaagagaaagcacgtggaccacgtggagagcagcctgttcgtggcccccggcagcgtgcagagcagcgacgacctggaggaggacagcagcgactacagcatccccagcagaaccagccacagcgacagcagcatctacctgagaagacacacccacagaagcagcgagagcgaccacttcagctacgtgcagctgagaaacgccgccgacctggacgacagaagaaacagaatcctgaccagaaaggccaacagcagcggcgaggccatgagcctgggcagccacagcccccagagcgacagcctgacccagctggtgcagcagcccgacatgatgtacttcatcctgttcctgtggctgctggtgtactgcctgctgctgttcccccagctggacgtgagcagactgtag

SEQ ID NO: 75148 - DNA, 450 bp, Artificial Sequence
  Description of Artificial Sequence: Synthetic coding sequence
atggccgaccagctgaccgaggagcagatcgccgagttcaaggaggccttcagcctgttcgacaaggacggcgacggcaccatcaccaccaaggagctgggcaccgtgatgagaagcctgggccagaaccccaccgaggccgagctgcaggacatgatcaacgaggtggacgccgacggcaacggcaccatcgacttccccgagttcctgaccatgatggccagaaagatgaaggacaccgacagcgaggaggagatcagagaggccttcagagtgttcgacaaggacggcaacggctacatcagcgccgccgagctgagacacgtgatgaccaacctgggcgagaagctgaccgacgaggaggtggacgagatgatcagagaggccgacatcgacggcgacggccaggtgaactacgaggagttcgtgcagatgatgaccgccaagtag

SEQ ID NO: 75149 - DNA, 450 bp, Artificial Sequence; identical to SEQ ID NO: 75148
  Description of Artificial Sequence: Synthetic coding sequence

SEQ ID NO: 75150 - DNA, 450 bp, Artificial Sequence; identical to SEQ ID NO: 75148
  Description of Artificial Sequence: Synthetic coding sequence

SEQ ID NO: 75151 - DNA, 450 bp, Artificial Sequence; identical to SEQ ID NO: 75148
  Description of Artificial Sequence: Synthetic coding sequence

SEQ ID NO: 75152 - DNA, 5022 bp, Artificial Sequence
  Description of Artificial Sequence: Synthetic coding sequence
atgtggagagccgagggcaagtggctgcccaagaccagcagaaagagcgtgagccagagcgtgttctgcggcaccagcacctactgcgtgctgaacaccgtgccccccatcgaggacgaccacggcaacagcaacagcagccacgtgaagatcttcctgcccaagaagctgctggagtgcctgcccaagtgcagcagcctgcccaaggagagacacagatggaacaccaacgaggagatcgccgcctacctgatcaccttcgagaagcacgaggagtggctgaccaccagccccaagaccagaccccagaacggcagcatgatcctgtacaacagaaagaaggtgaagtacagaaaggacggctactgctggaagaagagaaaggacggcaagaccaccagagaggaccacatgaagctgaaggtgcagggcgtggagtgcctgtacggctgctacgtgcacagcagcatcatccccaccttccacagaagatgctactggctgctgcagaaccccgacatcgtgctggtgcactacctgaacgtgcccgccatcgaggactgcggcaagccctgcggccccatcctgtgcagcatcaacaccgacaagaaggagtgggccaagtggaccaaggaggagctgatcggccagctgaagcccatgttccacggcatcaagtggacctgcagcaacggcaacagcagcagcggcttcagcgtggagcagctggtgcagcagatcctggacagccaccagaccaagccccagcccagaacccacaactgcctgtgcaccggcagcctgggcgccggcggcagcgtgcaccacaagtgcaacagcgccaagcacagaatcatcagccccaaggtggagcccagaaccggcggctacggcagccacagcgaggtgcagcacaacgacgtgagcgagggcaagcacgagcacagccacagcaagggcagcagcagagagaagagaaacggcaaggtggccaagcccgtgctgctgcaccagagcagcaccgaggtgagcagcaccaaccaggtggaggtgcccgacaccacccagagcagccccgtgagcatcagcagcggcctgaacagcgaccccgacatggtggacagccccgtggtgaccggcgtgagcggcatggccgtggccagcgtgatgggcagcctgagccagagcgccaccgtgttcatgagcgaggtgaccaacgaggccgtgtacaccatgagccccaccgccggccccaaccaccacctgctgagccccgacgccagccagggcctggtgctggccgtgagcagcgacggccacaagttcgccttccccaccaccggcagcagcgagagcctgagcatgctgcccaccaacgtgagcgaggagctggtgctgagcaccaccctggacggcggcagaaagatccccgagaccaccatgaacttcgaccccgactgcttcctgaacaaccccaagcagggccagacctacggcggcggcggcctgaaggccgagatggtgagcagcaacatcagacacagcccccccggcgagagaagcttcagcttcaccaccgtgctgaccaaggagatcaagaccgaggacaccagcttcgagcagcagatggccaaggaggcctacagcagcagcgccgccgccgtggccgccagcagcctgaccctgaccgccggcagcagcctgctgcccagcggcggcggcctgagccccagcaccaccctggagcagatggacttcagcgccatcgacagcaacaaggactacaccagcagcttcagccagaccggccacagcccccacatccaccagacccccagccccagcttcttcctgcaggacgccagcaagcccctgcccgtggagcagaacacccacagcagcctgagcgacagcggcggcaccttcgtgatgcccaccgtgaagaccgaggccagcagccagaccagcagctgcagcggccacgtggagaccagaatcgagagcaccagcagcctgcacctgatgcagttccaggccaacttccaggccatgaccgccgagggcgaggtgaccatggagaccagccaggccgccgagggcagcgaggtgctgctgaagagcggcgagctgcaggcctgcagcagcgagcactacctgcagcccgagaccaacggcgtgatcagaagcgccggcggcgtgcccatcctgcccggcaacgtggtgcagggcctgtaccccgtggcccagcccagcctgggcaacgccagcaacatggagctgagcctggaccacttcgacatcagcttcagcaaccagttcagcgacctgatcaacgacttcatcagcgtggagggcggcagcagcaccatctacggccaccagctggtgagcggcgacagcaccgccctgagccagagcgaggacggcgccagagcccccttcacccaggccgagatgtgcctgccctgctgcagcccccagcagggcagcctgcagctgagcagcagcgagggcggcgccagcaccatggcctacatgcacgtggccgaggtggtgagcgccgccagcgcccagggcaccctgggcatgctgcagcagagcggcagagtgttcatggtgaccgactacagccccgagtggagctaccccgagggcggcgtgaaggtgctgatcaccggcccctggcaggaggccagcaacaactacagctgcctgttcgaccagatcagcgtgcccgccagcctgatccagcccggcgtgctgagatgctactgccccgcccacgacaccggcctggtgaccctgcaggtggccttcaacaaccagatcatcagcaacagcgtggtgttcgagtacaaggccagagccctgcccaccctgcccagcagccagcacgactggctgagcctggacgacaaccagttcagaatgagcatcctggagagactggagcagatggagagaagaatggccgagatgaccggcagccagcagcacaagcaggccagcggcggcggcagcagcggcggcggcagcggcagcggcaacggcggcagccaggcccagtgcgccagcggcaccggcgccctgggcagctgcttcgagagcagagtggtggtggtgtgcgagaagatgatgagcagagcctgctgggccaagagcaagcacctgatccacagcaagaccttcagaggcatgaccctgctgcacctggccgccgcccagggctacgccaccctgatccagaccctgatcaagtggagaaccaagcacgccgacagcatcgacctggagctggaggtggaccccctgaacgtggaccacttcagctgcacccccctgatgtgggcctgcgccctgggccacctggaggccgccgtggtgctgtacaagtgggacagaagagccatcagcatccccgacagcctgggcagactgcccctgggcatcgccagaagcagaggccacgtgaagctggccgagtgcctggagcacctgcagagagacgagcaggcccagctgggccagaaccccagaatccactgccccgccagcgaggagcccagcaccgagagctggatggcccagtggcacagcgaggccatcagcagccccgagatccccaagggcgtgaccgtgatcgccagcaccaaccccgagctgagaagacccagaagcgagcccagcaactactacagcagcgagagccacaaggactaccccgcccccaagaagcacaagctgaaccccgagtacttccagaccagacaggagaagctgctgcccaccgccctgagcctggaggagcccaacatcagaaagcagagccccagcagcaagcagagcgtgcccgagaccctgagccccagcgagggcgtgagagacttcagcagagagctgagcccccccacccccgagaccgccgccttccaggccagcggcagccagcccgtgggcaagtggaacagcaaggacctgtacatcggcgtgagcaccgtgcaggtgaccggcaaccccaagggcaccagcgtgggcaaggaggccgcccccagccaggtgagacccagagagcccatgagcgtgctgatgatggccaacagagaggtggtgaacaccgagctgggcagctacagagacagcgccgagaacgaggagtgcggccagcccatggacgacatccaggtgaacatgatgaccctggccgagcacatcatcgaggccacccccgacagaatcaagcaggagaacttcgtgcccatggagagcagcggcctggagagaaccgaccccgccaccatcagcagcaccatgagctggctggccagctacctggccgacgccgactgcctgcccagcgccgcccagatcagaagcgcctacaacgagcccctgacccccagcagcaacaccagcctgagccccgtgggcagccccgtgagcgagatcgccttcgagaagcccaacctgcccagcgccgccgactggagcgagttcctgagcgccagcaccagcgagaaggtggagaacgagttcgcccagctgaccctgagcgaccacgagcagagagagctgtacgaggccgccagactggtgcagaccgccttcagaaagtacaagggcagacccctgagagagcagcaggaggtggccgccgccgtgatccagagatgctacagaaagtacaagcagtacgccctgtacaagaagatgacccaggccgccatcctgatccagagcaagttcagaagctactacgagcagaagaagttccagcagagcagaagagccgccgtgctgatccagaagtactacagaagctacaagaagtgcggcaagagaagacaggccagaagaaccgccgtgatcgtgcagcagaagctgagaagcagcctgctgaccaagaagcaggaccaggccgccagaaagatcatgagattcctgagaagatgcagacacagccccctggtggaccacagactgtacaagagaagcgagagaatcgagaagggccagggcacctag

SEQ ID NO: 75153 - DNA, 1911 bp, Artificial Sequence
  Description of Artificial Sequence: Synthetic coding sequence
atgatgagcagagcctgctgggccaagagcaagcacctgatccacagcaagaccttcagaggcatgaccctgctgcacctggccgccgcccagggctacgccaccctgatccagaccctgatcaagtggagaaccaagcacgccgacagcatcgacctggagctggaggtggaccccctgaacgtggaccacttcagctgcacccccctgatgtgggcctgcgccctgggccacctggaggccgccgtggtgctgtacaagtgggacagaagagccatcagcatccccgacagcctgggcagactgcccctgggcatcgccagaagcagaggccacgtgaagctggccgagtgcctggagcacctgcagagagacgagcaggcccagctgggccagaaccccagaatccactgccccgccagcgaggagcccagcaccgagagctggatggcccagtggcacagcgaggccatcagcagccccgagatccccaagggcgtgaccgtgatcgccagcaccaaccccgagctgagaagacccagaagcgagcccagcaactactacagcagcgagagccacaaggactaccccgcccccaagaagcacaagctgaaccccgagtacttccagaccagacaggagaagctgctgcccaccgccctgagcctggaggagcccaacatcagaaagcagagccccagcagcaagcagagcgtgcccgagaccctgagccccagcgagggcgtgagagacttcagcagagagctgagcccccccacccccgagaccgccgccttccaggccagcggcagccagcccgtgggcaagtggaacagcaaggacctgtacatcggcgtgagcaccgtgcaggtgaccggcaaccccaagggcaccagcgtgggcaaggaggccgcccccagccaggtgagacccagagagcccatgagcgtgctgatgatggccaacagagaggtggtgaacaccgagctgggcagctacagagacagcgccgagaacgaggagtgcggccagcccatggacgacatccaggtgaacatgatgaccctggccgagcacatcatcgaggccacccccgacagaatcaagcaggagaacttcgtgcccatggagagcagcggcctggagagaaccgaccccgccaccatcagcagcaccatgagctggctggccagctacctggccgacgccgactgcctgcccagcgccgcccagatcagaagcgcctacaacgagcccctgacccccagcagcaacaccagcctgagccccgtgggcagccccgtgagcgagatcgccttcgagaagcccaacctgcccagcgccgccgactggagcgagttcctgagcgccagcaccagcgagaaggtggagaacgagttcgcccagctgaccctgagcgaccacgagcagagagagctgtacgaggccgccagactggtgcagaccgccttcagaaagtacaagggcagacccctgagagagcagcaggaggtggccgccgccgtgatccagagatgctacagaaagtacaagcagggcaagaacatctgcctgaagtacgccctgtacaagaagatgacccaggccgccatcctgatccagagcaagttcagaagctactacgagcagaagaagttccagcagagcagaagagccgccgtgctgatccagaagtactacagaagctacaagaagtgcggcaagagaagacaggccagaagaaccgccgtgatcgtgcagcagaagctgagaagcagcctgctgaccaagaagcaggaccaggccgccagaaagatcatgagattcctgagaagatgcagacacagagtgaaggagctgaagaaggccaaggagctggaggacatccagcagcaccccctggccatgtag

SEQ ID NO: 75154 - DNA, 2151 bp, Artificial Sequence
  Description of Artificial Sequence: Synthetic coding sequence
atggcctgccccgtgagccccgaccacaagcaggagggcgcccacgacaccggcctggtgaccctgcaggtggccttcaacaaccagatcatcagcaacagcgtggtgttcgagtacaaggccagagccctgcccaccctgcccagcagccagcacgactggctgagcctggacgacaaccagttcagaatgagcatcctggagagactggagcagatggagagaagaatggccgagatgaccggcagccagcagcacaagcaggccagcggcggcggcagcagcggcggcggcagcggcagcggcaacggcggcagccaggcccagtgcgccagcggcaccggcgccctgggcagctgcttcgagagcagagtggtggtggtgtgcgagaagatgatgagcagagcctgctgggccaagagcaagcacctgatccacagcaagaccttcagaggcatgaccctgctgcacctggccgccgcccagggctacgccaccctgatccagaccctgatcaagtggagaaccaagcacgccgacagcatcgacctggagctggaggtggaccccctgaacgtggaccacttcagctgcacccccctgatgtgggcctgcgccctgggccacctggaggccgccgtggtgctgtacaagtgggacagaagagccatcagcatccccgacagcctgggcagactgcccctgggcatcgccagaagcagaggccacgtgaagctggccgagtgcctggagcacctgcagagagacgagcaggcccagctgggccagaaccccagaatccactgccccgccagcgaggagcccagcaccgagagctggatggcccagtggcacagcgaggccatcagcagccccgagatccccaagggcgtgaccgtgatcgccagcaccaaccccgagctgagaagacccagaagcgagcccagcaactactacagcagcgagagccacaaggactaccccgcccccaagaagcacaagctgaaccccgagtacttccagaccagacaggagaagctgctgcccaccgccctgagcctggaggagcccaacatcagaaagcagagccccagcagcaagcagagcgtgcccgagaccctgagccccagcgagggcgtgagagacttcagcagagagctgagcccccccacccccgagaccgccgccttccaggccagcggcagccagcccgtgggcaagtggaacagcaaggacctgtacatcggcgtgagcaccgtgcaggtgaccggcaaccccaagggcaccagcgtgggcaaggaggccgcccccagccaggtgagacccagagagcccatgagcgtgctgatgatggccaacagagaggtggtgaacaccgagctgggcagctacagagacagcgccgagaacgaggagtgcggccagcccatggacgacatccaggtgaacatgatgaccctggccgagcacatcatcgaggccaccctgagcagcaccatgagctggctggccagctacctggccgacgccgactgcctgcccagcgccgcccagatcagaagcgcctacaacgagcccctgacccccagcagcaacaccagcctgagccccgtgggcagccccgtgagcgagatcgccttcgagaaggtggagaacgagttcgcccagctgaccctgagcgaccacgagcagagagagctgtacgaggccgccagactggtgcagaccgccttcagaaagtacaagggcagacccctgagagagcagcaggaggtggccgccgccgtgatccagagatgctacagaaagtacaagcagtacgccctgtacaagaagatgacccaggccgccatcctgatccagagcaagttcagaagctactacgagcagaagaagttccagcagagcagaagagccgccgtgctgatccagaagtactacagaagctacaagaagtgcggcaagagaagacaggccagaagaaccgccgtgatcgtgcagcagaagctgagaagcagcctgctgaccaagaagcaggaccaggccgccagaaagatcatgagattcctgagaagatgcagacacagagtgaaggagctgaagaaggccaaggagctggaggacatccagcagcaccccctggccatgtag

SEQ ID NO: 75155 - DNA, 4980 bp, Artificial Sequence
  Description of Artificial Sequence: Synthetic coding sequence
atgtggagagccgagggcaagtggctgcccaagaccagcagaaagagcgtgagccagagcgtgttctgcggcaccagcacctactgcgtgctgaacaccgtgccccccatcgaggacgaccacggcaacagcaacagcagccacgtgaagatcttcctgcccaagaagctgctggagtgcctgcccaagtgcagcagcctgcccaaggagagacacagatggaacaccaacgaggagatcgccgcctacctgatcaccttcgagaagcacgaggagtggctgaccaccagccccaagaccagaccccagaacggcagcatgatcctgtacaacagaaagaaggtgaagtacagaaaggacggctactgctggaagaagagaaaggacggcaagaccaccagagaggaccacatgaagctgaaggtgcagggcgtggagtgcctgtacggctgctacgtgcacagcagcatcatccccaccttccacagaagatgctactggctgctgcagaaccccgacatcgtgctggtgcactacctgaacgtgcccgccatcgaggactgcggcaagccctgcggccccatcctgtgcagcatcaacaccgacaagaaggagtgggccaagtggaccaaggaggagctgatcggccagctgaagcccatgttccacggcatcaagtggacctgcagcaacggcaacagcagcagcggcttcagcgtggagcagctggtgcagcagatcctggacagccaccagaccaagccccagcccagaacccacaactgcctgtgcaccggcagcctgggcgccggcggcagcgtgcaccacaagtgcaacagcgccaagcacagaatcatcagccccaaggtggagcccagaaccggcggctacggcagccacagcgaggtgcagcacaacgacgtgagcgagggcaagcacgagcacagccacagcaagggcagcagcagagagaagagaaacggcaaggtggccaagcccgtgctgctgcaccagagcagcaccgaggtgagcagcaccaaccaggtggaggtgcccgacaccacccagagcagccccgtgagcatcagcagcggcctgaacagcgaccccgacatggtggacagccccgtggtgaccggcgtgagcggcatggccgtggccagcgtgatgggcagcctgagccagagcgccaccgtgttcatgagcgaggtgaccaacgaggccgtgtacaccatgagccccaccgccggccccaaccaccacctgctgagccccgacgccagccagggcctggtgctggccgtgagcagcgacggccacaagttcgccttccccaccaccggcagcagcgagagcctgagcatgctgcccaccaacgtgagcgaggagctggtgctgagcaccaccctggacggcggcagaaagatccccgagaccaccatgaacttcgaccccgactgcttcctgaacaaccccaagcagggccagacctacggcggcggcggcctgaaggccgagatggtgagcagcaacatcagacacagcccccccggcgagagaagcttcagcttcaccaccgtgctgaccaaggagatcaagaccgaggacaccagcttcgagcagcagatggccaaggaggcctacagcagcagcgccgccgccgtggccgccagcagcctgaccctgaccgccggcagcagcctgctgcccagcggcggcggcctgagccccagcaccaccctggagcagatggacttcagcgccatcgacagcaacaaggactacaccagcagcttcagccagaccggccacagcccccacatccaccagacccccagccccagcttcttcctgcaggacgccagcaagcccctgcccgtggagcagaacacccacagcagcctgagcgacagcggcggcaccttcgtgatgcccaccgtgaagaccgaggccagcagccagaccagcagctgcagcggccacgtggagaccagaatcgagagcaccagcagcctgcacctgatgcagttccaggccaacttccaggccatgaccgccgagggcgaggtgaccatggagaccagccaggccgccgagggcagcgaggtgctgctgaagagcggcgagctgcaggcctgcagcagcgagcactacctgcagcccgagaccaacggcgtgatcagaagcgccggcggcgtgcccatcctgcccggcaacgtggtgcagggcctgtaccccgtggcccagcccagcctgggcaacgccagcaacatggagctgagcctggaccacttcgacatcagcttcagcaaccagttcagcgacctgatcaacgacttcatcagcgtggagggcggcagcagcaccatctacggccaccagctggtgagcggcgacagcaccgccctgagccagagcgaggacggcgccagagcccccttcacccaggccgagatgtgcctgccctgctgcagcccccagcagggcagcctgcagctgagcagcagcgagggcggcgccagcaccatggcctacatgcacgtggccgaggtggtgagcgccgccagcgcccagggcaccctgggcatgctgcagcagagcggcagagtgttcatggtgaccgactacagccccgagtggagctaccccgagggcggcgtgaaggtgctgatcaccggcccctggcaggaggccagcaacaactacagctgcctgttcgaccagatcagcgtgcccgccagcctgatccagcccggcgtgctgagatgctactgccccgcccacgacaccggcctggtgaccctgcaggtggccttcaacaaccagatcatcagcaacagcgtggtgttcgagtacaaggccagagccctgcccaccctgcccagcagccagcacgactggctgagcctggacgacaaccagttcagaatgagcatcctggagagactggagcagatggagagaagaatggccgagatgaccggcagccagcagcacaagcaggccagcggcggcggcagcagcggcggcggcagcggcagcggcaacggcggcagccaggcccagtgcgccagcggcaccggcgccctgggcagctgcttcgagagcagagtggtggtggtgtgcgagaagatgatgagcagagcctgctgggccaagagcaagcacctgatccacagcaagaccttcagaggcatgaccctgctgcacctggccgccgcccagggctacgccaccctgatccagaccctgatcaagtggagaaccaagcacgccgacagcatcgacctggagctggaggtggaccccctgaacgtggaccacttcagctgcacccccctgatgtgggcctgcgccctgggccacctggaggccgccgtggtgctgtacaagtgggacagaagagccatcagcatccccgacagcctgggcagactgcccctgggcatcgccagaagcagaggccacgtgaagctggccgagtgcctggagcacctgcagagagacgagcaggcccagctgggccagaaccccagaatccactgccccgccagcgaggagcccagcaccgagagctggatggcccagtggcacagcgaggccatcagcagccccgagatccccaagggcgtgaccgtgatcgccagcaccaaccccgagctgagaagacccagaagcgagcccagcaactactacagcagcgagagccacaaggactaccccgcccccaagaagcacaagctgaaccccgagtacttccagaccagacaggagaagctgctgcccaccgccctgagcctggaggagcccaacatcagaaagcagagccccagcagcaagcagagcgtgcccgagaccctgagccccagcgagggcgtgagagacttcagcagagagctgagcccccccacccccgagaccgccgccttccaggccagcggcagccagcccgtgggcaagtggaacagcaaggacctgtacatcggcgtgagcaccgtgcaggtgaccggcaaccccaagggcaccagcgtgggcaaggaggccgcccccagccaggtgagacccagagagcccatgagcgtgctgatgatggccaacagagaggtggtgaacaccgagctgggcagctacagagacagcgccgagaacgaggagtgcggccagcccatggacgacatccaggtgaacatgatgaccctggccgagcacatcatcgaggccacccccgacagaatcaagcaggagaacttcgtgcccatggagagcagcggcctggagagaaccgaccccgccaccatcagcagcaccatgagctggctggccagctacctggccgacgccgactgcctgcccagcgccgcccagatcagactgagccccgtgggcagccccgtgagcgagatcgccttcgagaagcccaacctgcccagcgccgccgactggagcgagttcctgagcgccagcaccagcgagaaggtggagaacgagttcgcccagctgaccctgagcgaccacgagcagagagagctgtacgaggccgccagactggtgcagaccgccttcagaaagtacaagggcagacccctgagagagcagcaggaggtggccgccgccgtgatccagagatgctacagaaagtacaagcagtacgccctgtacaagaagatgacccaggccgccatcctgatccagagcaagttcagaagctactacgagcagaagaagttccagcagagcagaagagccgccgtgctgatccagaagtactacagaagctacaagaagtgcggcaagagaagacaggccagaagaaccgccgtgatcgtgcagcagaagctgagaagcagcctgctgaccaagaagcaggaccaggccgccagaaagatcatgagattcctgagaagatgcagacacagagtgaaggagctgaagaaggccaaggagctggaggacatccagcagcaccccctggccatgtag

SEQ ID NO: 75156 - DNA, 243 bp, Artificial Sequence
  Description of Artificial Sequence: Synthetic coding sequence
atgtggagagccgagggcaagtggctgcccaagaccagcagaaagagcgtgagccagagcgtgttctgcggcaccagcacctactgcgtgctgaacaccgtgccccccatcgaggacgaccacggcaacagcaacagcagccacgtgaagatcttcctgcccaagaagctgctggagtgcctgcccaagtgcagcagcctgcccaaggagagacacagatggaacaccaacgagagaagctag

SEQ ID NO: 75157 - DNA, 306 bp, Artificial Sequence
  Description of Artificial Sequence: Synthetic coding sequence
atgtggagagccgagggcaagtggctgcccaagaccagcagaaagagcgtgagccagagcgtgttctgcggcaccagcacctactgcgtgctgaacaccgtgccccccatcgaggacgaccacggcaacagcaacagcagccacgtgaagatcttcctgcccaagaagctgctggagtgcctgcccaagtgcagcagcctgcccaaggagagacacagatggaacaccaacgaggccctgaccacccacctgttcatgggcgccgccaagaagagagacccccagagctggagccacgagggctag

SEQ ID NO: 75158 - DNA, 3609 bp, Artificial Sequence
  Description of Artificial Sequence: Synthetic coding sequence
atgaacaccaaggacaccaccgaggtggccgagaacagccaccacctgaagatcttcctgcccaagaagctgctggagtgcctgcccagatgccccctgctgccccccgagagactgagatggaacaccaacgaggagatcgccagctacctgatcaccttcgagaagcacgacgagtggctgagctgcgcccccaagaccagaccccagaacggcagcatcatcctgtacaacagaaagaaggtgaagtacagaaaggacggctacctgtggaagaagagaaaggacggcaagaccaccagagaggaccacatgaagctgaaggtgcagggcatggagtgcctgtacggctgctacgtgcacagcagcatcgtgcccaccttccacagaagatgctactggctgctgcagaaccccgacatcgtgctggtgcactacctgaacgtgcccgccctggaggactgcggcaagggctgcagccccatcttctgcagcatcagcagcgacagaagagagtggctgaagtggagcagagaggagctgctgggccagctgaagcccatgttccacggcatcaagtggagctgcggcaacggcaccgaggagttcagcgtggagcacctggtgcagcagatcctggacacccaccccaccaagcccgcccccagaacccacgcctgcctgtgcagcggcggcctgggcagcggcagcctgacccacaagtgcagcagcaccaagcacagaatcatcagccccaaggtggagcccagagccctgaccctgaccagcatcccccacgcccacccccccgagcccccccccctgatcgcccccctgccccccgagctgcccaaggcccacaccagccccagcagcagcagcagcagcagcagcagcggcttcgccgagcccctggagatcagacccagcccccccaccagcagaggcggcagcagcagaggcggcaccgccatcctgctgctgaccggcctggagcagagagccggcggcctgacccccaccagacacctggccccccaggccgaccccagacccagcatgagcctggccgtggtggtgggcaccgagcccagcgccccccccgccccccccagccccgccttcgaccccgacagattcctgaacagcccccagagaggccagacctacggcggcggccagggcgtgagccccgacttccccgaggccgaggccgcccacaccccctgcagcgccctggagcccgccgccgccctggagccccaggccgccgccagaggcccccccccccagagcgtggccggcggcagaagaggcaactgcttcttcatccaggacgacgacagcggcgaggagctgaagggccacggcgccgccccccccatccccagccccccccccagccccccccccagccccgcccccctggagcccagcagcagagtgggcagaggcgaggccctgttcggcggccccgtgggcgccagcgagctggagcccttcagcctgagcagcttccccgacctgatgggcgagctgatcagcgacgaggcccccagcatccccgcccccaccccccagctgagccccgccctgagcaccatcaccgacttcagccccgagtggagctaccccgagggcggcgtgaaggtgctgatcaccggcccctggaccgaggccgccgagcactacagctgcgtgttcgaccacatcgccgtgcccgccagcctggtgcagcccggcgtgctgagatgctactgccccgcccacgaggtgggcctggtgagcctgcaggtggccggcagagagggccccctgagcgccagcgtgctgttcgagtacagagccagaagattcctgagcctgcccagcacccagctggactggctgagcctggacgacaaccagttcagaatgagcatcctggagagactggagcagatggagaagagaatggccgagatcgccgccgccggccaggtgccctgccagggccccgacgccccccccgtgcaggacgagggccagggccccggcttcgaggccagagtggtggtgctggtggagagcatgatccccagaagcacctggaagggccccgagagactggcccacggcagccccttcagaggcatgagcctgctgcacctggccgccgcccagggctacgccagactgatcgagaccctgagccagtggagaagcgtggagaccggcagcctggacctggagcaggaggtggaccccctgaacgtggaccacttcagctgcacccccctgatgtgggcctgcgccctgggccacctggaggccgccgtgctgctgttcagatggaacagacaggccctgagcatccccgacagcctgggcagactgcccctgagcgtggcccacagcagaggccacgtgagactggccagatgcctggaggagctgcagagacaggagcccagcgtggagccccccttcgccctgagcccccccagcagcagccccgacaccggcctgagcagcgtgagcagccccagcgagctgagcgacggcaccttcagcgtgaccagcgcctacagcagcgcccccgacggcagccccccccccgcccccctgcccgccagcgagatgaccatggaggacatggcccccggccagctgagcagcggcgtgcccgaggcccccctgctgctgatggactacgaggccaccaacagcaagggccccctgagcagcctgcccgccctgccccccgccagcgacgacggcgccgcccccgaggacgccgacagcccccaggccgtggacgtgatccccgtggacatgatcagcctggccaagcagatcatcgaggccacccccgagagaatcaagagagaggacttcgtgggcctgcccgaggccggcgccagcatgagagagagaaccggcgccgtgggcctgagcgagaccatgagctggctggccagctacctggagaacgtggaccacttccccagcagcaccccccccagcgagctgcccttcgagagaggcagactggccgtgcccagcgcccccagctgggccgagttcctgagcgccagcaccagcggcaagatggagagcgacttcgccctgctgaccctgagcgaccacgagcagagagagctgtacgaggccgccagagtgatccagaccgccttcagaaagtacaagggcagaagactgaaggagcagcaggaggtggccgccgccgtgatccagagatgctacagaaagtacaagcagctgacctggatcgccctgaagttcgccctgtacaagaagatgacccaggccgccatcctgatccagagcaagttcagaagctactacgagcagaagagattccagcagagcagaagagccgccgtgctgatccagcagcactacagaagctacagaagaagacccggccccccccacagaaccagcgccaccctgcccgccagaaacaagggcagcttcctgaccaagaagcaggaccaggccgccagaaagatcatgagattcctgagaagatgcagacacagaatgagagagctgaagcagaaccaggagctggagggcctgccccagcccggcctggccacctag

SEQ ID NO: 75159 - DNA, 3588 bp, Artificial Sequence
  Description of Artificial Sequence: Synthetic coding sequence
atgaacaccaaggacaccaccgaggtggccgagaacagccaccacctgaagatcttcctgcccaagaagctgctggagtgcctgcccagatgccccctgctgccccccgagagactgagatggaacaccaacgaggagatcgccagctacctgatcaccttcgagaagcacgacgagtggctgagctgcgcccccaagaccagaccccagaacggcagcatcatcctgtacaacagaaagaaggtgaagtacagaaaggacggctacctgtggaagaagagaaaggacggcaagaccaccagagaggaccacatgaagctgaaggtgcagggcatggagtgcctgtacggctgctacgtgcacagcagcatcgtgcccaccttccacagaagatgctactggctgctgcagaaccccgacatcgtgctggtgcactacctgaacgtgcccgccctggaggactgcggcaagggctgcagccccatcttctgcagcatcagcagcgacagaagagagtggctgaagtggagcagagaggagctgctgggccagctgaagcccatgttccacggcatcaagtggagctgcggcaacggcaccgaggagttcagcgtggagcacctggtgcagcagatcctggacacccaccccaccaagcccgcccccagaacccacgcctgcctgtgcagcggcggcctgggcagcggcagcctgacccacaagtgcagcagcaccaagcacagaatcatcagccccaaggtggagcccagagccctgaccctgaccagcatcccccacgcccacccccccgagcccccccccctgatcgcccccctgccccccgagctgcccaaggcccacaccagccccagcagcagcagcagcagcagcagcagcggcttcgccgagcccctggagatcagacccagcccccccaccagcagaggcggcagcagcagaggcggcaccgccatcctgctgctgaccggcctggagcagagagccggcggcctgacccccaccagacacctggccccccaggccgaccccagacccagcatgagcctggccgtggtggtgggcaccgagcccagcgccccccccgccccccccagccccgccttcgaccccgacagattcctgaacagcccccagagaggccagacctacggcggcggccagggcgtgagccccgacttccccgaggccgaggccgcccacaccccctgcagcgccctggagcccgccgccgccctggagccccaggccgccgccagaggcccccccccccagagcgtggccggcggcagaagaggcaactgcttcttcatccaggacgacgacagcggcgaggagctgaagggccacggcgccgccccccccatccccagccccccccccagccccccccccagccccgcccccctggagcccagcagcagagtgggcagaggcgaggccctgttcggcggccccgtgggcgccagcgagctggagcccttcagcctgagcagcttccccgacctgatgggcgagctgatcagcgacgaggcccccagcatccccgcccccaccccccagctgagccccgccctgagcaccatcaccgacttcagccccgagtggagctaccccgagggcggcgtgaaggtgctgatcaccggcccctggaccgaggccgccgagcactacagctgcgtgttcgaccacatcgccgtgcccgccagcctggtgcagcccggcgtgctgagatgctactgccccgcccacgaggtgggcctggtgagcctgcaggtggccggcagagagggccccctgagcgccagcgtgctgttcgagtacagagccagaagattcctgagcctgcccagcacccagctggactggctgagcctggacgacaaccagttcagaatgagcatcctggagagactggagcagatggagaagagaatggccgagatcgccgccgccggccaggtgccctgccagggccccgacgccccccccgtgcaggacgagggccagggccccggcttcgaggccagagtggtggtgctggtggagagcatgatccccagaagcacctggaagggccccgagagactggcccacggcagccccttcagaggcatgagcctgctgcacctggccgccgcccagggctacgccagactgatcgagaccctgagccagtggagaagcgtggagaccggcagcctggacctggagcaggaggtggaccccctgaacgtggaccacttcagctgcacccccctgatgtgggcctgcgccctgggccacctggaggccgccgtgctgctgttcagatggaacagacaggccctgagcatccccgacagcctgggcagactgcccctgagcgtggcccacagcagaggccacgtgagactggccagatgcctggaggagctgcagagacaggagcccagcgtggagccccccttcgccctgagcccccccagcagcagccccgacaccggcctgagcagcgtgagcagccccagcgagctgagcgacggcaccttcagcgtgaccagcgcctacagcagcgcccccgacggcagccccccccccgcccccctgcccgccagcgagatgaccatggaggacatggcccccggccagctgagcagcggcgtgcccgaggcccccctgctgctgatggactacgaggccaccaacagcaagggccccctgagcagcctgcccgccctgccccccgccagcgacgacggcgccgcccccgaggacgccgacagcccccaggccgtggacgtgatccccgtggacatgatcagcctggccaagcagatcatcgaggccacccccgagagaatcaagagagaggacttcgtgggcctgcccgaggccggcgccagcatgagagagagaaccggcgccgtgggcctgagcgagaccatgagctggctggccagctacctggagaacgtggaccacttccccagcagcaccccccccagcgagctgcccttcgagagaggcagactggccgtgcccagcgcccccagctgggccgagttcctgagcgccagcaccagcggcaagatggagagcgacttcgccctgctgaccctgagcgaccacgagcagagagagctgtacgaggccgccagagtgatccagaccgccttcagaaagtacaagggcagaagactgaaggagcagcaggaggtggccgccgccgtgatccagagatgctacagaaagtacaagcagttcgccctgtacaagaagatgacccaggccgccatcctgatccagagcaagttcagaagctactacgagcagaagagattccagcagagcagaagagccgccgtgctgatccagcagcactacagaagctacagaagaagacccggccccccccacagaaccagcgccaccctgcccgccagaaacaagggcagcttcctgaccaagaagcaggaccaggccgccagaaagatcatgagattcctgagaagatgcagacacagaatgagagagctgaagcagaaccaggagctggagggcctgccccagcccggcctggccacctag

SEQ ID NO: 75160 - DNA, 3606 bp, Artificial Sequence
  Description of Artificial Sequence: Synthetic coding sequence
atgggcaccgacagccccagccccagacccctgagacccggcgtgaccctgccccccggcgccctgaccatgaacaccaaggacaccaccgaggtggccgagaacagccaccacctgaagatcttcctgcccaagaagctgctggagtgcctgcccagatgccccctgctgccccccgagagactgagatggaacaccaacgaggagatcgccagctacctgatcaccttcgagaagcacgacgagtggctgagctgcgcccccaagaccagaccccagaacggcagcatcatcctgtacaacagaaagaaggtgaagtacagaaaggacggctacctgtggaagaagagaaaggacggcaagaccaccagagaggaccacatgaagctgaaggtgcagggcatggagaaccccgacatcgtgctggtgcactacctgaacgtgcccgccctggaggactgcggcaagggctgcagccccatcttctgcagcatcagcagcgacagaagagagtggctgaagtggagcagagaggagctgctgggccagctgaagcccatgttccacggcatcaagtggagctgcggcaacggcaccgaggagttcagcgtggagcacctggtgcagcagatcctggacacccaccccaccaagcccgcccccagaacccacgcctgcctgtgcagcggcggcctgggcagcggcagcctgacccacaagtgcagcagcaccaagcacagaatcatcagccccaaggtggagcccagagccctgaccctgaccagcatcccccacgcccacccccccgagcccccccccctgatcgcccccctgccccccgagctgcccaaggcccacaccagccccagcagcagcagcagcagcagcagcagcggcttcgccgagcccctggagatcagacccagcccccccaccagcagaggcggcagcagcagaggcggcaccgccatcctgctgctgaccggcctggagcagagagccggcggcctgacccccaccagacacctggccccccaggccgaccccagacccagcatgagcctggccgtggtggtgggcaccgagcccagcgccccccccgccccccccagccccgccttcgaccccgacagattcctgaacagcccccagagaggccagacctacggcggcggccagggcgtgagccccgacttccccgaggccgaggccgcccacaccccctgcagcgccctggagcccgccgccgccctggagccccaggccgccgccagaggcccccccccccagagcgtggccggcggcagaagaggcaactgcttcttcatccaggacgacgacagcggcgaggagctgaagggccacggcgccgccccccccatccccagccccccccccagccccccccccagccccgcccccctggagcccagcagcagagtgggcagaggcgaggccctgttcggcggccccgtgggcgccagcgagctggagcccttcagcctgagcagcttccccgacctgatgggcgagctgatcagcgacgaggcccccagcatccccgcccccaccccccagctgagccccgccctgagcaccatcaccgacttcagccccgagtggagctaccccgagggcggcgtgaaggtgctgatcaccggcccctggaccgaggccgccgagcactacagctgcgtgttcgaccacatcgccgtgcccgccagcctggtgcagcccggcgtgctgagatgctactgccccgcccacgaggtgggcctggtgagcctgcaggtggccggcagagagggccccctgagcgccagcgtgctgttcgagtacagagccagaagattcctgagcctgcccagcacccagctggactggctgagcctggacgacaaccagttcagaatgagcatcctggagagactggagcagatggagaagagaatggccgagatcgccgccgccggccaggtgccctgccagggccccgacgccccccccgtgcaggacgagggccagggccccggcttcgaggccagagtggtggtgctggtggagagcatgatccccagaagcacctggaagggccccgagagactggcccacggcagccccttcagaggcatgagcctgctgcacctggccgccgcccagggctacgccagactgatcgagaccctgagccagtggagaagcgtggagaccggcagcctggacctggagcaggaggtggaccccctgaacgtggaccacttcagctgcacccccctgatgtgggcctgcgccctgggccacctggaggccgccgtgctgctgttcagatggaacagacaggccctgagcatccccgacagcctgggcagactgcccctgagcgtggcccacagcagaggccacgtgagactggccagatgcctggaggagctgcagagacaggagcccagcgtggagccccccttcgccctgagcccccccagcagcagccccgacaccggcctgagcagcgtgagcagccccagcgagctgagcgacggcaccttcagcgtgaccagcgcctacagcagcgcccccgacggcagccccccccccgcccccctgcccgccagcgagatgaccatggaggacatggcccccggccagctgagcagcggcgtgcccgaggcccccctgctgctgatggactacgaggccaccaacagcaagggccccctgagcagcctgcccgccctgccccccgccagcgacgacggcgccgcccccgaggacgccgacagcccccaggccgtggacgtgatccccgtggacatgatcagcctggccaagcagatcatcgaggccacccccgagagaatcaagagagaggacttcgtgggcctgcccgaggccggcgccagcatgagagagagaaccggcgccgtgggcctgagcgagaccatgagctggctggccagctacctggagaacgtggaccacttccccagcagcaccccccccagcgagctgcccttcgagagaggcagactggccgtgcccagcgcccccagctgggccgagttcctgagcgccagcaccagcggcaagatggagagcgacttcgccctgctgaccctgagcgaccacgagcagagagagctgtacgaggccgccagagtgatccagaccgccttcagaaagtacaagggcagaagactgaaggagcagcaggaggtggccgccgccgtgatccagagatgctacagaaagtacaagcagctgacctggatcgccctgaagttcgccctgtacaagaagatgacccaggccgccatcctgatccagagcaagttcagaagctactacgagcagaagagattccagcagagcagaagagccgccgtgctgatccagcagcactacagaagctacagaagaagacccggccccccccacagaaccagcgccaccctgcccgccagaaacaagggcagcttcctgaccaagaagcaggaccaggccgccagaaagatcatgagattcctgagaagatgcagacacagaatgagagagctgaagcagaaccaggagctggagggcctgccccagcccggcctggccacctag

SEQ ID NO: 75161 - DNA, 3594 bp, Artificial Sequence
  Description of Artificial Sequence: Synthetic coding sequence
atggccgccgccgccgtgaccagaggcacccccggcgagaacagccaccacctgaagatcttcctgcccaagaagctgctggagtgcctgcccagatgccccctgctgccccccgagagactgagatggaacaccaacgaggagatcgccagctacctgatcaccttcgagaagcacgacgagtggctgagctgcgcccccaagaccagaccccagaacggcagcatcatcctgtacaacagaaagaaggtgaagtacagaaaggacggctacctgtggaagaagagaaaggacggcaagaccaccagagaggaccacatgaagctgaaggtgcagggcatggagtgcctgtacggctgctacgtgcacagcagcatcgtgcccaccttccacagaagatgctactggctgctgcagaaccccgacatcgtgctggtgcactacctgaacgtgcccgccctggaggactgcggcaagggctgcagccccatcttctgcagcatcagcagcgacagaagagagtggctgaagtggagcagagaggagctgctgggccagctgaagcccatgttccacggcatcaagtggagctgcggcaacggcaccgaggagttcagcgtggagcacctggtgcagcagatcctggacacccaccccaccaagcccgcccccagaacccacgcctgcctgtgcagcggcggcctgggcagcggcagcctgacccacaagtgcagcagcaccaagcacagaatcatcagccccaaggtggagcccagagccctgaccctgaccagcatcccccacgcccacccccccgagcccccccccctgatcgcccccctgccccccgagctgcccaaggcccacaccagccccagcagcagcagcagcagcagcagcagcggcttcgccgagcccctggagatcagacccagcccccccaccagcagaggcggcagcagcagaggcggcaccgccatcctgctgctgaccggcctggagcagagagccggcggcctgacccccaccagacacctggccccccaggccgaccccagacccagcatgagcctggccgtggtggtgggcaccgagcccagcgccccccccgccccccccagccccgccttcgaccccgacagattcctgaacagcccccagagaggccagacctacggcggcggccagggcgtgagccccgacttccccgaggccgaggccgcccacaccccctgcagcgccctggagcccgccgccgccctggagccccaggccgccgccagaggcccccccccccagagcgtggccggcggcagaagaggcaactgcttcttcatccaggacgacgacagcggcgaggagctgaagggccacggcgccgccccccccatccccagccccccccccagccccccccccagccccgcccccctggagcccagcagcagagtgggcagaggcgaggccctgttcggcggccccgtgggcgccagcgagctggagcccttcagcctgagcagcttccccgacctgatgggcgagctgatcagcgacgaggcccccagcatccccgcccccaccccccagctgagccccgccctgagcaccatcaccgacttcagccccgagtggagctaccccgagggcggcgtgaaggtgctgatcaccggcccctggaccgaggccgccgagcactacagctgcgtgttcgaccacatcgccgtgcccgccagcctggtgcagcccggcgtgctgagatgctactgccccgcccacgaggtgggcctggtgagcctgcaggtggccggcagagagggccccctgagcgccagcgtgctgttcgagtacagagccagaagattcctgagcctgcccagcacccagctggactggctgagcctggacgacaaccagttcagaatgagcatcctggagagactggagcagatggagaagagaatggccgagatcgccgccgccggccaggtgccctgccagggccccgacgccccccccgtgcaggacgagggccagggccccggcttcgaggccagagtggtggtgctggtggagagcatgatccccagaagcacctggaagggccccgagagactggcccacggcagccccttcagaggcatgagcctgctgcacctggccgccgcccagggctacgccagactgatcgagaccctgagccagtggagaagcgtggagaccggcagcctggacctggagcaggaggtggaccccctgaacgtggaccacttcagctgcacccccctgatgtgggcctgcgccctgggccacctggaggccgccgtgctgctgttcagatggaacagacaggccctgagcatccccgacagcctgggcagactgcccctgagcgtggcccacagcagaggccacgtgagactggccagatgcctggaggagctgcagagacaggagcccagcgtggagccccccttcgccctgagcccccccagcagcagccccgacaccggcctgagcagcgtgagcagccccagcgagctgagcgacggcaccttcagcgtgaccagcgcctacagcagcgcccccgacggcagccccccccccgcccccctgcccgccagcgagatgaccatggaggacatggcccccggccagctgagcagcggcgtgcccgaggcccccctgctgctgatggactacgaggccaccaacagcaagggccccctgagcagcctgcccgccctgccccccgccagcgacgacggcgccgcccccgaggacgccgacagcccccaggccgtggacgtgatccccgtggacatgatcagcctggccaagcagatcatcgaggccacccccgagagaatcaagagagaggacttcgtgggcctgcccgaggccggcgccagcatgagagagagaaccggcgccgtgggcctgagcgagaccatgagctggctggccagctacctggagaacgtggaccacttccccagcagcaccccccccagcgagctgcccttcgagagaggcagactggccgtgcccagcgcccccagctgggccgagttcctgagcgccagcaccagcggcaagatggagagcgacttcgccctgctgaccctgagcgaccacgagcagagagagctgtacgaggccgccagagtgatccagaccgccttcagaaagtacaagggcagaagactgaaggagcagcaggaggtggccgccgccgtgatccagagatgctacagaaagtacaagcagttcgccctgtacaagaagatgacccaggccgccatcctgatccagagcaagttcagaagctactacgagcagaagagattccagcagagcagaagagccgccgtgctgatccagcagcactacagaagctacagaagaagacccggccccccccacagaaccagcgccaccctgcccgccagaaacaagggcagcttcctgaccaagaagcaggaccaggccgccagaaagatcatgagattcctgagaagatgcagacacagaatgagagagctgaagcagaaccaggagctggagggcctgccccagcccggcctggccacctag

SEQ ID NO: 75162 - DNA, 3726 bp, Artificial Sequence
  Description of Artificial Sequence: Synthetic coding sequence
atgggcaccgacagccccagccccagacccctgagacccggcgtgaccctgccccccggcgccctgaccatgaacaccaaggacaccaccgaggtggccgagaacagccaccacctgaagatcttcctgcccaagaagctgctggagtgcctgcccagatgccccctgctgccccccgagagactgagatggaacaccaacgaggagatcgccagctacctgatcaccttcgagaagcacgacgagtggctgagctgcgcccccaagaccagaccccagaacggcagcatcatcctgtacaacagaaagaaggtgaagtacagaaaggacggctacctgtggaagaagagaaaggacggcaagaccaccagagaggaccacatgaagctgaaggtgcagggcatggagtgcctgtacggctgctacgtgcacagcagcatcgtgcccaccttccacagaagatgctactggctgctgcagaaccccgacatcgtgctggtgcactacctgaacgtgcccgccctggaggactgcggcaagggctgcagccccatcttctgcagcatcagcagcgacagaagagagtggctgaagtggagcagagaggagctgctgggccagctgaagcccatgttccacggcatcaagtggagctgcggcaacggcaccgaggagttcagcgtggagcacctggtgcagcagatcctggacacccaccccaccaagcccgcccccagaacccacgcctgcctgtgcagcggcggcctgggcagcggcagcctgacccacaagtgcagcagcaccaagcacagaatcatcagccccaaggtggagcccagagccctgaccctgaccagcatcccccacgcccacccccccgagcccccccccctgatcgcccccctgccccccgagctgcccaaggcccacaccagccccagcagcagcagcagcagcagcagcagcggcttcgccgagcccctggagatcagacccagcccccccaccagcagaggcggcagcagcagaggcggcaccgccatcctgctgctgaccggcctggagcagagagccggcggcctgacccccaccagacacctggccccccaggccgaccccagacccagcatgagcctggccgtggtggtgggcaccgagcccagcgccccccccgccccccccagccccgccttcgaccccgacagattcctgaacagcccccagagaggccagacctacggcggcggccagggcgtgagccccgacttccccgaggccgaggccgcccacaccccctgcagcgccctggagcccgccgccgccctggagccccaggccgccgccagaggcccccccccccagagcgtggccggcggcagaagaggcaactgcttcttcatccaggacgacgacagcggcgaggagctgaagggccacggcgccgccccccccatccccagccccccccccagccccccccccagccccgcccccctggagcccagcagcagagtgggcagaggcgaggccctgttcggcggccccgtgggcgccagcgagctggagcccttcagcctgagcagcttccccgacctgatgggcgagctgatcagcgacgaggcccccagcatccccgcccccaccccccagctgagccccgccctgagcaccatcaccgacttcagccccgagtggagctaccccgagggcggcgtgaaggtgctgatcaccggcccctggaccgaggccgccgagcactacagctgcgtgttcgaccacatcgccgtgcccgccagcctggtgcagcccggcgtgctgagatgctactgccccgcccacgaggtgggcctggtgagcctgcaggtggccggcagagagggccccctgagcgccagcgtgctgttcgagtacagagccagaagattcctgagcctgcccagcacccagctggactggctgagcctggacgacaaccagttcagaatgagcatcctggagagactggagcagatggagaagagaatggccgagatcgccgccgccggccaggtgccctgccagggccccgacgccccccccgtgcaggacgagggccagggccccggcttcgaggccagagtggtggtgctggtggagagcatgatccccagaagcacctggaagggccccgagagactggcccacggcagccccttcagaggcatgagcctgctgcacctggccgccgcccagggctacgccagactgatcgagaccctgagccagtggagaagcgtggagaccggcagcctggacctggagcaggaggtggaccccctgaacgtggaccacttcagctgcacccccctgatgtgggcctgcgccctgggccacctggaggccgccgtgctgctgttcagatggaacagacaggccctgagcatccccgacagcctgggcagactgcccctgagcgtggcccacagcagaggccacgtgagactggccagatgcctggaggagctgcagagacaggagcccagcgtggagccccccttcgccctgagcccccccagcagcagccccgacaccggcctgagcagcgtgagcagccccagcgagctgagcgacggcaccttcagcgtgaccagcgcctacagcagcgcccccgacggcagccccccccccgcccccctgcccgccagcgagatgaccatggaggacatggcccccggccagctgagcagcggcgtgcccgaggcccccctgctgctgatggactacgaggccaccaacagcaagggccccctgagcagcctgcccgccctgccccccgccagcgacgacggcgccgcccccgaggacgccgacagcccccaggccgtggacgtgatccccgtggacatgatcagcctggccaagcagatcatcgaggccacccccgagagaatcaagagagaggacttcgtgggcctgcccgaggccggcgccagcatgagagagagaaccggcgccgtgggcctgagcgagaccatgagctggctggccagctacctggagaacgtggaccacttccccagcagcaccccccccagcgagctgcccttcgagagaggcagactggccgtgcccagcgcccccagctgggccgagttcctgagcgccagcaccagcggcaagatggagagcgacttcgccctgctgaccctgagcgaccacgagcagagagagctgtacgaggccgccagagtgatccagaccgccttcagaaagtacaagggcagaagactgaaggagcagcaggaggtggccgccgccgtgatccagagatgctacagaaagtacaagcagctgacctggatcgccctgaagttcgccctgtacaagaagatgacccaggccgccatcctgatccagagcaagttcagaagctactacgagcagaagagattccagcagagcagaagagccgccgtgctgatccagcagcactacagaagctacagaagaagacccggccccccccacagaaccagcgccaccctgcccgccagaaacaagctgctgagccaccaggaggccggccccggcagccccgaggaccacgagatccccgccgccctgcccacccaggacgagggcaccgaggccgagcccggcgccggcagagccagccccgccggcaccggccacatgacctggcccccccccttcagccccccctggggcagactggtgcagagctag

SEQ ID NO: 75163 - DNA, 4470 bp, Artificial Sequence
  Description of Artificial Sequence: Synthetic coding sequence
atgggcgacgccgccgaccccagagagatgagaaagaccttcatcgtgcccgccatcaagcccttcgaccactacgacttcagcagagccaagatcgcctgcaacctggcctggctggtggccaaggccttcggcaccgagaacgtgcccgaggagctgcaggagcccttctacaccgaccagtacgaccaggagcacatcaagccccccgtggtgaacctgctgctgagcgccgagctgtactgcagagccggcagcctgatcctgaagagcgacgccgccaagcccctgctgggccacgacgccgtgatccaggccctggcccagaagggcctgtacgtgaccgaccaggagaagctggtgaccgagagagacctgcacaagaagcccatccagatgagcgcccacctggccatgatcgacaccctgatgatggcctacaccgtggagatggtgagcatcgagaaggtgatcgcctgcgcccagcagtacagcgccttcttccaggccaccgacctgccctacgacatcgaggacgccgtgatgtactggatcaacaaggtgaacgagcacctgaaggacatcatggagcaggagcagaagctgaaggagcaccacaccgtggaggcccccggcggccagaagagccccagcaagtggttctggaagctggtgcccgccagatacagaaaggagcagaccctgctgaagcagctgccctgcatccccctggtggagaacctgctgaaggacggcaccgacggctgcgccctggccgccctgatccacttctactgccccgacgtggtgagactggaggacatctgcctgaaggagaccatgagcctggccgacagcctgtacaacctgcagctgatccaggagttctgccaggagtacctgaaccagtgctgccacttcaccctggaggacatgctgtacgccgccagcagcatcaagagcaactacctggtgttcatggccgagctgttctggtggttcgaggtggtgaagcccagcttcgtgcagcccagagtggtgagaccccagggcgccgagcccgtgaaggacatgcccagcatccccgtgctgaacgccgccaagagaaacgtgctggacagcagcagcgacttccccagcagcggcgagggcgccaccttcacccagagccaccaccacctgcccagcagatacagcagaccccaggcccacagcagcgccagcggcggcatcagaagaagcagcagcatgagctacgtggacggcttcatcggcacctggcccaaggagaagagaagcagcgtgcacggcgtgagcttcgacatcagcttcgacaaggaggacagcgtgcagagaagcacccccaacagaggcatcaccagaagcatcagcaacgagggcctgaccctgaacaacagccacgtgagcaagcacatcagaaagaacctgagcttcaagcccatcaacggcgaggaggaggccgagagcatcgaggaggagctgaacatcgacagccacagcgacctgaagagctgcgtgcccctgaacaccaacgagctgaacagcaacgagaacatccactacaagctgcccaacggcgccctgcagaacagaatcctgctggacgagttcggcaaccagatcgagacccccagcatcgaggaggccctgcagatcatccacgacaccgagaagagcccccacaccccccagcccgaccagatcgccaacggcttcttcctgcacagccaggagatgagcatcctgaacagcaacatcaagctgaaccagagcagccccgacaacgtgaccgacaccaagggcgccctgagccccatcaccgacaacaccgaggtggacaccggcatccacgtgcccagcgaggacatccccgagaccatggacgaggacagcagcctgagagactacaccgtgagcctggacagcgacatggacgacgccagcaagttcctgcaggactacgacatcagaaccggcaacaccagagaggccctgagcccctgccccagcaccgtgagcaccaagagccagcccggcagcagcgccagcagcagcagcggcgtgaagatgaccagcttcgccgagcagaagttcagaaagctgaaccacaccgacggcaagagcagcggcagcagcagccagaagaccacccccgagggcagcgagctgaacatcccccacgtggtggcctgggcccagatccccgaggagaccggcctgccccagggcagagacaccacccagctgctggccagcgagatggtgcacctgagaatgaagctggaggagaagagaagagccatcgaggcccagaagaagaagatggaggccgccttcaccaagcagagacagaagatgggcagaaccgccttcctgaccgtggtgaagaagaagggcgacggcatcagccccctgagagaggaggccgccggcgccgaggacgagaaggtgtacaccgacagagccaaggagaaggagagccagaagaccgacggccagagaagcaagagcctggccgacatcaaggagagcatggagaacccccaggccaagtggctgaagagccccaccacccccatcgaccccgagaagcagtggaacctggccagccccagcgaggagaccctgaacgagggcgagatcctggagtacaccaagagcatcgagaagctgaacagcagcctgcacttcctgcagcaggagatgcagagactgagcctgcagcaggagatgctgatgcagatgagagagcagcagagctgggtgatcagccccccccagcccagcccccagaagcagatcagagacttcaagcccagcaagcaggccggcctgagcagcgccatcgcccccttcagcagcgacagccccagacccacccaccccagcccccagagcagcaacagaaagagcgccagcttcagcgtgaagagccagagaacccccagacccaacgagctgaagatcacccccctgaacagaaccctgaccccccccagaagcgtggacagcctgcccagactgagaagattcagccccagccaggtgcccatccagaccagaagcttcgtgtgcttcggcgacgacggcgagccccagctgaaggagagcaagcccaaggaggaggtgaagaaggaggagctggagagcaagggcaccctggagcagagaggccacaaccccgaggagaaggagatcaagcccttcgagagcaccgtgagcgaggtgctgagcctgcccgtgaccgagaccgtgtgcctgacccccaacgaggaccagctgaaccagcccaccgagcccccccccaagcccgtgttcccccccaccgcccccaagaacgtgaacctgatcgaggtgagcctgagcgacctgaagccccccgagaaggccgacgtgcccgtggagaagtacgacggcgagagcgacaaggagcagttcgacgacgaccagaaggtgtgctgcggcttcttcttcaaggacgaccagaaggccgagaacgacatggccatgaagagagccgccctgctggagaagagactgagaagagagaaggagacccagctgagaaagcagcagctggaggccgagatggagcacaagaaggaggagaccagaagaaagaccgaggaggagagacagaagaaggaggacgagagagccagaagagagttcatcagacaggagtacatgagaagaaagcagctgaagctgatggaggacatggacaccgtgatcaagcccagaccccaggtggtgaagcagaagaagcagagacccaagagcatccacagagaccacatcgagagccccaagacccccatcaagggcccccccgtgagcagcctgagcctggccagcctgaacaccggcgacaacgagagcgtgcacagcggcaagagaacccccagaagcgagagcgtggagggcttcctgagccccagcagatgcggcagcagaaacggcgagaaggactgggagaacgccagcaccaccagcagcgtggccagcggcaccgagtacaccggccccaagctgtacaaggagcccagcgccaagagcaacaagcacatcatccagaacgccctggcccactgctgcctggccggcaaggtgaacgagggccagaagaagaagatcctggaggagatggagaagagcgacgccaacaacttcctgatcctgttcagagacagcggctgccagttcagaagcctgtacacctactgccccgagaccgaggagatcaacaagctgaccggcatcggccccaagagcatcaccaagaagatgatcgagggcctgtacaagtacaacagcgacagaaagcagttcagccacatccccgccaagaccctgagcgccagcgtggacgccatcaccatccacagccacctgtggcagaccaagagacccgtgacccccaagaagctgctgcccaccaaggcctag

SEQ ID NO: 75164 - DNA, 4437 bp, Artificial Sequence
  Description of Artificial Sequence: Synthetic coding sequence
atgggcgacgccgccgaccccagagagatgagaaagaccttcatcgtgcccgccatcaagcccttcgaccactacgacttcagcagagccaagatcgcctgcaacctggcctggctggtggccaaggccttcggcaccgagaacgtgcccgaggagctgcaggagcccttctacaccgaccagtacgaccaggagcacatcaagccccccgtggtgaacctgctgctgagcgccgagctgtactgcagagccggcagcctgatcctgaagagcgacgccgccaagcccctgctgggccacgacgccgtgatccaggccctggcccagaagggcctgtacgtgaccgaccaggagaagctggtgaccgagagagacctgcacaagaagcccatccagatgagcgcccacctggccatgatcgacaccctgatgatggcctacaccgtggagatggtgagcatcgagaaggtgatcgcctgcgcccagcagtacagcgccttcttccaggccaccgacctgccctacgacatcgaggacgccgtgatgtactggatcaacaaggtgaacgagcacctgaaggacatcatggagcaggagcagaagctgaaggagcaccacaccgtggaggcccccggcggccagaaggccagatacagaaaggagcagaccctgctgaagcagctgccctgcatccccctggtggagaacctgctgaaggacggcaccgacggctgcgccctggccgccctgatccacttctactgccccgacgtggtgagactggaggacatctgcctgaaggagaccatgagcctggccgacagcctgtacaacctgcagctgatccaggagttctgccaggagtacctgaaccagtgctgccacttcaccctggaggacatgctgtacgccgccagcagcatcaagagcaactacctggtgttcatggccgagctgttctggtggttcgaggtggtgaagcccagcttcgtgcagcccagagtggtgagaccccagggcgccgagcccgtgaaggacatgcccagcatccccgtgctgaacgccgccaagagaaacgtgctggacagcagcagcgacttccccagcagcggcgagggcgccaccttcacccagagccaccaccacctgcccagcagatacagcagaccccaggcccacagcagcgccagcggcggcatcagaagaagcagcagcatgagctacgtggacggcttcatcggcacctggcccaaggagaagagaagcagcgtgcacggcgtgagcttcgacatcagcttcgacaaggaggacagcgtgcagagaagcacccccaacagaggcatcaccagaagcatcagcaacgagggcctgaccctgaacaacagccacgtgagcaagcacatcagaaagaacctgagcttcaagcccatcaacggcgaggaggaggccgagagcatcgaggaggagctgaacatcgacagccacagcgacctgaagagctgcgtgcccctgaacaccaacgagctgaacagcaacgagaacatccactacaagctgcccaacggcgccctgcagaacagaatcctgctggacgagttcggcaaccagatcgagacccccagcatcgaggaggccctgcagatcatccacgacaccgagaagagcccccacaccccccagcccgaccagatcgccaacggcttcttcctgcacagccaggagatgagcatcctgaacagcaacatcaagctgaaccagagcagccccgacaacgtgaccgacaccaagggcgccctgagccccatcaccgacaacaccgaggtggacaccggcatccacgtgcccagcgaggacatccccgagaccatggacgaggacagcagcctgagagactacaccgtgagcctggacagcgacatggacgacgccagcaagttcctgcaggactacgacatcagaaccggcaacaccagagaggccctgagcccctgccccagcaccgtgagcaccaagagccagcccggcagcagcgccagcagcagcagcggcgtgaagatgaccagcttcgccgagcagaagttcagaaagctgaaccacaccgacggcaagagcagcggcagcagcagccagaagaccacccccgagggcagcgagctgaacatcccccacgtggtggcctgggcccagatccccgaggagaccggcctgccccagggcagagacaccacccagctgctggccagcgagatggtgcacctgagaatgaagctggaggagaagagaagagccatcgaggcccagaagaagaagatggaggccgccttcaccaagcagagacagaagatgggcagaaccgccttcctgaccgtggtgaagaagaagggcgacggcatcagccccctgagagaggaggccgccggcgccgaggacgagaaggtgtacaccgacagagccaaggagaaggagagccagaagaccgacggccagagaagcaagagcctggccgacatcaaggagagcatggagaacccccaggccaagtggctgaagagccccaccacccccatcgaccccgagaagcagtggaacctggccagccccagcgaggagaccctgaacgagggcgagatcctggagtacaccaagagcatcgagaagctgaacagcagcctgcacttcctgcagcaggagatgcagagactgagcctgcagcaggagatgctgatgcagatgagagagcagcagagctgggtgatcagccccccccagcccagcccccagaagcagatcagagacttcaagcccagcaagcaggccggcctgagcagcgccatcgcccccttcagcagcgacagccccagacccacccaccccagcccccagagcagcaacagaaagagcgccagcttcagcgtgaagagccagagaacccccagacccaacgagctgaagatcacccccctgaacagaaccctgaccccccccagaagcgtggacagcctgcccagactgagaagattcagccccagccaggtgcccatccagaccagaagcttcgtgtgcttcggcgacgacggcgagccccagctgaaggagagcaagcccaaggaggaggtgaagaaggaggagctggagagcaagggcaccctggagcagagaggccacaaccccgaggagaaggagatcaagcccttcgagagcaccgtgagcgaggtgctgagcctgcccgtgaccgagaccgtgtgcctgacccccaacgaggaccagctgaaccagcccaccgagcccccccccaagcccgtgttcccccccaccgcccccaagaacgtgaacctgatcgaggtgagcctgagcgacctgaagccccccgagaaggccgacgtgcccgtggagaagtacgacggcgagagcgacaaggagcagttcgacgacgaccagaaggtgtgctgcggcttcttcttcaaggacgaccagaaggccgagaacgacatggccatgaagagagccgccctgctggagaagagactgagaagagagaaggagacccagctgagaaagcagcagctggaggccgagatggagcacaagaaggaggagaccagaagaaagaccgaggaggagagacagaagaaggaggacgagagagccagaagagagttcatcagacaggagtacatgagaagaaagcagctgaagctgatggaggacatggacaccgtgatcaagcccagaccccaggtggtgaagcagaagaagcagagacccaagagcatccacagagaccacatcgagagccccaagacccccatcaagggcccccccgtgagcagcctgagcctggccagcctgaacaccggcgacaacgagagcgtgcacagcggcaagagaacccccagaagcgagagcgtggagggcttcctgagccccagcagatgcggcagcagaaacggcgagaaggactgggagaacgccagcaccaccagcagcgtggccagcggcaccgagtacaccggccccaagctgtacaaggagcccagcgccaagagcaacaagcacatcatccagaacgccctggcccactgctgcctggccggcaaggtgaacgagggccagaagaagaagatcctggaggagatggagaagagcgacgccaacaacttcctgatcctgttcagagacagcggctgccagttcagaagcctgtacacctactgccccgagaccgaggagatcaacaagctgaccggcatcggccccaagagcatcaccaagaagatgatcgagggcctgtacaagtacaacagcgacagaaagcagttcagccacatccccgccaagaccctgagcgccagcgtggacgccatcaccatccacagccacctgtggcagaccaagagacccgtgacccccaagaagctgctgcccaccaaggcctag

SEQ ID NO: 75165 - DNA, 4389 bp, Artificial Sequence
  Description of Artificial Sequence: Synthetic coding sequence
atgggcgacgccgccgaccccagagagatgagaaagaccttcatcgtgcccgccatcaagcccttcgaccactacgacttcagcagagccaagatcgcctgcaacctggcctggctggtggccaaggccttcggcaccgagaacgtgcccgaggagctgcaggagcccttctacaccgaccagtacgaccaggagcacatcaagccccccgtggtgaacctgctgctgagcgccgagctgtactgcagagccggcagcctgatcctgaagagcgacgccgccaagcccctgctgggccacgacgccgtgatccaggccctggcccagaagggcctgtacgtgaccgaccaggagaagctggtgaccgagagagacctgcacaagaagcccatccagatgagcgcccacctggccatgatcgacaccctgatgatggcctacaccgtggagatggtgagcatcgagaaggtgatcgcctgcgcccagcagtacagcgccttcttccaggccaccgacctgccctacgacatcgaggacgccgtgatgtactggatcaacaaggtgaacgagcacctgaaggacatcatggagcaggagcagaagctgaaggagcaccacaccgtggaggcccccggcggccagaaggccagatacagaaaggagcagaccctgctgaagcagctgccctgcatccccctggtggagaacctgctgaaggacggcaccgacggctgcgccctggccgccctgatccacttctactgccccgacgtggtgagactggaggacatctgcctgaaggagaccatgagcctggccgacagcctgtacaacctgcagctgatccaggagttctgccaggagtacctgaaccagtgctgccacttcaccctggaggacatgctgtacgccgccagcagcatcaagagcaactacctggtgttcatggccgagctgttctggtggttcgaggtggtgaagcccagcttcgtgcagcccagagtggtgagaccccagggcgccgagcccgtgaaggacatgcccagcatccccgtgctgaacgccgccaagagaaacgtgctggacagcagcagcgacttccccagcagatacagcagaccccaggcccacagcagcgccagcggcggcatcagaagaagcagcagcatgagctacgtggacggcttcatcggcacctggcccaaggagaagagaagcagcgtgcacggcgtgagcttcgacatcagcttcgacaaggaggacagcgtgcagagaagcacccccaacagaggcatcaccagaagcatcagcaacgagggcctgaccctgaacaacagccacgtgagcaagcacatcagaaagaacctgagcttcaagcccatcaacggcgaggaggaggccgagagcatcgaggaggagctgaacatcgacagccacagcgacctgaagagctgcgtgcccctgaacaccaacgagctgaacagcaacgagaacatccactacaagctgcccaacggcgccctgcagaacagaatcctgctggacgagttcggcaaccagatcgagacccccagcatcgaggaggccctgcagatcatccacgacaccgagaagagcccccacaccccccagcccgaccagatcgccaacggcttcttcctgcacagccaggagatgagcatcctgaacagcaacatcaagctgaaccagagcagccccgacaacgtgaccgacaccaagggcgccctgagccccatcaccgacaacaccgaggtggacaccggcatccacgtgcccagcgaggacatccccgagaccatggacgaggacagcagcctgagagactacaccgtgagcctggacagcgacatggacgacgccagcaagttcctgcaggactacgacatcagaaccggcaacaccagagaggccctgagcccctgccccagcaccgtgagcaccaagagccagcccggcagcagcgccagcagcagcagcggcgtgaagatgaccagcttcgccgagcagaagttcagaaagctgaaccacaccgacggcaagagcagcggcagcagcagccagaagaccacccccgagggcagcgagctgaacatcccccacgtggtggcctgggcccagatccccgaggagaccggcctgccccagggcagagacaccacccagctgctggccagcgagatggtgcacctgagaatgaagctggaggagaagagaagagccatcgaggcccagaagaagaagatggaggccgccttcaccaagcagagacagaagatgggcagaaccgccttcctgaccgtggtgaagaagaagggcgacggcatcagccccctgagagaggaggccgccggcgccgaggacgagaaggtgtacaccgacagagccaaggagaaggagagccagaagaccgacggccagagaagcaagagcctggccgacatcaaggagagcatggagaacccccaggccaagtggctgaagagccccaccacccccatcgaccccgagaagcagtggaacctggccagccccagcgaggagaccctgaacgagggcgagatcctggagtacaccaagagcatcgagaagctgaacagcagcctgcacttcctgcagcaggagatgcagagactgagcctgcagcaggagatgctgatgcagatgagagagcagcagagctgggtgatcagccccccccagcccagcccccagaagcagatcagagacttcaagcccagcaagcaggccggcctgagcagcgccatcgcccccttcagcagcgacagccccagacccacccaccccagcccccagagcagcaacagaaagagcgccagcttcagcgtgaagagccagagaacccccagacccaacgagctgaagatcacccccctgaacagaaccctgaccccccccagaagcgtggacagcctgcccagactgagaagattcagccccagccaggtgcccatccagaccagaagcttcgtgtgcttcggcgacgacggcgagccccagctgaaggagagcaagcccaaggaggaggtgaagaaggaggagctggagagcaagggcaccctggagcagagaggccacaaccccgaggagaaggagatcaagcccttcgagagcaccgtgagcgaggtgctgagcctgcccgtgaccgagaccgtgtgcctgacccccaacgaggaccagctgaaccagcccaccgagcccccccccaagcccgtgttcccccccaccgcccccaagaacgtgaacctgatcgaggtgagcctgagcgacctgaagccccccgagaaggccgacgtgcccgtggagaagtacgacggcgagagcgacaaggagcagttcgacgacgaccagaaggtgtgctgcggcttcttcttcaaggacgaccagaaggccgagaacgacatggccatgaagagagccgccctgctggagaagagactgagaagagagaaggagacccagctgagaaagcagcagctggaggccgagatggagcacaagaaggaggagaccagaagaaagaccgaggaggagagacagaagaaggaggacgagagagccagaagagagttcatcagacaggagtacatgagaagaaagcagctgaagctgatggaggacatggacaccgtgatcaagcccagaccccaggtggtgaagcagaagaagcagagacccaagagcatccacagagaccacatcgagagccccaagacccccatcaagggcccccccgtgagcagcctgagcctggccagcctgaacaccggcgacaacgagagcgtgcacagcggcaagagaacccccagaagcgagagcgtggagggcttcctgagccccagcagatgcggcagcagaaacggcgagaaggactgggagaacgccagcaccaccagcagcgtggccagcggcaccgagtacaccggccccaagctgtacaaggagcccagcgccaagagcaacaagcacatcatccagaacgccctggcccactgctgcctggccggcaaggtgaacgagggccagaagaagaagatcctggaggagatggagaagagcgacgccaacaacttcctgatcctgttcagagacagcggctgccagttcagaagcctgtacacctactgccccgagaccgaggagatcaacaagctgaccggcatcggccccaagagcatcaccaagaagatgatcgagggcctgtacaagtacaacagcgacagaaagcagttcagccacatccccgccaagaccctgagcgccagcgtggacgccatcaccatccacagccacctgtggcagaccaagagacccgtgacccccaagaagctgctgcccaccaaggcctag

SEQ ID NO: 75166 - DNA, 450 bp, Artificial Sequence
  Description of Artificial Sequence: Synthetic coding sequence
atggccgaccagctgaccgaggagcaggtgaccgagttcaaggaggccttcagcctgttcgacaaggacggcgacggctgcatcaccaccagagagctgggcaccgtgatgagaagcctgggccagaaccccaccgaggccgagctgagagacatgatgagcgagatcgacagagacggcaacggcaccgtggacttccccgagttcctgggcatgatggccagaaagatgaaggacaccgacaacgaggaggagatcagagaggccttcagagtgttcgacaaggacggcaacggcttcgtgagcgccgccgagctgagacacgtgatgaccagactgggcgagaagctgagcgacgaggaggtggacgagatgatcagagccgccgacaccgacggcgacggccaggtgaactacgaggagttcgtgagagtgctggtgagcaagtag

SEQ ID NO: 75167 - DNA, 546 bp, Artificial Sequence
  Description of Artificial Sequence: Synthetic coding sequence
atgggcctgcagcaggagatcagcctgcagccctggtgccaccaccccgccgagagctgccagaccaccaccgacatgaccgagagactgagcgccgagcagatcaaggagtacaagggcgtgttcgagatgttcgacgaggagggcaacggcgaggtgaagaccggcgagctggagtggctgatgagcctgctgggcatcaaccccaccaagagcgagctggccagcatggccaaggacgtggacagagacaacaagggcttcttcaactgcgacggcttcctggccctgatgggcgtgtaccacgagaaggcccagaaccaggagagcgagctgagagccgccttcagagtgttcgacaaggagggcaagggctacatcgactggaacaccctgaagtacgtgctgatgaacgccggcgagcccctgaacgaggtggaggccgagcagatgatgaaggaggccgacaaggacggcgacagaaccatcgactacgaggagttcgtggccatgatgaccggcgagagcttcaagctgatccagtag

SEQ ID NO: 75168 - DNA, 495 bp, Artificial Sequence
  Description of Artificial Sequence: Synthetic coding sequence
atgggcctgcagcaggagatcagcctgaccgagagactgagcgccgagcagatcaaggagtacaagggcgtgttcgagatgttcgacgaggagggcaacggcgaggtgaagaccggcgagctggagtggctgatgagcctgctgggcatcaaccccaccaagagcgagctggccagcatggccaaggacgtggacagagacaacaagggcttcttcaactgcgacggcttcctggccctgatgggcgtgtaccacgagaaggcccagaaccaggagagcgagctgagagccgccttcagagtgttcgacaaggagggcaagggctacatcgactggaacaccctgaagtacgtgctgatgaacgccggcgagcccctgaacgaggtggaggccgagcagatgatgaaggaggccgacaaggacggcgacagaaccatcgactacgaggagttcgtggccatgatgaccggcgagagcttcaagctgatccagtag

SEQ ID NO: 75169 - DNA, 1779 bp, Artificial Sequence
  Description of Artificial Sequence: Synthetic coding sequence
atggagggcaagtggctgctgtgcatgctgctggtgctgggcaccgccatcgtggaggcccacgacggccacgacgacgacgtgatcgacatcgaggacgacctggacgacgtgatcgaggaggtggaggacagcaagcccgacaccaccgccccccccagcagccccaaggtgacctacaaggcccccgtgcccaccggcgaggtgtacttcgccgacagcttcgacagaggcaccctgagcggctggatcctgagcaaggccaagaaggacgacaccgacgacgagatcgccaagtacgacggcaagtgggaggtggaggagatgaaggagagcaagctgcccggcgacaagggcctggtgctgatgagcagagccaagcaccacgccatcagcgccaagctgaacaagcccttcctgttcgacaccaagcccctgatcgtgcagtacgaggtgaacttccagaacggcatcgagtgcggcggcgcctacgtgaagctgctgagcaagacccccgagctgaacctggaccagttccacgacaagaccccctacaccatcatgttcggccccgacaagtgcggcgaggactacaagctgcacttcatcttcagacacaagaaccccaagaccggcatctacgaggagaagcacgccaagagacccgacgccgacctgaagacctacttcaccgacaagaagacccacctgtacaccctgatcctgaaccccgacaacagcttcgagatcctggtggaccagagcgtggtgaacagcggcaacctgctgaacgacatgaccccccccgtgaaccccagcagagagatcgaggaccccgaggacagaaagcccgaggactgggacgagagacccaagatccccgaccccgaggccgtgaagcccgacgactgggacgaggacgcccccgccaagatccccgacgaggaggccaccaagcccgagggctggctggacgacgagcccgagtacgtgcccgaccccgacgccgagaagcccgaggactgggacgaggacatggacggcgagtgggaggccccccagatcgccaaccccagatgcgagagcgcccccggctgcggcgtgtggcagagacccgtgatcgacaaccccaactacaagggcaagtggaagccccccatgatcgacaaccccagctaccagggcatctggaagcccagaaagatccccaaccccgacttcttcgaggacctggagcccttcagaatgacccccttcagcgccatcggcctggagctgtggagcatgaccagcgacatcttcttcgacaacttcatcatctgcgccgacagaagaatcgtggacgactgggccaacgacggctggggcctgaagaaggccgccgacggcgccgccgagcccggcgtggtgggccagatgatcgaggccgccgaggagagaccctggctgtgggtggtgtacatcctgaccgtggccctgcccgtgttcctggtgatcctgttctgctgcagcggcaagaagcagaccagcggcatggagtacaagaagaccgacgccccccagcccgacgtgaaggaggaggaggaggagaaggaggaggagaaggacaagggcgacgaggaggaggagggcgaggagaagctggaggagaagcagaagagcgacgccgaggaggacggcggcaccgtgagccaggaggaggaggacagaaagcccaaggccgaggaggacgagatcctgaacagaagccccagaaacagaaagcccagaagagagtag

SEQ ID NO: 75170 - DNA, 852 bp, Artificial Sequence
  Description of Artificial Sequence: Synthetic coding sequence
atgctgctggtgctgggcaccgccatcgtggaggcccacgacggccacgacgacgacgtgatcgacatcgaggacgacctggacgacgtgatcgaggaggtggaggacagcaagcccgacaccaccgccccccccagcagccccaaggtgacctacaaggcccccgtgcccaccggcgaggtgtacttcgccgacagcttcgacagaggcaccctgagcggctggatcctgagcaaggccaagaaggacgacaccgacgacgagatcgccaagtacgacggcaagtgggaggtggaggagatgaaggagagcaagctgcccggcgacaagggcctggtgctgatgagcagagccaagcaccacgccatcagcgccaagctgaacaagcccttcctgttcgacaccaagcccctgatcgtgcagtacgaggtgaacttccagaacggcatcgagtgcggcggcgcctacaactgcttcctgaagcaccagaacagcacctgggaccagttccacgacaagaccccctacaccatcatgttcggccccgacaagtgcggcgaggactacaagctgcacttcatcttcagacacaagaaccccaagaccggcatctacgaggagaagcacgccaagagacccgacgccgacctgaagacctacttcaccgacaagaagacccacctgtacaccctgatcctgaaccccgacaacagcttcgagatcctggtggaccagagcgtgccccccgtgaaccccagcagagagatcgaggaccccgaggacagaaagcccgaggactgggacgagagacccaagatccccgaccccgaggccgtgaagcccgacgactag

SEQ ID NO: 75171 - DNA, 984 bp, Artificial Sequence
  Description of Artificial Sequence: Synthetic coding sequence
atggagggcaagtggctgctgtgcatgctgctggtgctgggcaccgccatcgtggaggcccacgacggccacgacgacgacgtgatcgacatcgaggacgacctggacgacgtgatcgaggaggtggaggagatgaaggagagcaagctgcccggcgacaagggcctggtgctgatgagcagagccaagcaccacgccatcagcgccaagctgaacaagcccttcctgttcgacaccaagcccctgatcgtgcagtacgaggtgaacttccagaacggcatcgagtgcggcggcgcctacgtgaagctgctgagcaagacccccgagctgaacctggaccagttccacgacaagaccccctacaccatcatgttcggccccgacaagtgcggcgaggactacaagctgcacttcatcttcagacacaagaaccccaagaccggcatctacgaggagaagcacgccaagagacccgacgccgacctgaagacctacttcaccgacaagaagacccacctgtacaccctgatcctgaaccccgacaacagcttcgagatcctggtggaccagagcgtggtgaacagcggcaacctgctgaacgacatgaccccccccgtgaaccccagcagagagatcgaggaccccgaggacagaaagcccgaggactgggacgagagacccaagatccccgaccccgaggccgtgaagcccgacgactgggacgaggacgcccccgccaagatccccgacgaggaggccaccaagcccgagggctggctggacgacgagcccgagtacgtgcccgaccccgacgccgagaagcccgaggactgggacgaggacatggacggcgagtgggaggccccccagatcgccaaccccagatgcgagagcgcccccggctgcggcgtgtggcagagacccgtggtggacatccagaagaccagcagacaccaccaccagcaggcccccgtggagcactag

SEQ ID NO: 75172 - DNA, 1884 bp, Artificial Sequence
  Description of Artificial Sequence: Synthetic coding sequence
atggccgacagaagaacccccacccccttcgccggctgcagactgcccagacagagaagagccagagacgccagccaggtgagcgcccccggcaccagaagaatcatggagggcaagtggctgctgtgcatgctgctggtgctgggcaccgccatcgtggaggcccacgacggccacgacgacgacgtgatcgacatcgaggacgacctggacgacgtgatcgaggaggtggaggacagcaagcccgacaccaccgccccccccagcagccccaaggtgacctacaaggcccccgtgcccaccggcgaggtgtacttcgccgacagcttcgacagaggcaccctgagcggctggatcctgagcaaggccaagaaggacgacaccgacgacgagatcgccaagtacgacggcaagtgggaggtggaggagatgaaggagagcaagctgcccggcgacaagggcctggtgctgatgagcagagccaagcaccacgccatcagcgccaagctgaacaagcccttcctgttcgacaccaagcccctgatcgtgcagtacgaggtgaacttccagaacggcatcgagtgcggcggcgcctacgtgaagctgctgagcaagacccccgagctgaacctggaccagttccacgacaagaccccctacaccatcatgttcggccccgacaagtgcggcgaggactacaagctgcacttcatcttcagacacaagaaccccaagaccggcatctacgaggagaagcacgccaagagacccgacgccgacctgaagacctacttcaccgacaagaagacccacctgtacaccctgatcctgaaccccgacaacagcttcgagatcctggtggaccagagcgtggtgaacagcggcaacctgctgaacgacatgaccccccccgtgaaccccagcagagagatcgaggaccccgaggacagaaagcccgaggactgggacgagagacccaagatccccgaccccgaggccgtgaagcccgacgactgggacgaggacgcccccgccaagatccccgacgaggaggccaccaagcccgagggctggctggacgacgagcccgagtacgtgcccgaccccgacgccgagaagcccgaggactgggacgaggacatggacggcgagtgggaggccccccagatcgccaaccccagatgcgagagcgcccccggctgcggcgtgtggcagagacccgtgatcgacaaccccaactacaagggcaagtggaagccccccatgatcgacaaccccagctaccagggcatctggaagcccagaaagatccccaaccccgacttcttcgaggacctggagcccttcagaatgacccccttcagcgccatcggcctggagctgtggagcatgaccagcgacatcttcttcgacaacttcatcatctgcgccgacagaagaatcgtggacgactgggccaacgacggctggggcctgaagaaggccgccgacggcgccgccgagcccggcgtggtgggccagatgatcgaggccgccgaggagagaccctggctgtgggtggtgtacatcctgaccgtggccctgcccgtgttcctggtgatcctgttctgctgcagcggcaagaagcagaccagcggcatggagtacaagaagaccgacgccccccagcccgacgtgaaggaggaggaggaggagaaggaggaggagaaggacaagggcgacgaggaggaggagggcgaggagaagctggaggagaagcagaagagcgacgccgaggaggacggcggcaccgtgagccaggaggaggaggacagaaagcccaaggccgaggaggacgagatcctgaacagaagccccagaaacagaaagcccagaagagagtag

SEQ ID NO: 75173 - DNA, 1779 bp, Artificial Sequence; identical to SEQ ID NO: 75169
  Description of Artificial Sequence: Synthetic coding sequence

SEQ ID NO: 75174 - DNA, 405 bp, Artificial Sequence
  Description of Artificial Sequence: Synthetic coding sequence
atggagggcaagtggctgctgtgcatgctgctggtgctgggcaccgccatcgtggaggcccacgacggccacgacgacgacgtgatcgacatcgaggacgacctggacgacgtgatcgaggaggtggaggacagcaagcccgacaccaccgccccccccagcagccccaaggtgacctacaaggcccccgtgcccaccggcgaggtgtacttcgccgacagcttcgacagaggcaccctgagcggctggatcctgagcaaggccaagaaggacgacaccgacgacgagatcgccaagtacgacggcaagtgggaggtggaggagatgaaggagagcaagctgcccggcgacaagggcctggtgctgatgagcagagccaagcaccacgccatcagcgccaagtag

SEQ ID NO: 75175 - DNA, 507 bp, Artificial Sequence
  Description of Artificial Sequence: Synthetic coding sequence
atggagggcaagtggctgctgtgcatgctgctggtgctgggcaccgccatcgtggaggcccacgacggccacgacgacgacgtgatcgacatcgaggacgacctggacgacgtgatcgaggaggtggaggacagcaagcccgacaccaccgccccccccagcagccccaaggtgacctacaaggcccccgtgcccaccggcgaggtgtacttcgccgacagcttcgacagaggcaccctgagcggctggatcctgagcaaggccaagaaggacgacaccgacgacgagatcgccaagtacgacggcaagtgggaggtggaggagatgaaggagagcaagctgcccggcgacaagggcctggtgctgatgagcagagccaagcaccacgccatcagcgccaagctgaacaagcccttcctgttcgacaccaagcccctgatcgtgcagtacgaggtgaacttccagaacggcatcgagtgcggcggcgcctacgtgaagctgctgtag

SEQ ID NO: 75176 - DNA, 1779 bp, Artificial Sequence; identical to SEQ ID NO: 75169
  Description of Artificial Sequence: Synthetic coding sequence

SEQ ID NO: 75177 - DNA, 240 bp, Artificial Sequence
  Description of Artificial Sequence: Synthetic coding sequence
atggagggcaagtggctgctgtgcatgctgctggtgctgggcaccgccatcgtggaggcccacgacggccacgacgacgacgtgatcgacatcgaggacgacctggacgacgtgatcgaggaggtggaggacagcaagcccgacaccaccgccccccccagcagccccaaggtgacctacaaggcccccgtgcccaccggcgaggtgtacttcgccgacagcttcgacagaggcacctag

SEQ ID NO: 75178 - DNA, 99 bp, Artificial Sequence
  Description of Artificial Sequence: Synthetic coding sequence
atggagggcaagtggctgctgtgcatgctgctggtgctgggcaccgccatcgtggaggcccacgacggccacgacgacgacgtgatcgacatcgagtag

SEQ ID NO: 75179 - DNA, 1455 bp, Artificial Sequence
  Description of Artificial Sequence: Synthetic coding sequence
atgaaggagagcaagctgcccggcgacaagggcctggtgctgatgagcagagccaagcaccacgccatcagcgccaagctgaacaagcccttcctgttcgacaccaagcccctgatcgtgcagtacgaggtgaacttccagaacggcatcgagtgcggcggcgcctacgtgaagctgctgagcaagacccccgagctgaacctggaccagttccacgacaagaccccctacaccatcatgttcggccccgacaagtgcggcgaggactacaagctgcacttcatcttcagacacaagaaccccaagaccggcatctacgaggagaagcacgccaagagacccgacgccgacctgaagacctacttcaccgacaagaagacccacctgtacaccctgatcctgaaccccgacaacagcttcgagatcctggtggaccagagcgtggtgaacagcggcaacctgctgaacgacatgaccccccccgtgaaccccagcagagagatcgaggaccccgaggacagaaagcccgaggactgggacgagagacccaagatccccgaccccgaggccgtgaagcccgacgactgggacgaggacgcccccgccaagatccccgacgaggaggccaccaagcccgagggctggctggacgacgagcccgagtacgtgcccgaccccgacgccgagaagcccgaggactgggacgaggacatggacggcgagtgggaggccccccagatcgccaaccccagatgcgagagcgcccccggctgcggcgtgtggcagagacccgtgatcgacaaccccaactacaagggcaagtggaagccccccatgatcgacaaccccagctaccagggcatctggaagcccagaaagatccccaaccccgacttcttcgaggacctggagcccttcagaatgacccccttcagcgccatcggcctggagctgtggagcatgaccagcgacatcttcttcgacaacttcatcatctgcgccgacagaagaatcgtggacgactgggccaacgacggctggggcctgaagaaggccgccgacggcgccgccgagcccggcgtggtgggccagatgatcgaggccgccgaggagagaccctggctgtgggtggtgtacatcctgaccgtggccctgcccgtgttcctggtgatcctgttctgctgcagcggcaagaagcagaccagcggcatggagtacaagaagaccgacgccccccagcccgacgtgaaggaggaggaggaggagaaggaggaggagaaggacaagggcgacgaggaggaggagggcgaggagaagctggaggagaagcagaagagcgacgccgaggaggacggcggcaccgtgagccaggaggaggaggacagaaagcccaaggccgaggaggacgagatcctgaacagaagccccagaaacagaaagcccagaagagagtag

SEQ ID NO: 75180 - DNA, 324 bp, Artificial Sequence
  Description of Artificial Sequence: Synthetic coding sequence
atggagggcaagtggctgctgtgcatgctgctggtgctgggcaccgccatcgtggaggcccacgacggccacgacgacgacgtgatcgacatcgaggacgacctggacgacgtgatcgaggaggtggaggacagcaagcccgacaccaccgccccccccagcagccccaaggtgacctacaaggcccccgtgcccaccggcgaggtgtacttcgccgacagcttcgacagaggcaccctgagcggctggatcctgagcaaggccaagaaggacgacaccgacgacgagatcgccaagtacgacggcaagtgggaggtggagtag

SEQ ID NO: 75181 - DNA, 435 bp, Artificial Sequence
  Description of Artificial Sequence: Synthetic coding sequence
atggagggcaagtggctgctgtgcatgctgctggtgctgggcaccgccatcgtggaggcccacgacggccacgacgacgacgtgatcgacatcgaggacgacctggacgacgtgatcgaggaggtggaggacagcaagcccgacaccaccgccccccccagcagccccaaggtgacctacaaggcccccgtgcccaccggcgaggtgtacttcgccgacagcttcgacagaggcaccctgagcggctggatcctgagcaaggccaagaaggacgacaccgacgacgagatcgccaagtacgacggcaagtgggaggtggaggagatgaaggagagcaagctgcccggcgacaagggcctggtgctgatgagcagagccaagcaccacgccatcagcgccaagctgaacaagcccttcctgttcgacaccaagtag

SEQ ID NO: 75182 - DNA, 420 bp, Artificial Sequence
  Description of Artificial Sequence: Synthetic coding sequence
atgagagccggcagaggcgccacccccgccagagagctgttcagagacgccgccttccccgccgccgacagcagcctgttctgcgacctgagcacccccctggcccagttcagagaggacatcacctggagaagaccccaggagatctgcgccacccccagactgttccccgacgaccccagagagggccaggtgaagcagggcctgctgggcgactgctggttcctgtgcgcctgcgccgccctgcagaagagcagacacctgctggaccaggtgagctgccccgtgcagctgcccgccgactggacctgcaaggtgcagcccgtgtggctggagttcccctgcctgcccatcagctgcagactgagagtgagcagcgacaccagccccgacagcgccacctggggcagctggaagtag

SEQ ID NO: 75183 - DNA, 417 bp, Artificial Sequence
  Description of Artificial Sequence: Synthetic coding sequence
atgagagccggcagaggcgccacccccgccagagagctgttcagagacgccgccttccccgccgccgacagcagcctgttctgcgacctgagcacccccctggcccagttcagagaggacatcacctggagaagaccccaggtgcccgagggcggcagaagccaggacgccccccccctgctgctgcaggagcccctgctgagctgcgtgccccacagatacgcccaggaggtgagcagactgtgcctgctgcccgccggcacctacaaggtggtgcccagcacctacctgcccgacaccgagggcgccttcaccgtgaccatcgccaccagaatcgacagacccagcatccacagccaggagatgctgggccagttcctgcaggaggtgagcatcatggccgtgatgaagacctag

SEQ ID NO: 75184 - DNA, 1554 bp, Artificial Sequence
  Description of Artificial Sequence: Synthetic coding sequence
atgagagccggcagaggcgccacccccgccagagagctgttcagagacgccgccttccccgccgccgacagcagcctgttctgcgacctgagcacccccctggcccagttcagagaggacatcacctggagaagaccccaggagatctgcgccacccccagactgttccccgacgaccccagagagggccaggtgaagcagggcctgctgggcgactgctggttcctgtgcgcctgcgccgccctgcagaagagcagacacctgctggaccaggtgatcccccccggccagcccagctgggccgaccaggagtacagaggcagcttcacctgcagaatctggcagttcggcagatgggtggaggtgaccaccgacgacagactgccctgcctggccggcagactgtgcttcagcagatgccagagagaggacgtgttctggctgcccctgctggagaaggtgtacgccaaggtgcacggcagctacgagcacctgtgggccggccaggtggccgacgccctggtggacctgaccggcggcctggccgagagatggaacctgaagggcgtggccggcagcggcggccagcaggacagacccggcagatgggagcacagaacctgcagacagctgctgcacctgaaggaccagtgcctgatcagctgctgcgtgctgagccccagagccggcgccagagagctgggcgagttccacgccttcatcgtgagcgacctgagagagctgcagggccaggccggccagtgcatcctgctgctgagaatccagaacccctggggcagaagatgctggcagggcctgtggagagagggcggcgagggctggagccaggtggacgccgccgtggccagcgagctgctgagccagctgcaggagggcgagttctgggtggaggaggaggagttcctgagagagttcgacgagctgaccgtgggctaccccgtgaccgaggccggccacctgcagagcctgtacaccgagagactgctgtgccacaccagagccctgcccggcgcctgggtgaagggccagagcgccggcggctgcagaaacaacagcggcttccccagcaaccccaagttctggctgagagtgagcgagcccagcgaggtgtacatcgccgtgctgcagagaagcagactgcacgccgccgactgggccggcagagccagagccctggtgggcgacagccacaccagctggagccccgccagcatccccggcaagcactaccaggccgtgggcctgcacctgtggaaggtgcccgagggcggcagaagccaggacgccccccccctgctgctgcaggagcccctgctgagctgcgtgccccacagatacgcccaggaggtgagcagactgtgcctgctgcccgccggcacctacaaggtggtgcccagcacctacctgcccgacaccgagggcgccttcaccgtgaccatcgccaccagaatcgacagacccagcatccacagccaggagatgctgggccagttcctgcaggaggtgagcatcatggccgtgatgaagacctag

SEQ ID NO: 75185 - DNA, 1335 bp, Artificial Sequence
  Description of Artificial Sequence: Synthetic coding sequence
atgagagccggcagaggcgccacccccgccagagagctgttcagagacgccgccttccccgccgccgacagcagcctgttctgcgacctgagcacccccctggcccagttcagagaggacatcacctggagaagaccccaggagatctgcgccacccccagactgttccccgacgaccccagagagggccaggtgaagcagggcctgctgggcgactgctggttcctgtgcgcctgcgccgccctgcagaagagcagacacctgctggaccaggtgatcccccccggccagcccagctgggccgaccaggagtacagaggcagcttcacctgcagaatctggcagttcggcagatgggtggaggtgaccaccgacgacagactgccctgcctggccggcagactgtgcttcagcagatgccagagagaggacgtgttctggctgcccctgctggagaaggtgtacgccaaggtgcacggcagctacgagcacctgtgggccggccaggtggccgacgccctggtggacctgaccggcggcctggccgagagatggaacctgaagggcgtggccggcagcggcggccagcaggacagacccggcagatgggagcacagaacctgcagacagctgctgcacctgaaggaccagtgcctgatcagctgctgcgtgctgagccccagagccggcgccagagagctgggcgagttccacgccttcatcgtgagcgacctgagagagctgcagggccaggccggccagtgcatcctgctgctgagaatccagaacccctggggcagaagatgctggcagggcctgtggagagagggcggcgagggctggagccaggtggacgccgccgtggccagcgagctgctgagccagctgcaggagggcgagttctgggtggaggaggaggagttcctgagagagttcgacgagctgaccgtgggctaccccgtgaccgaggccggccacctgcagagcctgtacaccgagagactgctgtgccacaccagagccctgcccggcgcctgggtgaagggccagagcgccggcggctgcagaaacaacagcggcttccccagcaaccccaagttctggctgagagtgagcgagcccagcgaggtgtacatcgccgtgctgcagagaagcagactgcacgccgccgactgggccggcagagccagagccctggtgggcgacagccacaccagctggagccccgccagcatccccggcaagcactaccaggccgtgggcctgcacctgtggaagggcgtgaccctgggcaccaccctgttccccgtgcccagctggatgtggcccacctag

SEQ ID NO: 75186 - DNA, 2019 bp, Artificial Sequence
  Description of Artificial Sequence: Synthetic coding sequence
atgagagccggcagaggcgccacccccgccagagagctgttcagagacgccgccttccccgccgccgacagcagcctgttctgcgacctgagcacccccctggcccagttcagagaggacatcacctggagaagaccccaggagatctgcgccacccccagactgttccccgacgaccccagagagggccaggtgaagcagggcctgctgggcgactgctggttcctgtgcgcctgcgccgccctgcagaagagcagacacctgctggaccaggtgatcccccccggccagcccagctgggccgaccaggagtacagaggcagcttcacctgcagaatctggcagttcggcagatgggtggaggtgaccaccgacgacagactgccctgcctggccggcagactgtgcttcagcagatgccagagagaggacgtgttctggctgcccctgctggagaaggtgtacgccaaggtgcacggcagctacgagcacctgtgggccggccaggtggccgacgccctggtggacctgaccggcggcctggccgagagatggaacctgaagggcgtggccggcagcggcggccagcaggacagacccggcagatgggagcacagaacctgcagacagctgctgcacctgaaggaccagtgcctgatcagctgctgcgtgctgagccccagagccggcgccagagagctgggcgagttccacgccttcatcgtgagcgacctgagagagctgcagggccaggccggccagtgcatcctgctgctgagaatccagaacccctggggcagaagatgctggcagggcctgtggagagagggcggcgagggctggagccaggtggacgccgccgtggccagcgagctgctgagccagctgcaggagggcgagttctgggtggaggaggaggagttcctgagagagttcgacgagctgaccgtgggctaccccgtgaccgaggccggccacctgcagagcctgtacaccgagagactgctgtgccacaccagagccctgcccggcgcctgggtgaagggccagagcgccggcggctgcagaaacaacagcggcttccccagcaaccccaagttctggctgagagtgagcgagcccagcgaggtgtacatcgccgtgctgcagagaagcagactgcacgccgccgactgggccggcagagccagagccctggtgggcgacagccacaccagctggagccccgccagcatccccggcaagcactaccaggccgtgggcctgcacctgtggaaggtggagaagagaagagtgaacctgcccagagtgctgagcatgccccccgtggccggcaccgcctgccacgcctacgacagagaggtgcacctgagatgcgagctgagccccggctactacctggccgtgcccagcaccttcctgaaggacgcccccggcgagttcctgctgagagtgttcagcaccggcagagtgagcctgagcgccatcagagccgtggccaagaacaccacccccggcgccgccctgcccgccggcgagtggggcaccgtgcagctgagaggcagctggagagtgggccagaccgccggcggcagcagaaacttcgccagctaccccaccaacccctgcttccccttcagcgtgcccgagggccccggccccagatgcgtgagaatcaccctgcaccagcactgcagacccagcgacaccgagttccaccccatcggcttccacatcttccaggtgcccgagggcggcagaagccaggacgccccccccctgctgctgcaggagcccctgctgagctgcgtgccccacagatacgcccaggaggtgagcagactgtgcctgctgcccgccggcacctacaaggtggtgcccagcacctacctgcccgacaccgagggcgccttcaccgtgaccatcgccaccagaatcgacagacccagcatccacagccaggagatgctgggccagttcctgcaggaggtgagcatcatggccgtgatgaagacctag

SEQ ID NO: 75187 - DNA, 2220 bp, Artificial Sequence
  Description of Artificial Sequence: Synthetic coding sequence
atgctgtacagccccggccccagcctgcccgagagcgccgagagcctggacggcagccaggaggacaagcccagaggcagctgcgccgagcccaccttcaccgacaccggcatggtggcccacatcaacaacagcagactgaaggccaagggcgtgggccagcacgacaacgcccagaacttcggcaaccagagcttcgaggagctgagagccgcctgcctgagaaagggcgagctgttcgaggaccccctgttccccgccgagcccagcagcctgggcttcaaggacctgggccccaacagcaagaacgtgcagaacatcagctggcagagacccaaggacatcatcaacaaccccctgttcatcatggacggcatcagccccaccgacatctgccagggcatcctgggcgactgctggctgctggccgccatcggcagcctgaccacctgccccaagctgctgtacagagtggtgcccagaggccagagcttcaagaagaactacgccggcatcttccacttccagatctggcagttcggccagtgggtgaacgtggtggtggacgacagactgcccaccaagaacgacaagctggtgttcgtgcacagcaccgagagaagcgagttctggagcgccctgctggagaaggcctacgccaagctgagcggcagctacgaggccctgagcggcggcagcaccatggagggcctggaggacttcaccggcggcgtggcccagagcttccagctgcagagacccccccagaacctgctgagactgctgagaaaggccgtggagagaagcagcctgatgggctgcagcatcgaggtgaccagcgacagcgagctggagagcatgaccgacaagatgctggtgagaggccacgcctacagcgtgaccggcctgcaggacgtgcactacagaggcaagatggagaccctgatcagagtgagaaacccctggggcagaatcgagtggaacggcgcctggagcgacagcgccagagagtgggaggaggtggccagcgacatccagatgcagctgctgcacaagaccgaggacggcgagttctggatgagctaccaggacttcctgaacaacttcaccctgctggagatctgcaacctgacccccgacaccctgagcggcgactacaagagctactggcacaccaccttctacgagggcagctggagaagaggcagcagcgccggcggctgcagaaaccaccccggcaccttctggaccaacccccagttcaagatcagcctgcccgagggcgacgaccccgaggacgacgccgagggcaacgtggtggtgtgcacctgcctggtggccctgatgcagaagaactggagacacgccagacagcagggcgcccagctgcagaccatcggcttcgtgctgtacgccgtgcccaaggagttccagaacatccaggacgtgcacctgaagaaggagttcttcaccaagtaccaggaccacggcttcagcgagatcttcaccaacagcagagaggtgagcagccagctgagactgccccccggcgagtacatcatcatccccagcaccttcgagccccacagagacgccgacttcctgctgagagtgttcaccgagaagcacagcgagagctgggagctggacgaggtgaactacgccgagcagctgcaggaggagaaggtgagcgaggacgacatggaccaggacttcctgcacctgttcaagatcgtggccggcgagggcaaggagatcggcgtgtacgagctgcagagactgctgaacagaatggccatcaagttcaagagcttcaagaccaagggcttcggcctggacgcctgcagatgcatgatcaacctgatggacaaggacggcagcggcaagctgggcctgctggagttcaagatcctgtggaagaagctgaagaagtggatggacatcttcagagagtgcgaccaggaccacagcggcaccctgaacagctacgagatgagactggtgatcgagaaggccggcatcaagctgaacaacaaggtgatgcaggtgctggtggccagatacgccgacgacgacctgatcatcgacttcgacagcttcatcagctgcttcctgagactgaagaccatgttcaccttcttcctgaccatggaccccaagaacaccggccacatctgcctgagcctggagcagtggctgcagatgaccatgtggggctag

SEQ ID NO: 75188 - DNA, 2220 bp, Artificial Sequence
  Description of Artificial Sequence: Synthetic coding sequence
atgctgtacagccccggccccagcctgcccgagagcgccgagagcctggacggcagccaggaggacaagcccagaggcagctgcgccgagcccaccttcaccgacaccggcatggtggcccacatcaacaacagcagactgaaggccaagggcgtgggccagcacgacaacgcccagaacttcggcaaccagagcttcgaggagctgagagccgcctgcctgagaaagggcgagctgttcgaggaccccctgttccccgccgagcccagcagcctgggcttcaaggacctgggccccaacagcaagaacgtgcagaacatcagctggcagagacccaaggacatcatcaacaaccccctgttcatcatggacggcatcagccccaccgacatctgccagggcatcctgggcgactgctggctgctggccgccatcggcagcctgaccacctgccccaagctgctgtacagagtggtgcccagaggccagagcttcaagaagaactacgccggcatcttccacttccagatctggcagttcggccagtgggtgaacgtggtggtggacgacagactgcccaccaagaacgacaagctggtgttcgtgcacagcaccgagagaagcgagttctggagcgccctgctggagaaggcctacgccaagctgagcggcagctacgaggccctgagcggcggcagcaccatggagggcctggaggacttcaccggcggcgtggcccagagcttccagctgcagagacccccccagaacctgctgagactgctgagaaaggccgtggagagaagcagcctgatgggctgcagcatcgaggtgaccagcgacagcgagctggagagcatgaccgacaagatgctggtgagaggccacgcctacagcgtgaccggcctgcaggacgtgcactacagaggcaagatggagaccctgatcagagtgagaaacccctggggcagaatcgagtggaacggcgcctggagcgacagcgccagagagtgggaggaggtggccagcgacatccagatgcagctgctgcacaagaccgaggacggcgagttctggatgagctaccaggacttcctgaacaacttcaccctgctggagatctgcaacctgacccccgacaccctgagcggcgactacaagagctactggcacaccaccttctacgagggcagctggagaagaggcagcagcgccggcggctgcagaaaccaccccggcaccttctggaccaacccccagttcaagatcagcctgcccgagggcgacgaccccgaggacgacgccgagggcaacgtggtggtgtgcacctgcctggtggccctgatgcagaagaactggagacacgccagacagcagggcgcccagctgcagaccatcggcttcgtgctgtacgccgtggccagccccttccagaacatccaggacgtgcacctgaagaaggagttcttcaccaagtaccaggaccacggcttcagcgagatcttcaccaacagcagagaggtgagcagccagctgagactgccccccggcgagtacatcatcatccccagcaccttcgagccccacagagacgccgacttcctgctgagagtgttcaccgagaagcacagcgagagctgggagctggacgaggtgaactacgccgagcagctgcaggaggagaaggtgagcgaggacgacatggaccaggacttcctgcacctgttcaagatcgtggccggcgagggcaaggagatcggcgtgtacgagctgcagagactgctgaacagaatggccatcaagttcaagagcttcaagaccaagggcttcggcctggacgcctgcagatgcatgatcaacctgatggacaaggacggcagcggcaagctgggcctgctggagttcaagatcctgtggaagaagctgaagaagtggatggacatcttcagagagtgcgaccaggaccacagcggcaccctgaacagctacgagatgagactggtgatcgagaaggccggcatcaagctgaacaacaaggtgatgcaggtgctggtggccagatacgccgacgacgacctgatcatcgacttcgacagcttcatcagctgcttcctgagactgaagaccatgttcaccttcttcctgaccatggaccccaagaacaccggccacatctgcctgagcctggagcagtggctgcagatgaccatgtggggctag

SEQ ID NO: 75189 - DNA, 2160 bp, Artificial Sequence
  Description of Artificial Sequence: Synthetic coding sequence
atggccagcagcagcggcagagtgaccatccagctggtggacgaggaggccggcgtgggcgccggcagactgcagctgttcagaggccagagctacgaggccatcagagccgcctgcctggacagcggcatcctgttcagagacccctacttccccgccggccccgacgccctgggctacgaccagctgggccccgacagcgagaaggccaagggcgtgaagtggatgagaccccacgagttctgcgccgagcccaagttcatctgcgaggacatgagcagaaccgacgtgtgccagggcagcctgggcaactgctggttcctggccgccgccgccagcctgaccctgtaccccagactgctgagaagagtggtgccccccggccaggacttccagcacggctacgccggcgtgttccacttccagctgtggcagttcggcagatggatggacgtggtggtggacgacagactgcccgtgagagagggcaagctgatgttcgtgagaagcgagcagagaaacgagttctgggcccccctgctggagaaggcctacgccaagctgcacggcagctacgaggtgatgagaggcggccacatgaacgaggccttcgtggacttcaccggcggcgtgggcgaggtgctgtacctgagacagaacagcatgggcctgttcagcgccctgagacacgccctggccaaggagagcctggtgggcgccaccgccctgagcgacagaggcgagtacagaaccgaggagggcctggtgaagggccacgcctacagcatcaccggcacccacaaggtgttcctgggcttcaccaaggtgagactgctgagactgagaaacccctggggctgcgtggagtggaccggcgcctggagcgacagctgccccagatgggacaccctgcccaccgagtgcagagacgccctgctggtgaagaaggaggacggcgagttctggatggagctgagagacttcctgctgcacttcgacaccgtgcagatctgcagcctgagccccgaggtgctgggccccagccccgagggcggcggctggcacgtgcacaccttccagggcagatgggtgagaggcttcaacagcggcggcagccagcccaacgccgagaccttctggaccaacccccagttcagactgaccctgctggagcccgacgaggaggacgacgaggacgaggagggcccctggggcggctggggcgccgccggcgccagaggccccgccagaggcggcagaacccccaagtgcaccgtgctgctgagcctgatccagagaaacagaagaagactgagagccaagggcctgacctacctgaccgtgggcttccacgtgttccagatccccgaggagctgctgggcctgtgggacagccccagaagccacgccctgctgcccagactgctgagagccgacagaagccccctgagcgccagaagagacgtgaccagaagatgctgcctgagacccggccactacctggtggtgcccagcaccgcccacgccggcgacgaggccgacttcaccctgagagtgttcagcgagagaagacacaccgccgtggagatcgacgacgtgatcagcgccgacctgcagagcctgcagggcccctacctgcccctggagctgggcctggagcagctgttccaggagctggccggcgaggaggaggagctgaacgccagccagctgcaggccctgctgagcatcgccctggagcccgccagagcccacaccagcacccccagagagatcggcctgagaacctgcgagcagctgctgcagtgcttcggccacggccagagcctggccctgcaccacttccagcagctgtggggctacctgctggagtggcaggccatcttcaacaagttcgacgaggacaccagcggcaccatgaacagctacgagctgagactggccctgaacgccgccggcttccacctgaacaaccagctgacccagaccctgaccagcagatacagagacagcagactgagagtggacttcgagagattcgtgagctgcgtggcccacctgacctgcatcttctgccactgcagccagcacctggacggcggcgagggcgtgatctgcctgacccacagacagtggatggaggtggccaccttcagctag

SEQ ID NO: 75190 - DNA, 2448 bp, Artificial Sequence
  Description of Artificial Sequence: Synthetic coding sequence
atgcccaccgtgatcagcgccagcgtggcccccagaaccgccgccgagcccagaagccccggccccgtgccccaccccgcccagagcaaggccaccgaggccggcggcggcaaccccagcggcatctacagcgccatcatcagcagaaacttccccatcatcggcgtgaaggagaagaccttcgagcagctgcacaagaagtgcctggagaagaaggtgctgtacgtggaccccgagttcccccccgacgagaccagcctgttctacagccagaagttccccatccagttcgtgtggaagagaccccccgagatctgcgagaaccccagattcatcatcgacggcgccaacagaaccgacatctgccagggcgagctgggcgactgctggttcctggccgccatcgcctgcctgaccctgaaccagcacctgctgttcagagtgatcccccacgaccagagcttcatcgagaactacgccggcatcttccacttccagttctggagatacggcgagtgggtggacgtggtgatcgacgactgcctgcccacctacaacaaccagctggtgttcaccaagagcaaccacagaaacgagttctggagcgccctgctggagaaggcctacgccaagctgcacggcagctacgaggccctgaagggcggcaacaccaccgaggccatggaggacttcaccggcggcgtggccgagttcttcgagatcagagacgcccccagcgacatgtacaagatcatgaagaaggccatcgagagaggcagcctgatgggctgcagcatcgacgacggcaccaacatgacctacggcaccagccccagcggcctgaacatgggcgagctgatcgccagaatggtgagaaacatggacaacagcctgctgcaggacagcgacctggaccccagaggcagcgacgagagacccaccagaaccatcatccccgtgcagtacgagaccagaatggcctgcggcctggtgagaggccacgcctacagcgtgaccggcctggacgaggtgcccttcaagggcgagaaggtgaagctggtgagactgagaaacccctggggccaggtggagtggaacggcagctggagcgacagatggaaggactggagcttcgtggacaaggacgagaaggccagactgcagcaccaggtgaccgaggacggcgagttctggatgagctacgaggacttcatctaccacttcaccaagctggagatctgcaacctgaccgccgacgccctgcagagcgacaagctgcagacctggaccgtgagcgtgaacgagggcagatgggtgagaggctgcagcgccggcggctgcagaaacttccccgacaccttctggaccaacccccagtacagactgaagctgctggaggaggacgacgaccccgacgacagcgaggtgatctgcagcttcctggtggccctgatgcagaagaacagaagaaaggacagaaagctgggcgccagcctgttcaccatcggcttcgccatctacgaggtgccccaccagatgcacggcaacaagcagcacctgcagaaggacttcttcctgtacaacgccagcaaggccagaagcaagacctacatcaacatgagagaggtgagccagagattcagactgccccccagcgagtacgtgatcgtgcccagcacctacgagccccaccaggagggcgagttcatcctgagagtgttcagcgagaagagaaacctgagcgaggaggtggagaacaccatcagcgtggacagacccgtgcccatcatcttcgtgagcgacagagccaacagcaacaaggagctgggcgtggaccaggagagcgaggagggcaagggcaagaccagccccgacaagcagaagcagagcccccagccccagcccggcagcagcgaccaggagagcgaggagcagcagcagttcagaaacatcttcaagcagatcgccggcgacgacatggagatctgcgccgacgagctgaagaaggtgctgaacaccgtggtgaacaagcacaaggacctgaagacccacggcttcaccctggagagctgcagaagcatgatcgccctgatggacaccgacggcagcggcaagctgaacctgcaggagttccaccacctgtggaacaagatcaaggcctggcagaagatcttcaagcactacgacaccgaccagagcggcaccatcaacagctacgagatgagaaacgccgtgaacgacgccggcttccacctgaacaaccagctgtacgacatcatcaccatgagatacgccgacaagcacatgaacatcgacttcgacagcttcatctgctgcttcgtgagactggagggcatgttcagagccttccacgccttcgacaaggacggcgacggcatcatcaagctgaacgtgctggagtggctgcagctgaccatgtacgcctag

SEQ ID NO: 75191 - DNA, 930 bp, Artificial Sequence
  Description of Artificial Sequence: Synthetic coding sequence
atgcacggcaacaagcagcacctgcagaaggacttcttcctgtacaacgccagcaaggccagaagcaagacctacatcaacatgagagaggtgagccagagattcagactgccccccagcgagtacgtgatcgtgcccagcacctacgagccccaccaggagggcgagttcatcctgagagtgttcagcgagaagagaaacctgagcgaggaggtggagaacaccatcagcgtggacagacccgtgagaaaggagacctacaagcccatcatcttcgtgagcgacagagccaacagcaacaaggagctgggcgtggaccaggagagcgaggagggcaagggcaagaccagccccgacaagcagaagcagagcccccagccccagcccggcagcagcgaccaggagagcgaggagcagcagcagttcagaaacatcttcaagcagatcgccggcgacgacatggagatctgcgccgacgagctgaagaaggtgctgaacaccgtggtgaacaagcacaaggacctgaagacccacggcttcaccctggagagctgcagaagcatgatcgccctgatggacaccgacggcagcggcaagctgaacctgcaggagttccaccacctgtggaacaagatcaaggcctggcagaagatcttcaagcactacgacaccgaccagagcggcaccatcaacagctacgagatgagaaacgccgtgaacgacgccggcttccacctgaacaaccagctgtacgacatcatcaccatgagatacgccgacaagcacatgaacatcgacttcgacagcttcatctgctgcttcgtgagactggagggcatgttcagagccttccacgccttcgacaaggacggcgacggcatcatcaagctgaacgtgctggagtggctgcagctgaccatgtacgcctag

SEQ ID NO: 75192 - DNA, 471 bp, Artificial Sequence
  Description of Artificial Sequence: Synthetic coding sequence
atggagatctgcgccgacgagctgaagaaggtgctgaacaccgtggtgaacaagcacaaggacctgaagacccacggcttcaccctggagagctgcagaagcatgatcgccctgatggacaccgacggcagcggcaagctgaacctgcaggagttccaccacctgtggaacaagatcaaggcctggcagaagatcttcaagcactacgacaccgaccagagcggcaccatcaacagctacgagatgagaaacgccgtgaacgacgccggcttccacctgaacaaccagctgtacgacatcatcaccatgagatacgccgacaagcacatgaacatcgacttcgacagcttcatctgctgcttcgtgagactggagggcatgttcagagccttccacgccttcgacaaggacggcgacggcatcatcaagctgaacgtgctggagtggctgcagctgaccatgtacgcctag

SEQ ID NO: 75193 - DNA, 2190 bp, Artificial Sequence
  Description of Artificial Sequence: Synthetic coding sequence
atgcccaccgtgatcagcgccagcgtggcccccagaaccgccgccgagcccagaagccccggccccgtgccccaccccgcccagagcaaggccaccgaggccggcggcggcaaccccagcggcatctacagcgccatcatcagcagaaacttccccatcatcggcgtgaaggagaagaccttcgagcagctgcacaagaagtgcctggagaagaaggtgctgtacgtggaccccgagttcccccccgacgagaccagcctgttctacagccagaagttccccatccagttcgtgtggaagagaccccccgagatctgcgagaaccccagattcatcatcgacggcgccaacagaaccgacatctgccagggcgagctgggcgactgctggttcctggccgccatcgcctgcctgaccctgaaccagcacctgctgttcagagtgatcccccacgaccagagcttcatcgagaactacgccggcatcttccacttccagttctggagatacggcgagtgggtggacgtggtgatcgacgactgcctgcccacctacaacaaccagctggtgttcaccaagagcaaccacagaaacgagttctggagcgccctgctggagaaggcctacgccaagctgcacggcagctacgaggccctgaagggcggcaacaccaccgaggccatggaggacttcaccggcggcgtggccgagttcttcgagatcagagacgcccccagcgacatgtacaagatcatgaagaaggccatcgagagaggcagcctgatgggctgcagcatcgacaccatcatccccgtgcagtacgagaccagaatggcctgcggcctggtgagaggccacgcctacagcgtgaccggcctggacgaggtgcccttcaagggcgagaaggtgaagctggtgagactgagaaacccctggggccaggtggagtggaacggcagctggagcgacagatggaaggactggagcttcgtggacaaggacgagaaggccagactgcagcaccaggtgaccgaggacggcgagttctggatgagctacgaggacttcatctaccacttcaccaagctggagatctgcaacctgaccgccgacgccctgcagagcgacaagctgcagacctggaccgtgagcgtgaacgagggcagatgggtgagaggctgcagcgccggcggctgcagaaacttccccgacaccttctggaccaacccccagtacagactgaagctgctggaggaggacgacgaccccgacgacagcgaggtgatctgcagcttcctggtggccctgatgcagaagaacagaagaaaggacagaaagctgggcgccagcctgttcaccatcggcttcgccatctacgaggtgcccaaggagatgcacggcaacaagcagcacctgcagaaggacttcttcctgtacaacgccagcaaggccagaagcaagacctacatcaacatgagagaggtgagccagagattcagactgccccccagcgagtacgtgatcgtgcccagcacctacgagccccaccaggagggcgagttcatcctgagagtgttcagcgagaagagaaacctgagcgaggaggtggagaacaccatcagcgtggacagacccgtgccccagcccggcagcagcgaccaggagagcgaggagcagcagcagttcagaaacatcttcaagcagatcgccggcgacgacatggagatctgcgccgacgagctgaagaaggtgctgaacaccgtggtgaacaagcacaaggacctgaagacccacggcttcaccctggagagctgcagaagcatgatcgccctgatggacaccgacggcagcggcaagctgaacctgcaggagttccaccacctgtggaacaagatcaaggcctggcagaagatcttcaagcactacgacaccgaccagagcggcaccatcaacagctacgagatgagaaacgccgtgaacgacgccggcttccacctgaacaaccagctgtacgacatcatcaccatgagatacgccgacaagcacatgaacatcgacttcgacagcttcatctgctgcttcgtgagactggagggcatgttcagagccttccacgccttcgacaaggacggcgacggcatcatcaagctgaacgtgctggagtggctgcagctgaccatgtacgcctag

SEQ ID NO: 75194 - DNA, 2187 bp, Artificial Sequence
  Description of Artificial Sequence: Synthetic coding sequence
atgagctggcagatcagcctgaagacccagaccacccagcagaagaacgagatctgcgagaaccccagattcatcatcgacggcgccaacagaaccgacatctgccagggcgagctgggcgactgctggttcctggccgccatcgcctgcctgaccctgaaccagcacctgctgttcagagtgatcccccacgaccagagcttcatcgagaactacgccggcatcttccacttccagttctggagatacggcgagtgggtggacgtggtgatcgacgactgcctgcccacctacaacaaccagctggtgttcaccaagagcaaccacagaaacgagttctggagcgccctgctggagaaggcctacgccaagctgcacggcagctacgaggccctgaagggcggcaacaccaccgaggccatggaggacttcaccggcggcgtggccgagttcttcgagatcagagacgcccccagcgacatgtacaagatcatgaagaaggccatcgagagaggcagcctgatgggctgcagcatcgacgacggcaccaacatgacctacggcaccagccccagcggcctgaacatgggcgagctgatcgccagaatggtgagaaacatggacaacagcctgctgcaggacagcgacctggaccccagaggcagcgacgagagacccaccagaaccatcatccccgtgcagtacgagaccagaatggcctgcggcctggtgagaggccacgcctacagcgtgaccggcctggacgaggtgcccttcaagggcgagaaggtgaagctggtgagactgagaaacccctggggccaggtggagtggaacggcagctggagcgacagatggaaggactggagcttcgtggacaaggacgagaaggccagactgcagcaccaggtgaccgaggacggcgagttctggatgagctacgaggacttcatctaccacttcaccaagctggagatctgcaacctgaccgccgacgccctgcagagcgacaagctgcagacctggaccgtgagcgtgaacgagggcagatgggtgagaggctgcagcgccggcggctgcagaaacttccccgacaccttctggaccaacccccagtacagactgaagctgctggaggaggacgacgaccccgacgacagcgaggtgatctgcagcttcctggtggccctgatgcagaagaacagaagaaaggacagaaagctgggcgccagcctgttcaccatcggcttcgccatctacgaggtgcccaaggagatgcacggcaacaagcagcacctgcagaaggacttcttcctgtacaacgccagcaaggccagaagcaagacctacatcaacatgagagaggtgagccagagattcagactgccccccagcgagtacgtgatcgtgcccagcacctacgagccccaccaggagggcgagttcatcctgagagtgttcagcgagaagagaaacctgagcgaggaggtggagaacaccatcagcgtggacagacccgtgcccatcatcttcgtgagcgacagagccaacagcaacaaggagctgggcgtggaccaggagagcgaggagggcaagggcaagaccagccccgacaagcagaagcagagcccccagccccagcccggcagcagcgaccaggagagcgaggagcagcagcagttcagaaacatcttcaagcagatcgccggcgacgacatggagatctgcgccgacgagctgaagaaggtgctgaacaccgtggtgaacaagcacaaggacctgaagacccacggcttcaccctggagagctgcagaagcatgatcgccctgatggacaccgacggcagcggcaagctgaacctgcaggagttccaccacctgtggaacaagatcaaggcctggcagaagatcttcaagcactacgacaccgaccagagcggcaccatcaacagctacgagatgagaaacgccgtgaacgacgccggcttccacctgaacaaccagctgtacgacatcatcaccatgagatacgccgacaagcacatgaacatcgacttcgacagcttcatctgctgcttcgtgagactggagggcatgttcagagccttccacgccttcgacaaggacggcgacggcatcatcaagctgaacgtgctggagtggctgcagctgaccatgtacgcctag

SEQ ID NO: 75195 - DNA, 2448 bp, Artificial Sequence
  Description of Artificial Sequence: Synthetic coding sequence
atgcccaccgtgatcagcgccagcgtggcccccagaaccgccgccgagcccagaagccccggccccgtgccccaccccgcccagagcaaggccaccgaggccggcggcggcaaccccagcggcatctacagcgccatcatcagcagaaacttccccatcatcggcgtgaaggagaagaccttcgagcagctgcacaagaagtgcctggagaagaaggtgctgtacgtggaccccgagttcccccccgacgagaccagcctgttctacagccagaagttccccatccagttcgtgtggaagagaccccccgagatctgcgagaaccccagattcatcatcgacggcgccaacagaaccgacatctgccagggcgagctgggcgactgctggttcctggccgccatcgcctgcctgaccctgaaccagcacctgctgttcagagtgatcccccacgaccagagcttcatcgagaactacgccggcatcttccacttccagttctggagatacggcgagtgggtggacgtggtgatcgacgactgcctgcccacctacaacaaccagctggtgttcaccaagagcaaccacagaaacgagttctggagcgccctgctggagaaggcctacgccaagctgcacggcagctacgaggccctgaagggcggcaacaccaccgaggccatggaggacttcaccggcggcgtggccgagttcttcgagatcagagacgcccccagcgacatgtacaagatcatgaagaaggccatcgagagaggcagcctgatgggctgcagcatcgacgacggcaccaacatgacctacggcaccagccccagcggcctgaacatgggcgagctgatcgccagaatggtgagaaacatggacaacagcctgctgcaggacagcgacctggaccccagaggcagcgacgagagacccaccagaaccatcatccccgtgcagtacgagaccagaatggcctgcggcctggtgagaggccacgcctacagcgtgaccggcctggacgaggtgcccttcaagggcgagaaggtgaagctggtgagactgagaaacccctggggccaggtggagtggaacggcagctggagcgacagatggaaggactggagcttcgtggacaaggacgagaaggccagactgcagcaccaggtgaccgaggacggcgagttctggatgagctacgaggacttcatctaccacttcaccaagctggagatctgcaacctgaccgccgacgccctgcagagcgacaagctgcagacctggaccgtgagcgtgaacgagggcagatgggtgagaggctgcagcgccggcggctgcagaaacttccccgacaccttctggaccaacccccagtacagactgaagctgctggaggaggacgacgaccccgacgacagcgaggtgatctgcagcttcctggtggccctgatgcagaagaacagaagaaaggacagaaagctgggcgccagcctgttcaccatcggcttcgccatctacgaggtgcccaaggagatgcacggcaacaagcagcacctgcagaaggacttcttcctgtacaacgccagcaaggccagaagcaagacctacatcaacatgagagaggtgagccagagattcagactgccccccagcgagtacgtgatcgtgcccagcacctacgagccccaccaggagggcgagttcatcctgagagtgttcagcgagaagagaaacctgagcgaggaggtggagaacaccatcagcgtggacagacccgtgcccatcatcttcgtgagcgacagagccaacagcaacaaggagctgggcgtggaccaggagagcgaggagggcaagggcaagaccagccccgacaagcagaagcagagcccccagccccagcccggcagcagcgaccaggagagcgaggagcagcagcagttcagaaacatcttcaagcagatcgccggcgacgacatggagatctgcgccgacgagctgaagaaggtgctgaacaccgtggtgaacaagcacaaggacctgaagacccacggcttcaccctggagagctgcagaagcatgatcgccctgatggacaccgacggcagcggcaagctgaacctgcaggagttccaccacctgtggaacaagatcaaggcctggcagaagatcttcaagcactacgacaccgaccagagcggcaccatcaacagctacgagatgagaaacgccgtgaacgacgccggcttccacctgaacaaccagctgtacgacatcatcaccatgagatacgccgacaagcacatgaacatcgacttcgacagcttcatctgctgcttcgtgagactggagggcatgttcagagccttccacgccttcgacaaggacggcgacggcatcatcaagctgaacgtgctggagtggctgcagctgaccatgtacgcctag

SEQ ID NO: 75196 - DNA, 2466 bp, Artificial Sequence
  Description of Artificial Sequence: Synthetic coding sequence
atgcccaccgtgatcagcgccagcgtggcccccagaaccgccgccgagcccagaagccccggccccgtgccccaccccgcccagagcaaggccaccgaggccggcggcggcaaccccagcggcatctacagcgccatcatcagcagaaacttccccatcatcggcgtgaaggagaagaccttcgagcagctgcacaagaagtgcctggagaagaaggtgctgtacgtggaccccgagttcccccccgacgagaccagcctgttctacagccagaagttccccatccagttcgtgtggaagagaccccccgagatctgcgagaaccccagattcatcatcgacggcgccaacagaaccgacatctgccagggcgagctgggcgactgctggttcctggccgccatcgcctgcctgaccctgaaccagcacctgctgttcagagtgatcccccacgaccagagcttcatcgagaactacgccggcatcttccacttccagttctggagatacggcgagtgggtggacgtggtgatcgacgactgcctgcccacctacaacaaccagctggtgttcaccaagagcaaccacagaaacgagttctggagcgccctgctggagaaggcctacgccaagctgcacggcagctacgaggccctgaagggcggcaacaccaccgaggccatggaggacttcaccggcggcgtggccgagttcttcgagatcagagacgcccccagcgacatgtacaagatcatgaagaaggccatcgagagaggcagcctgatgggctgcagcatcgacgacggcaccaacatgacctacggcaccagccccagcggcctgaacatgggcgagctgatcgccagaatggtgagaaacatggacaacagcctgctgcaggacagcgacctggaccccagaggcagcgacgagagacccaccagaaccatcatccccgtgcagtacgagaccagaatggcctgcggcctggtgagaggccacgcctacagcgtgaccggcctggacgaggtgcccttcaagggcgagaaggtgaagctggtgagactgagaaacccctggggccaggtggagtggaacggcagctggagcgacagatggaaggactggagcttcgtggacaaggacgagaaggccagactgcagcaccaggtgaccgaggacggcgagttctggatgagctacgaggacttcatctaccacttcaccaagctggagatctgcaacctgaccgccgacgccctgcagagcgacaagctgcagacctggaccgtgagcgtgaacgagggcagatgggtgagaggctgcagcgccggcggctgcagaaacttccccgacaccttctggaccaacccccagtacagactgaagctgctggaggaggacgacgaccccgacgacagcgaggtgatctgcagcttcctggtggccctgatgcagaagaacagaagaaaggacagaaagctgggcgccagcctgttcaccatcggcttcgccatctacgaggtgcccaaggagatgcacggcaacaagcagcacctgcagaaggacttcttcctgtacaacgccagcaaggccagaagcaagacctacatcaacatgagagaggtgagccagagattcagactgccccccagcgagtacgtgatcgtgcccagcacctacgagccccaccaggagggcgagttcatcctgagagtgttcagcgagaagagaaacctgagcgaggaggtggagaacaccatcagcgtggacagacccgtgaagaagaagaagaccaagcccatcatcttcgtgagcgacagagccaacagcaacaaggagctgggcgtggaccaggagagcgaggagggcaagggcaagaccagccccgacaagcagaagcagagcccccagccccagcccggcagcagcgaccaggagagcgaggagcagcagcagttcagaaacatcttcaagcagatcgccggcgacgacatggagatctgcgccgacgagctgaagaaggtgctgaacaccgtggtgaacaagcacaaggacctgaagacccacggcttcaccctggagagctgcagaagcatgatcgccctgatggacaccgacggcagcggcaagctgaacctgcaggagttccaccacctgtggaacaagatcaaggcctggcagaagatcttcaagcactacgacaccgaccagagcggcaccatcaacagctacgagatgagaaacgccgtgaacgacgccggcttccacctgaacaaccagctgtacgacatcatcaccatgagatacgccgacaagcacatgaacatcgacttcgacagcttcatctgctgcttcgtgagactggagggcatgttcagagccttccacgccttcgacaaggacggcgacggcatcatcaagctgaacgtgctggagtggctgcagctgaccatgtacgcctag

SEQ ID NO: 75197 - DNA, 930 bp, Artificial Sequence
  Description of Artificial Sequence: Synthetic coding sequence
atgcacggcaacaagcagcacctgcagaaggacttcttcctgtacaacgccagcaaggccagaagcaagacctacatcaacatgagagaggtgagccagagattcagactgccccccagcgagtacgtgatcgtgcccagcacctacgagccccaccaggagggcgagttcatcctgagagtgttcagcgagaagagaaacctgagcgaggaggtggagaacaccatcagcgtggacagacccgtgaagaagaagaagaccaagcccatcatcttcgtgagcgacagagccaacagcaacaaggagctgggcgtggaccaggagagcgaggagggcaagggcaagaccagccccgacaagcagaagcagagcccccagccccagcccggcagcagcgaccaggagagcgaggagcagcagcagttcagaaacatcttcaagcagatcgccggcgacgacatggagatctgcgccgacgagctgaagaaggtgctgaacaccgtggtgaacaagcacaaggacctgaagacccacggcttcaccctggagagctgcagaagcatgatcgccctgatggacaccgacggcagcggcaagctgaacctgcaggagttccaccacctgtggaacaagatcaaggcctggcagaagatcttcaagcactacgacaccgaccagagcggcaccatcaacagctacgagatgagaaacgccgtgaacgacgccggcttccacctgaacaaccagctgtacgacatcatcaccatgagatacgccgacaagcacatgaacatcgacttcgacagcttcatctgctgcttcgtgagactggagggcatgttcagagccttccacgccttcgacaaggacggcgacggcatcatcaagctgaacgtgctggagtggctgcagctgaccatgtacgcctag

SEQ ID NO: 75198 - DNA, 471 bp, Artificial Sequence; identical to SEQ ID NO: 75192
  Description of Artificial Sequence: Synthetic coding sequence

SEQ ID NO: 75199 - DNA, 1923 bp, Artificial Sequence
  Description of Artificial Sequence: Synthetic coding sequence
atgttcagctgcgtgaagccctacgaggaccagaactacagcgccctgagaagagactgcagaagaagaaaggtgctgttcgaggaccccctgttccccgccaccgacgacagcctgtactacaagggcacccccggccccgccgtgagatggaagagacccaagggcatctgcgaggaccccagactgttcgtggacggcatcagcagccacgacctgcaccagggccaggtgggcaactgctggttcgtggccgcctgcagcagcctggccagcagagagagcctgtggcagaaggtgatccccgactggaaggagcaggagtgggaccccgagaagcccaacgcctacgccggcatcttccacttccacttctggagattcggcgagtgggtggacgtggtgatcgacgacagactgcccaccgtgaacaaccagctgatctactgccacagcaacagcagaaacgagttctggtgcgccctggtggagaaggcctacgccaagctggccggctgctaccaggccctggacggcggcaacaccgccgacgccctggtggacttcaccggcggcgtgagcgagcccatcgacctgaccgagggcgacttcgccaacgacgagaccaagagaaaccagctgttcgagagaatgctgaaggtgcacagcagaggcggcctgatcagcgccagcatcaaggccgtgaccgccgccgacatggaggccagactggcctgcggcctggtgaagggccacgcctacgccgtgaccgacgtgagaaaggtgagactgggccacggcctgctggccttcttcaagagcgagaagctggacatgatcagactgagaaacccctggggcgagagagagtggaacggcccctggagcgacaccagcgaggagtggcagaaggtgagcaagagcgagagagagaagatgggcgtgaccgtgcaggacgacggcgagttctggatgaccttcgaggacgtgtgcagatacttcaccgacatcatcaagtgcagagtgatcaacaccagccacctgagcatccacaagacctgggaggaggccagactgcacggcgcctggaccctgcacgaggaccccagacagaacagaggcggcggctgcatcaaccacaaggacaccttcttccagaacccccagtacatcttcgaggtgaagaagcccgaggacgaggtgctgatctgcatccagcagagacccaagagaagcaccagaagagagggcaagggcgagaacctggccatcggcttcgacatctacaaggtggaggagaacagacagtacagaatgcacagcctgcagcacaaggccgccagcagcatctacatcaacagcagaagcgtgttcctgagaaccgaccagcccgagggcagatacgtgatcatccccaccaccttcgagcccggccacaccggcgagttcctgctgagagtgttcaccgacgtgcccagcaactgcagagagctgagactggacgagcccccccacacctgctggagcagcctgtgcggctacccccagctggtgacccaggtgcacgtgctgggcgccgccggcctgaaggacagccccaccggcgccaacagctacgtgatcatcaagtgcgagggcgacaaggtgagaagcgccgtgcagaagggcaccagcacccccgagtacaacgtgaagggcatcttctacagaaagaagctgagccagcccatcaccgtgcaggtgtggaaccacagagtgctgaaggacgagttcctgggccaggtgcacctgaaggccgaccccgacaacctgcaggccctgcacaccctgcacctgagagacagaaacagcagacagcccagcaacctgcccggcaccgtggccgtgcacatcctgagcagcaccagcctgatggccgtgtag

SEQ ID NO: 75200 - DNA, 2043 bp, Artificial Sequence
  Description of Artificial Sequence: Synthetic coding sequence
atgagctgcaccggcacccccagctgcatctacctgctgagcgccctgagcctgcaggacctggtgctggactgggagcccagaggcgtgcccccccccctgcccggcgccgccgccaccatgttcagctgcgtgaagccctacgaggaccagaactacagcgccctgagaagagactgcagaagaagaaaggtgctgttcgaggaccccctgttccccgccaccgacgacagcctgtactacaagggcacccccggccccgccgtgagatggaagagacccaagggcatctgcgaggaccccagactgttcgtggacggcatcagcagccacgacctgcaccagggccaggtgggcaactgctggttcgtggccgcctgcagcagcctggccagcagagagagcctgtggcagaaggtgatccccgactggaaggagcaggagtgggaccccgagaagcccaacgcctacgccggcatcttccacttccacttctggagattcggcgagtgggtggacgtggtgatcgacgacagactgcccaccgtgaacaaccagctgatctactgccacagcaacagcagaaacgagttctggtgcgccctggtggagaaggcctacgccaagctggccggctgctaccaggccctggacggcggcaacaccgccgacgccctggtggacttcaccggcggcgtgagcgagcccatcgacctgaccgagggcgacttcgccaacgacgagaccaagagaaaccagctgttcgagagaatgctgaaggtgcacagcagaggcggcctgatcagcgccagcatcaaggccgtgaccgccgccgacatggaggccagactggcctgcggcctggtgaagggccacgcctacgccgtgaccgacgtgagaaaggtgagactgggccacggcctgctggccttcttcaagagcgagaagctggacatgatcagactgagaaacccctggggcgagagagagtggaacggcccctggagcgacaccagcgaggagtggcagaaggtgagcaagagcgagagagagaagatgggcgtgaccgtgcaggacgacggcgagttctggatgaccttcgaggacgtgtgcagatacttcaccgacatcatcaagtgcagagtgatcaacaccagccacctgagcatccacaagacctgggaggaggccagactgcacggcgcctggaccctgcacgaggaccccagacagaacagaggcggcggctgcatcaaccacaaggacaccttcttccagaacccccagtacatcttcgaggtgaagaagcccgaggacgaggtgctgatctgcatccagcagagacccaagagaagcaccagaagagagggcaagggcgagaacctggccatcggcttcgacatctacaaggtggaggagaacagacagtacagaatgcacagcctgcagcacaaggccgccagcagcatctacatcaacagcagaagcgtgttcctgagaaccgaccagcccgagggcagatacgtgatcatccccaccaccttcgagcccggccacaccggcgagttcctgctgagagtgttcaccgacgtgcccagcaactgcagagagctgagactggacgagcccccccacacctgctggagcagcctgtgcggctacccccagctggtgacccaggtgcacgtgctgggcgccgccggcctgaaggacagccccaccggcgccaacagctacgtgatcatcaagtgcgagggcgacaaggtgagaagcgccgtgcagaagggcaccagcacccccgagtacaacgtgaagggcatcttctacagaaagaagctgagccagcccatcaccgtgcaggtgtggaaccacagagtgctgaaggacgagttcctgggccaggtgcacctgaaggccgaccccgacaacctgcaggccctgcacaccctgcacctgagagacagaaacagcagacagcccagcaacctgcccggcaccgtggccgtgcacatcctgagcagcaccagcctgatggccgtgtag

SEQ ID NO: 75201 - DNA, 294 bp, Artificial Sequence
  Description of Artificial Sequence: Synthetic coding sequence
atgttcagctgcgtgaagccctacgaggaccagaactacagcgccctgagaagagactgcagaagaagaaaggtgctgttcgaggaccccctgttccccgccaccgacgacagcctgtactacaagggcacccccggccccgccgtgagatggaagagacccaagggcatctgcgaggaccccagactgttcgtggacggcatcagcagccacgacctgcaccagggccaggtgggcaactgctggttcgtggccgcctgcagcagcctggccagcagagagagcctgtggtag

SEQ ID NO: 75202 - DNA, 1923 bp, Artificial Sequence; identical to SEQ ID NO: 75199
  Description of Artificial Sequence: Synthetic coding sequence

SEQ ID NO: 75203 - DNA, 1674 bp, Artificial Sequence
  Description of Artificial Sequence: Synthetic coding sequence
atgttcagctgcgtgaagccctacgaggaccagaactacagcgccctgagaagagactgcagaagaagaaaggtgctgttcgaggaccccctgttccccgccaccgacgacagcctgtactacaagggcacccccggccccgccgtgagatggaagagacccaagtacagcggccacagcctggccccccacagacccggctggggcgacgccagaagaatggagaacgtgcccagacccggcagcagcggctgccccagcagcagcctgagagccagagacctgggcatctgcgaggaccccagactgttcgtggacggcatcagcagccacgacctgcaccagggccaggtgggcaactgctggttcgtggccgcctgcagcagcctggccagcagagagagcctgtggcagaaggtgatccccgactggaaggagcaggagtgggaccccgagaagcccaacgcctacgccggcatcttccacttccacttctggagattcggcgagtgggtggacgtggtgatcgacgacagactgcccaccgtgaacaaccagctgatctactgccacagcaacagcagaaacgagttctggtgcgccctggtggagaaggcctacgccaagctggccggctgctaccaggccctggacggcggcaacaccgccgacgccctggtggacttcaccggcggcgtgagcgagcccatcgacctgaccgagggcgacttcgccaacgacgagaccaagagaaaccagctgttcgagagaatgctgaaggtgcacagcagaggcggcctgatcagcgccagcatcaaggccgtgaccgccgccgacatggaggccagactggcctgcggcctggtgaagggccacgcctacgccgtgaccgacgtgagaaaggtgagactgggccacggcctgctggccttcttcaagagcgagaagctggacatgatcagactgagaaacccctggggcgagagagagtggaacggcccctggagcgacaccagcgaggagtggcagaaggtgagcaagagcgagagagagaagatgggcgtgaccgtgcaggacgacggcgagttctggatgaccttcgaggacgtgtgcagatacttcaccgacatcatcaagtgcagagtgatcaacaccagccacctgagcatccacaagacctgggaggaggccagactgcacggcgcctggaccctgcacgaggaccccagacagaacagaggcggcggctgcatcaaccacaaggacaccttcttccagaacccccagtacatcttcgaggtgaagaagcccgaggacgaggtgctgatctgcatccagcagagacccaagagaagcaccagaagagagggcaagggcgagaacctggccatcggcttcgacatctacaaggtggaggagaacagacagtacagaatgcacagcctgcagcacaaggccgccagcagcatctacatcaacagcagaagcgtgttcctgagaaccgaccagcccgagggcagatacgtgatcatccccaccaccttcgagcccggccacaccggcgagttcctgctgagagtgttcaccgacgtgcccagcaactgcagagagctgagactggacgagcccccccacacctgctggagcagcctgtgcggctacccccagtggtag

SEQ ID NO: 75204 - DNA, 2442 bp, Artificial Sequence
  Description of Artificial Sequence: Synthetic coding sequence
atggacgccaccgccctggagagagacgccgtgcagttcgccagactggccgtgcagagagaccacgagggcagatacagcgaggccgtgttctactacaaggaggccgcccaggccctgatctacgccgagatggccggcagcagcctggagaacatccaggagaagatcaccgagtacctggagagagtgcaggccctgcacagcgccgtgcagagcaagagcgccgaccccctgaagagcaagcaccagctggacctggagagagcccacttcctggtgacccaggccttcgacgaggacgagaaggagaacgtggaggacgccatcgagctgtacaccgaggccgtggacctgtgcctgaagaccagctacgagaccgccgacaaggtgctgcagaacaagctgaagcagctggccagacaggccctggacagagccgaggccctgagcgagcccctgaccaagcccgtgggcaagatcagcagcaccagcgtgaagcccaagcccccccccgtgagagcccacttccccctgggcgccaaccccttcctggagagaccccagagcttcatcagcccccagagctgcgacgcccagggccagagatacaccgccgaggagatcgaggtgctgagaaccaccagcaagatcaacggcatcgagtacgtgcccttcatgaacgtggacctgagagagagattcgcctaccccatgcccttctgcgacagatggggcaagctgcccctgagccccaagcagaagaccaccttcagcaagtgggtgagacccgaggacctgaccaacaaccccaccatgatctacaccgtgagcagcttcagcatcaagcagaccatcgtgagcgactgcagcttcgtggccagcctggccatcagcgccgcctacgagagaagattcaacaagaagctgatcaccggcatcatctacccccagaacaaggacggcgagcccgagtacaacccctgcggcaagtacatggtgaagctgcacctgaacggcgtgcccagaaaggtgatcatcgacgaccagctgcccgtggaccacaagggcgagctgctgtgcagctacagcaacaacaagagcgagctgtgggtgagcctgatcgagaaggcctacatgaaggtgatgggcggctacgacttccccggcagcaacagcaacatcgacctgcacgccctgaccggctggatccccgagagaatcgccatgcacagcgacagccagaccttcagcaaggacaacagcttcagaatgctgtaccagagattccacaagggcgacgtgctgatcaccgccagcaccggcatgatgaccgaggccgagggcgagaagtggggcctggtgcccacccacgcctacgccgtgctggacatcagagagttcaagggcctgagattcatccagctgaagaacccctggagccacctgagatggaagggcagatacagcgagaacgacgtgaagaactggacccccgagctgcagaagtacctgaacttcgaccccagaaccgcccagaagatcgacaacggcatcttctggatcagctgggacgacctgtgccagtactacgacgtgatctacctgagctggaaccccggcctgttcaaggagagcacctgcatccacagcacctgggacgccaagcagggccccgtgaaggacgcctacagcctggccaacaacccccagtacaagctggaggtgcagtgcccccagggcggcgccgccgtgtgggtgctgctgagcagacacatcaccgacaaggacgacttcgccaacaacagagagttcatcaccatggtggtgtacaagaccgacggcaagaaggtgtactaccccgccgacccccccccctacatcgacggcatcagaatcaacagcccccactacctgaccaagatcaagctgaccacccccggcacccacaccttcaccctggtggtgagccagtacgagaagcagaacaccatccactacaccgtgagagtgtacagcgcctgcagcttcaccttcagcaagatccccagcccctacaccctgagcaagagaatcaacggcaagtggagcggccagagcgccggcggctgcggcaacttccaggagacccacaagaacaaccccatctaccagttccacatcgagaagaccggccccctgctgatcgagctgagaggccccagacagtacagcgtgggcttcgaggtggtgaccgtgagcaccctgggcgaccccggcccccacggcttcctgagaaagagcagcggcgactacagatgcggcttctgctacctggagctggagaacatccccagcggcatcttcaacatcatccccagcaccttcctgcccaagcaggagggccccttcttcctggacttcaacagcatcatccccatcaagatcacccagctgcagtag

SEQ ID NO: 75205 - DNA, 2073 bp, Artificial Sequence
  Description of Artificial Sequence: Synthetic coding sequence
atgccctacctgtacagagcccccggcccccaggcccaccccgtgcccaaggacgccagaatcacccacagcagcggccagagcttcgagcagatgagacaggagtgcctgcagagaggcaccctgttcgaggacgccgacttccccgccagcaacagcagcctgttctacagcgagagaccccagatccccttcgtgtggaagagacccggcgagatcgtgaagaaccccgagttcatcctgggcggcgccaccagaaccgacatctgccagggcgagctgggcgactgctggctgctggccgccatcgccagcctgaccctgaaccagaaggccctggccagagtgatcccccaggaccagagcttcggccccggctacgccggcatcttccacttccagttctggcagcacagcgagtggctggacgtggtgatcgacgacagactgcccaccttcagagacagactggtgttcctgcacagcgccgaccacaacgagttctggagcgccctgctggagaaggcctacgccaagctgaacggcagctacgaggccctgaagggcggcagcgccatcgaggccatggaggacttcaccggcggcgtggccgagaccttccagaccaaggaggcccccgagaacttctacgagatcctggagaaggccctgaagagaggcagcctgctgggctgcttcatcgacaccagaagcgccgccgagagcgaggccagaacccccttcggcctgatcaagggccacgcctacagcgtgaccggcatcgaccaggtgagcttcagaggccagagaatcgagctgatcagaatcagaaacccctggggccaggtggagtggaacggcagctggagcgacagcagccccgagtggagaagcgtgggccccgccgagcagaagagactgtgccacaccgccctggacgacggcgagttctggatggccttcaaggacttcaaggcccacttcgacaaggtggagatctgcaacctgacccccgacgccctggaggaggacgccatccacaagtgggaggtgaccgtgcaccagggcagctgggtgagaggcagcaccgccggcggctgcagaaacttcctggacaccttctggaccaacccccagatcaagctgagcctgaccgagaaggacgagggccaggaggagtgcagcttcctggtggccctgatgcagaaggacagaagaaagctgaagagattcggcgccaacgtgctgaccatcggctacgccatctacgagtgccccgacaaggacgagcacctgaacaaggacttcttcagataccacgccagcagagccagaagcaagaccttcatcaacctgagagaggtgagcgacagattcaagctgccccccggcgagtacatcctgatccccagcaccttcgagccccaccaggaggccgacttctgcctgagaatcttcagcgagaagaaggccatcaccagagacatggacggcaacgtggacatcgacctgcccgagccccccaagcccaccccccccgaccaggagaccgaggaggagcagagattcagagccctgttcgagcaggtggccggcgaggacatggaggtgaccgccgaggagctggagtacgtgctgaacgccgtgctgcagaagaagaaggacatcaagttcaagaagctgagcctgatcagctgcaagaacatcatcagcctgatggacaccagcggcaacggcaagctggagttcgacgagttcaaggtgttctgggacaagctgaagcagtggatcaacctgttcctgagattcgacgccgacaagagcggcaccatgagcacctacgagctgagaaccgccctgaaggccgccggcttccagctgagcagccacctgctgcagctgatcgtgctgagatacgccgacgaggagctgcagctggacttcgacgacttcctgaactgcctggtgagactggagaacgccagcagagtgttccaggccctgagcaccaagaacaaggagttcatccacctgaacatcaacgagttcatccacctgaccatgaacatctag

SEQ ID NO: 75206 - DNA, 1995 bp, Artificial Sequence
  Description of Artificial Sequence: Synthetic coding sequence
atgccctacctgtacagagcccccggcccccaggcccaccccgtgcccaaggacgccagaatcacccacagcagcggccagagcttcgagcagatgagacaggagtgcctgcagagaggcaccctgttcgaggacgccgacttccccgccagcaacagcagcctgttctacagcgagagaccccagatccccttcgtgtggaagagacccggcgagatcgtgaagaaccccgagttcatcctgggcggcgccaccagaaccgacatctgccagggcgagctgggcgactgctggctgctggccgccatcgccagcctgaccctgaaccagaaggccctggccagagtgatcccccaggaccagagcttcggccccggctacgccggcatcttccacttccagttctggcagcacagcgagtggctggacgtggtgatcgacgacagactgcccaccttcagagacagactggtgttcctgcacagcgccgaccacaacgagttctggagcgccctgctggagaaggcctacgccaagctgaacggcagctacgaggccctgaagggcggcagcgccatcgaggccatggaggacttcaccggcggcgtggccgagaccttccagaccaaggaggcccccgagaacttctacgagatcctggagaaggccctgaagagaggcagcctgctgggctgcttcatcgacaccagaagcgccgccgagagcgaggccagaacccccttcggcctgatcaagggccacgcctacagcgtgaccggcatcgaccaggtgagcttcagaggccagagaatcgagctgatcagaatcagaaacccctggggccaggtggagtggaacggcagctggagcgacagaatggccttcaaggacttcaaggcccacttcgacaaggtggagatctgcaacctgacccccgacgccctggaggaggacgccatccacaagtgggaggtgaccgtgcaccagggcagctgggtgagaggcagcaccgccggcggctgcagaaacttcctggacaccttctggaccaacccccagatcaagctgagcctgaccgagaaggacgagggccaggaggagtgcagcttcctggtggccctgatgcagaaggacagaagaaagctgaagagattcggcgccaacgtgctgaccatcggctacgccatctacgagtgccccgacaaggacgagcacctgaacaaggacttcttcagataccacgccagcagagccagaagcaagaccttcatcaacctgagagaggtgagcgacagattcaagctgccccccggcgagtacatcctgatccccagcaccttcgagccccaccaggaggccgacttctgcctgagaatcttcagcgagaagaaggccatcaccagagacatggacggcaacgtggacatcgacctgcccgagccccccaagcccaccccccccgaccaggagaccgaggaggagcagagattcagagccctgttcgagcaggtggccggcgaggacatggaggtgaccgccgaggagctggagtacgtgctgaacgccgtgctgcagaagaagaaggacatcaagttcaagaagctgagcctgatcagctgcaagaacatcatcagcctgatggacaccagcggcaacggcaagctggagttcgacgagttcaaggtgttctgggacaagctgaagcagtggatcaacctgttcctgagattcgacgccgacaagagcggcaccatgagcacctacgagctgagaaccgccctgaaggccgccggcttccagctgagcagccacctgctgcagctgatcgtgctgagatacgccgacgaggagctgcagctggacttcgacgacttcctgaactgcctggtgagactggagaacgccagcagagtgttccaggccctgagcaccaagaacaaggagttcatccacctgaacatcaacgagttcatccacctgaccatgaacatctag

SEQ ID NO: 75207 - DNA, 1884 bp, Artificial Sequence
  Description of Artificial Sequence: Synthetic coding sequence
atgccctacctgtacagagcccccggcccccaggcccaccccgtgcccaaggacgccagaatcacccacagcagcggccagagcttcgagcagatgagacaggagtgcctgcagagaggcaccctgttcgaggacgccgacttccccgccagcaacagcagcctgttctacagcgagagaccccagatccccttcgtgtggaagagacccggcttctggcagcacagcgagtggctggacgtggtgatcgacgacagactgcccaccttcagagacagactggtgttcctgcacagcgccgaccacaacgagttctggagcgccctgctggagaaggcctacgccaagctgaacggcagctacgaggccctgaagggcggcagcgccatcgaggccatggaggacttcaccggcggcgtggccgagaccttccagaccaaggaggcccccgagaacttctacgagatcctggagaaggccctgaagagaggcagcctgctgggctgcttcatcgacaccagaagcgccgccgagagcgaggccagaacccccttcggcctgatcaagggccacgcctacagcgtgaccggcatcgaccaggtgagcttcagaggccagagaatcgagctgatcagaatcagaaacccctggggccaggtggagtggaacggcagctggagcgacagcagccccgagtggagaagcgtgggccccgccgagcagaagagactgtgccacaccgccctggacgacggcgagttctggatggccttcaaggacttcaaggcccacttcgacaaggtggagatctgcaacctgacccccgacgccctggaggaggacgccatccacaagtgggaggtgaccgtgcaccagggcagctgggtgagaggcagcaccgccggcggctgcagaaacttcctggacaccttctggaccaacccccagatcaagctgagcctgaccgagaaggacgagggccaggaggagtgcagcttcctggtggccctgatgcagaaggacagaagaaagctgaagagattcggcgccaacgtgctgaccatcggctacgccatctacgagtgccccgacaaggacgagcacctgaacaaggacttcttcagataccacgccagcagagccagaagcaagaccttcatcaacctgagagaggtgagcgacagattcaagctgccccccggcgagtacatcctgatccccagcaccttcgagccccaccaggaggccgacttctgcctgagaatcttcagcgagaagaaggccatcaccagagacatggacggcaacgtggacatcgacctgcccgagccccccaagcccaccccccccgaccaggagaccgaggaggagcagagattcagagccctgttcgagcaggtggccggcgaggacatggaggtgaccgccgaggagctggagtacgtgctgaacgccgtgctgcagaagaagaaggacatcaagttcaagaagctgagcctgatcagctgcaagaacatcatcagcctgatggacaccagcggcaacggcaagctggagttcgacgagttcaaggtgttctgggacaagctgaagcagtggatcaacctgttcctgagattcgacgccgacaagagcggcaccatgagcacctacgagctgagaaccgccctgaaggccgccggcttccagctgagcagccacctgctgcagctgatcgtgctgagatacgccgacgaggagctgcagctggacttcgacgacttcctgaactgcctggtgagactggagaacgccagcagagtgttccaggccctgagcaccaagaacaaggagttcatccacctgaacatcaacgagttcatccacctgaccatgaacatctag

SEQ ID NO: 75208 - DNA, 807 bp, Artificial Sequence
  Description of Artificial Sequence: Synthetic coding sequence
atgttcctggtgaacagcttcctgaagggcggcggcggcggcggcggcggcggcggcggcctgggcggcggcctgggcaacgtgctgggcggcctgatcagcggcgccggcggcggcggcggcggcggcggcggcggcggcggcggcggcggcggcggcggcggcggcaccgccatgagaatcctgggcggcgtgatcagcgccatcagcgaggccgccgcccagtacaaccccgagccccccccccccagaacccactacagcaacatcgaggccaacgagagcgaggaggtgagacagttcagaagactgttcgcccagctggccggcgacgacatggaggtgagcgccaccgagctgatgaacatcctgaacaaggtggtgaccagacaccccgacctgaagaccgacggcttcggcatcgacacctgcagaagcatggtggccgtgatggacagcgacaccaccggcaagctgggcttcgaggagttcaagtacctgtggaacaacatcaagagatggcaggccatctacaagcagttcgacaccgacagaagcggcaccatctgcagcagcgagctgcccggcgccttcgaggccgccggcttccacctgaacgagcacctgtacaacatgatcatcagaagatacagcgacgagagcggcaacatggacttcgacaacttcatcagctgcctggtgagactggacgccatgttcagagccttcaagagcctggacaaggacggcaccggccagatccaggtgaacatccaggagtggctgcagctgaccatgtacagctag

SEQ ID NO: 75209 - DNA, 2061 bp, Artificial Sequence
  Description of Artificial Sequence: Synthetic coding sequence
atgaaccccaccgagaccaaggccgtgaagaccgagcccgagaagaagagccagagcaccaagctgagcgtggtgcacgagaagaagagccaggagggcaagcccaaggagcacaccgagcccaagagcctgcccaagcaggccagcgacaccggcagcaacgacgcccacaacaagaaggccgtgagcagaagcgccgagcagcagcccagcgagaagagcaccgagcccaagaccaagccccaggacatgatcagcgccggcggcgagagcgtggccggcatcaccgccatcagcggcaagcccggcgacaagaagaaggagaagaagagcctgacccccgccgtgcccgtggagagcaagcccgacaagcccagcggcaagagcggcatggacgccgccctggacgacctgatcgacaccctgggcggccccgaggagaccgaggaggagaacaccacctacaccggccccgaggtgagcgaccccatgagcagcacctacatcgaggagctgggcaagagagaggtgaccatcccccccaagtacagagagctgctggccaagaaggagggcatcaccggcccccccgccgacagcagcaagcccatcggccccgacgacgccatcgacgccctgagcagcgacttcacctgcggcagccccaccgccgccggcaagaagaccgagaaggaggagagcaccgaggtgctgaaggcccagagcgccggcaccgtgagaagcgccgcccccccccaggagaagaagagaaaggtggagaaggacaccatgagcgaccaggccctggaggccctgagcgccagcctgggcaccagacaggccgagcccgagctggacctgagaagcatcaaggaggtggacgaggccaaggccaaggaggagaagctggagaagtgcggcgaggacgacgagaccatccccagcgagtacagactgaagcccgccaccgacaaggacggcaagcccctgctgcccgagcccgaggagaagcccaagcccagaagcgagagcgagctgatcgacgagctgagcgaggacttcgacagaagcgagtgcaaggagaagcccagcaagcccaccgagaagaccgaggagagcaaggccgccgcccccgcccccgtgagcgaggccgtgtgcagaaccagcatgtgcagcatccagagcgccccccccgagcccgccaccctgaagggcaccgtgcccgacgacgccgtggaggccctggccgacagcctgggcaagaaggaggccgaccccgaggacggcaagcccgtgatggacaaggtgaaggagaaggccaaggaggaggacagagagaagctgggcgagaaggaggagaccatcccccccgactacagactggaggaggtgaaggacaaggacggcaagcccctgctgcccaaggagagcaaggagcagctgccccccatgagcgaggacttcctgctggacgccctgagcgaggacttcagcggcccccagaacgccagcagcctgaagttcgaggacgccaagctggccgccgccatcagcgaggtggtgagccagacccccgccagcaccacccaggccggcgccccccccagagacaccagccagagcgacaaggacctggacgacgccctggacaagctgagcgacagcctgggccagagacagcccgaccccgacgagaacaagcccatggaggacaaggtgaaggagaaggccaaggccgagcacagagacaagctgggcgagagagacgacaccatcccccccgagtacagacacctgctggacgacaacggccaggacaagcccgtgaagccccccaccaagaagagcgaggacagcaagaagcccgccgacgaccaggaccccatcgacgccctgagcggcgacctggacagctgccccagcaccaccgagaccagccagaacaccgccaaggacaagtgcaagaaggccgccagcagcagcaaggcccccaagaacggcggcaaggccaaggacagcgccaagaccaccgaggagaccagcaagcccaaggacgactag

SEQ ID NO: 75210 - DNA, 2271 bp, Artificial Sequence
  Description of Artificial Sequence: Synthetic coding sequence
atgagccagcccggccagaagcccgccgccagccccagacccagaagagccgccgccgccagaagaacccacgagcacgtgagcgagaagaccagcgagagccccagcaagcccggcgagaagaagggcagcgacgagaagaaggccgccagcctgggcagcagccagagcagcagaacctacgccggcggcaccgccagcgccaccaaggtgagcgccagcagcggcgccaccagcaagagcagcagcatgaaccccaccgagaccaaggccgtgaagaccgagcccgagaagaagagccagagcaccaagctgagcgtggtgcacgagaagaagagccaggagggcaagcccaaggagcacaccgagcccaagagcctgcccaagcaggccagcgacaccggcagcaacgacgcccacaacaagaaggccgtgagcagaagcgccgagcagcagcccagcgagaagagcaccgagcccaagaccaagccccaggacatgatcagcgccggcggcgagagcgtggccggcatcaccgccatcagcggcaagcccggcgacaagaagaaggagaagaagagcctgacccccgccgtgcccgtggagagcaagcccgacaagcccagcggcaagagcggcatggacgccgccctggacgacctgatcgacaccctgggcggccccgaggagaccgaggaggagaacaccacctacaccggccccgaggtgagcgaccccatgagcagcacctacatcgaggagctgggcaagagagaggtgaccatcccccccaagtacagagagctgctggccaagcccatcggccccgacgacgccatcgacgccctgagcagcgacttcacctgcggcagccccaccgccgccggcaagaagaccgagaaggaggagagcaccgaggtgctgaaggcccagagcgccggcaccgtgagaagcgccgcccccccccaggagaagaagagaaaggtggagaaggacaccatgagcgaccaggccctggaggccctgagcgccagcctgggcaccagacaggccgagcccgagctggacctgagaagcatcaaggaggtggacgaggccaaggccaaggaggagaagctggagaagtgcggcgaggacgacgagaccatccccagcgagtacagactgaagcccgccaccgacaaggacggcaagcccctgctgcccgagcccgaggagaagcccaagcccagaagcgagagcgagctgatcgacgagctgagcgaggacttcgacagaagcgagtgcaaggagaagcccagcaagcccaccgagaagaccgaggagagcaaggccgccgcccccgcccccgtgagcgaggccgtgtgcagaaccagcatgtgcagcatccagagcgccccccccgagcccgccaccctgaagggcaccgtgcccgacgacgccgtggaggccctggccgacagcctgggcaagaaggaggccgaccccgaggacggcaagcccgtgatggacaaggtgaaggagaaggccaaggaggaggacagagagaagctgggcgagaaggaggagaccatcccccccgactacagactggaggaggtgaaggacaaggacggcaagcccctgctgcccaaggagagcaaggagcagctgccccccatgagcgaggacttcctgctggacgccctgagcgaggacttcagcggcccccagaacgccagcagcctgaagttcgaggacgccaagctggccgccgccatcagcgaggtggtgagccagacccccgccagcaccacccaggccggcgccccccccagagacaccagccagagcgacaaggacctggacgacgccctggacaagctgagcgacagcctgggccagagacagcccgaccccgacgagaacaagcccatggaggacaaggtgaaggagaaggccaaggccgagcacagagacaagctgggcgagagagacgacaccatcccccccgagtacagacacctgctggacgacaacggccaggacaagcccgtgaagccccccaccaagaagagcgaggacagcaagaagcccgccgacgaccaggaccccatcgacgccctgagcggcgacctggacagctgccccagcaccaccgagaccagccagaacaccgccaaggacaagtgcaagaaggccgccagcagcagcaaggcccccaagaacggcggcaaggccaaggacagcgccaagaccaccgaggagaccagcaagcccaaggacgactag

SEQ ID NO: 75211 - DNA, 2088 bp, Artificial Sequence
  Description of Artificial Sequence: Synthetic coding sequence
atgaaccccaccgagaccaaggccatccccgtgagccagcagatggagggcccccacctgcccaacaagaagaagcacaagaagcaggccgtgaagaccgagcccgagaagaagagccagagcaccaagctgagcgtggtgcacgagaagaagagccaggagggcaagcccaaggagcacaccgagcccaagagcctgcccaagcaggccagcgacaccggcagcaacgacgcccacaacaagaaggccgtgagcagaagcgccgagcagcagcccagcgagaagagcaccgagcccaagaccaagccccaggacatgatcagcgccggcggcgagagcgtggccggcatcaccgccatcagcggcaagcccggcgacaagaagaaggagaagaagagcctgacccccgccgtgcccgtggagagcaagcccgacaagcccagcggcaagagcggcatggacgccgccctggacgacctgatcgacaccctgggcggccccgaggagaccgaggaggagaacaccacctacaccggccccgaggtgagcgaccccatgagcagcacctacatcgaggagctgggcaagagagaggtgaccatcccccccaagtacagagagctgctggccaagcccatcggccccgacgacgccatcgacgccctgagcagcgacttcacctgcggcagccccaccgccgccggcaagaagaccgagaaggaggagagcaccgaggtgctgaaggcccagagcgccggcaccgtgagaagcgccgcccccccccaggagaagaagagaaaggtggagaaggacaccatgagcgaccaggccctggaggccctgagcgccagcctgggcaccagacaggccgagcccgagctggacctgagaagcatcaaggaggtggacgaggccaaggccaaggaggagaagctggagaagtgcggcgaggacgacgagaccatccccagcgagtacagactgaagcccgccaccgacaaggacggcaagcccctgctgcccgagcccgaggagaagcccaagcccagaagcgagagcgagctgatcgacgagctgagcgaggacttcgacagaagcgagtgcaaggagaagcccagcaagcccaccgagaagaccgaggagagcaaggccgccgcccccgcccccgtgagcgaggccgtgtgcagaaccagcatgtgcagcatccagagcgccccccccgagcccgccaccctgaagggcaccgtgcccgacgacgccgtggaggccctggccgacagcctgggcaagaaggaggccgaccccgaggacggcaagcccgtgatggacaaggtgaaggagaaggccaaggaggaggacagagagaagctgggcgagaaggaggagaccatcccccccgactacagactggaggaggtgaaggacaaggacggcaagcccctgctgcccaaggagagcaaggagcagctgccccccatgagcgaggacttcctgctggacgccctgagcgaggacttcagcggcccccagaacgccagcagcctgaagttcgaggacgccaagctggccgccgccatcagcgaggtggtgagccagacccccgccagcaccacccaggccggcgccccccccagagacaccagccagagcgacaaggacctggacgacgccctggacaagctgagcgacagcctgggccagagacagcccgaccccgacgagaacaagcccatggaggacaaggtgaaggagaaggccaaggccgagcacagagacaagctgggcgagagagacgacaccatcccccccgagtacagacacctgctggacgacaacggccaggacaagcccgtgaagccccccaccaagaagagcgaggacagcaagaagcccgccgacgaccaggaccccatcgacgccctgagcggcgacctggacagctgccccagcaccaccgagaccagccagaacaccgccaaggacaagtgcaagaaggccgccagcagcagcaaggcccccaagaacggcggcaaggccaaggacagcgccaagaccaccgaggagaccagcaagcccaaggacgactag

SEQ ID NO: 75212 - DNA, 2127 bp, Artificial Sequence
  Description of Artificial Sequence: Synthetic coding sequence
atgaaccccaccgagaccaaggccatccccgtgagccagcagatggagggcccccacctgcccaacaagaagaagcacaagaagcaggccgtgaagaccgagcccgagaagaagagccagagcaccaagctgagcgtggtgcacgagaagaagagccaggagggcaagcccaaggagcacaccgagcccaagagcctgcccaagcaggccagcgacaccggcagcaacgacgcccacaacaagaaggccgtgagcagaagcgccgagcagcagcccagcgagaagagcaccgagcccaagaccaagccccaggacatgatcagcgccggcggcgagagcgtggccggcatcaccgccatcagcggcaagcccggcgacaagaagaaggagaagaagagcctgacccccgccgtgcccgtggagagcaagcccgacaagcccagcggcaagagcggcatggacgccgccctggacgacctgatcgacaccctgggcggccccgaggagaccgaggaggagaacaccacctacaccggccccgaggtgagcgaccccatgagcagcacctacatcgaggagctgggcaagagagaggtgaccatcccccccaagtacagagagctgctggccaagaaggagggcatcaccggcccccccgccgacagcagcaagcccatcggccccgacgacgccatcgacgccctgagcagcgacttcacctgcggcagccccaccgccgccggcaagaagaccgagaaggaggagagcaccgaggtgctgaaggcccagagcgccggcaccgtgagaagcgccgcccccccccaggagaagaagagaaaggtggagaaggacaccatgagcgaccaggccctggaggccctgagcgccagcctgggcaccagacaggccgagcccgagctggacctgagaagcatcaaggaggtggacgaggccaaggccaaggaggagaagctggagaagtgcggcgaggacgacgagaccatccccagcgagtacagactgaagcccgccaccgacaaggacggcaagcccctgctgcccgagcccgaggagaagcccaagcccagaagcgagagcgagctgatcgacgagctgagcgaggacttcgacagaagcgagtgcaaggagaagcccagcaagcccaccgagaagaccgaggagagcaaggccgccgcccccgcccccgtgagcgaggccgtgtgcagaaccagcatgtgcagcatccagagcgccccccccgagcccgccaccctgaagggcaccgtgcccgacgacgccgtggaggccctggccgacagcctgggcaagaaggaggccgaccccgaggacggcaagcccgtgatggacaaggtgaaggagaaggccaaggaggaggacagagagaagctgggcgagaaggaggagaccatcccccccgactacagactggaggaggtgaaggacaaggacggcaagcccctgctgcccaaggagagcaaggagcagctgccccccatgagcgaggacttcctgctggacgccctgagcgaggacttcagcggcccccagaacgccagcagcctgaagttcgaggacgccaagctggccgccgccatcagcgaggtggtgagccagacccccgccagcaccacccaggccggcgccccccccagagacaccagccagagcgacaaggacctggacgacgccctggacaagctgagcgacagcctgggccagagacagcccgaccccgacgagaacaagcccatggaggacaaggtgaaggagaaggccaaggccgagcacagagacaagctgggcgagagagacgacaccatcccccccgagtacagacacctgctggacgacaacggccaggacaagcccgtgaagccccccaccaagaagagcgaggacagcaagaagcccgccgacgaccaggaccccatcgacgccctgagcggcgacctggacagctgccccagcaccaccgagaccagccagaacaccgccaaggacaagtgcaagaaggccgccagcagcagcaaggcccccaagaacggcggcaaggccaaggacagcgccaagaccaccgaggagaccagcaagcccaaggacgactag

SEQ ID NO: 75213 - DNA, 2319 bp, Artificial Sequence
  Description of Artificial Sequence: Synthetic coding sequence
atgagccagcccggccagaagcccgccgccagccccagacccagaagagccgccgccgccagaagaacccacgagcacgtgagcgagaagaccagcgagagccccagcaagcccggcgagaagaagggcagcgacgagaagaaggccgccagcctgggcagcagccagagcagcagaacctacgccggcggcaccgccagcgccaccaaggtgagcgccagcagcggcgccaccagcaagagcagcagcatgaaccccaccgagaccaaggccatccccgtgagccagcagatggagggcccccacctgcccaacaagaagaagcacaagaagcaggccgtgaagaccgagcccgagaagaagagccagagcaccaagcccaagagcctgcccaagcaggccagcgacaccggcagcaacgacgcccacaacaagaaggccgtgagcagaagcgccgagcagcagcccagcgagaagagcaccgagcccaagaccaagccccaggacatgatcagcgccggcggcgagagcgtggccggcatcaccgccatcagcggcaagcccggcgacaagaagaaggagaagaagagcctgacccccgccgtgcccgtggagagcaagcccgacaagcccagcggcaagagcggcatggacgccgccctggacgacctgatcgacaccctgggcggccccgaggagaccgaggaggagaacaccacctacaccggccccgaggtgagcgaccccatgagcagcacctacatcgaggagctgggcaagagagaggtgaccatcccccccaagtacagagagctgctggccaagaaggagggcatcaccggcccccccgccgacagcagcaagcccatcggccccgacgacgccatcgacgccctgagcagcgacttcacctgcggcagccccaccgccgccggcaagaagaccgagaaggaggagagcaccgaggtgctgaaggcccagagcgccggcaccgtgagaagcgccgcccccccccaggagaagaagagaaaggtggagaaggacaccatgagcgaccaggccctggaggccctgagcgccagcctgggcaccagacaggccgagcccgagctggacctgagaagcatcaaggaggtggacgaggccaaggccaaggaggagaagctggagaagtgcggcgaggacgacgagaccatccccagcgagtacagactgaagcccgccaccgacaaggacggcaagcccctgctgcccgagcccgaggagaagcccaagcccagaagcgagagcgagctgatcgacgagctgagcgaggacttcgacagaagcgagtgcaaggagaagcccagcaagcccaccgagaagaccgaggagagcaaggccgccgcccccgcccccgtgagcgaggccgtgtgcagaaccagcatgtgcagcatccagagcgccccccccgagcccgccaccctgaagggcaccgtgcccgacgacgccgtggaggccctggccgacagcctgggcaagaaggaggccgaccccgaggacggcaagcccgtgatggacaaggtgaaggagaaggccaaggaggaggacagagagaagctgggcgagaaggaggagaccatcccccccgactacagactggaggaggtgaaggacaaggacggcaagcccctgctgcccaaggagagcaaggagcagctgccccccatgagcgaggacttcctgctggacgccctgagcgaggacttcagcggcccccagaacgccagcagcctgaagttcgaggacgccaagctggccgccgccatcagcgaggtggtgagccagacccccgccagcaccacccaggccggcgccccccccagagacaccagccagagcgacaaggacctggacgacgccctggacaagctgagcgacagcctgggccagagacagcccgaccccgacgagaacaagcccatggaggacaaggtgaaggagaaggccaaggccgagcacagagacaagctgggcgagagagacgacaccatcccccccgagtacagacacctgctggacgacaacggccaggacaagcccgtgaagccccccaccaagaagagcgaggacagcaagaagcccgccgacgaccaggaccccatcgacgccctgagcggcgacctggacagctgccccagcaccaccgagaccagccagaacaccgccaaggacaagtgcaagaaggccgccagcagcagcaaggcccccaagaacggcggcaaggccaaggacagcgccaagaccaccgaggagaccagcaagcccaaggacgactag

SEQ ID NO: 75214 - DNA, 2376 bp, Artificial Sequence
  Description of Artificial Sequence: Synthetic coding sequence
atgagccagcccggccagaagcccgccgccagccccagacccagaagagccgccgccgccagaagaacccacgagcacgtgagcgagaagaccagcgagagccccagcaagcccggcgagaagaagggcagcgacgagaagaaggccgccagcctgggcagcagccagagcagcagaacctacgccggcggcaccgccagcgccaccaaggtgagcgccagcagcggcgccaccagcaagagcagcagcatgaaccccaccgagaccaaggccatccccgtgagccagcagatggagggcccccacctgcccaacaagaagaagcacaagaagcaggccgtgaagaccgagcccgagaagaagagccagagcaccaagctgagcgtggtgcacgagaagaagagccaggagggcaagcccaaggagcacaccgagcccaagagcctgcccaagcaggccagcgacaccggcagcaacgacgcccacaacaagaaggccgtgagcagaagcgccgagcagcagcccagcgagaagagcaccgagcccaagaccaagccccaggacatgatcagcgccggcggcgagagcgtggccggcatcaccgccatcagcggcaagcccggcgacaagaagaaggagaagaagagcctgacccccgccgtgcccgtggagagcaagcccgacaagcccagcggcaagagcggcatggacgccgccctggacgacctgatcgacaccctgggcggccccgaggagaccgaggaggagaacaccacctacaccggccccgaggtgagcgaccccatgagcagcacctacatcgaggagctgggcaagagagaggtgaccatcccccccaagtacagagagctgctggccaagaaggagggcatcaccggcccccccgccgacagcagcaagcccatcggccccgacgacgccatcgacgccctgagcagcgacttcacctgcggcagccccaccgccgccggcaagaagaccgagaaggaggagagcaccgaggtgctgaaggcccagagcgccggcaccgtgagaagcgccgcccccccccaggagaagaagagaaaggtggagaaggacaccatgagcgaccaggccctggaggccctgagcgccagcctgggcaccagacaggccgagcccgagctggacctgagaagcatcaaggaggtggacgaggccaaggccaaggaggagaagctggagaagtgcggcgaggacgacgagaccatccccagcgagtacagactgaagcccgccaccgacaaggacggcaagcccctgctgcccgagcccgaggagaagcccaagcccagaagcgagagcgagctgatcgacgagctgagcgaggacttcgacagaagcgagtgcaaggagaagcccagcaagcccaccgagaagaccgaggagagcaaggccgccgcccccgcccccgtgagcgaggccgtgtgcagaaccagcatgtgcagcatccagagcgccccccccgagcccgccaccctgaagggcaccgtgcccgacgacgccgtggaggccctggccgacagcctgggcaagaaggaggccgaccccgaggacggcaagcccgtgatggacaaggtgaaggagaaggccaaggaggaggacagagagaagctgggcgagaaggaggagaccatcccccccgactacagactggaggaggtgaaggacaaggacggcaagcccctgctgcccaaggagagcaaggagcagctgccccccatgagcgaggacttcctgctggacgccctgagcgaggacttcagcggcccccagaacgccagcagcctgaagttcgaggacgccaagctggccgccgccatcagcgaggtggtgagccagacccccgccagcaccacccaggccggcgccccccccagagacaccagccagagcgacaaggacctggacgacgccctggacaagctgagcgacagcctgggccagagacagcccgaccccgacgagaacaagcccatggaggacaaggtgaaggagaaggccaaggccgagcacagagacaagctgggcgagagagacgacaccatcccccccgagtacagacacctgctggacgacaacggccaggacaagcccgtgaagccccccaccaagaagagcgaggacagcaagaagcccgccgacgaccaggaccccatcgacgccctgagcggcgacctggacagctgccccagcaccaccgagaccagccagaacaccgccaaggacaagtgcaagaaggccgccagcagcagcaaggcccccaagaacggcggcaaggccaaggacagcgccaagaccaccgaggagaccagcaagcccaaggacgactag

SEQ ID NO: 75215 - DNA, 2265 bp, Artificial Sequence
  Description of Artificial Sequence: Synthetic coding sequence
atggccttcgccagctggtggtacaagacccacgtgagcgagaagaccagcgagagccccagcaagcccggcgagaagaagggcagcgacgagaagaaggccgccagcctgggcagcagccagagcagcagaacctacgccggcggcaccgccagcgccaccaaggtgagcgccagcagcggcgccaccagcaagagcagcagcatgaaccccaccgagaccaaggccgtgaagaccgagcccgagaagaagagccagagcaccaagctgagcgtggtgcacgagaagaagagccaggagggcaagcccaaggagcacaccgagcccaagagcctgcccaagcaggccagcgacaccggcagcaacgacgcccacaacaagaaggccgtgagcagaagcgccgagcagcagcccagcgagaagagcaccgagcccaagaccaagccccaggacatgatcagcgccggcggcgagagcgtggccggcatcaccgccatcagcggcaagcccggcgacaagaagaaggagaagaagagcctgacccccgccgtgcccgtggagagcaagcccgacaagcccagcggcaagagcggcatggacgccgccctggacgacctgatcgacaccctgggcggccccgaggagaccgaggaggagaacaccacctacaccggccccgaggtgagcgaccccatgagcagcacctacatcgaggagctgggcaagagagaggtgaccatcccccccaagtacagagagctgctggccaagaaggagggcatcaccggcccccccgccgacagcagcaagcccatcggccccgacgacgccatcgacgccctgagcagcgacttcacctgcggcagccccaccgccgccggcaagaagaccgagaaggaggagagcaccgaggtgctgaaggcccagagcgccggcaccgtgagaagcgccgcccccccccaggagaagaagagaaaggtggagaaggacaccatgagcgaccaggccctggaggccctgagcgccagcctgggcaccagacaggccgagcccgagctggacctgagaagcatcaaggaggtggacgaggccaaggccaaggaggagaagctggagaagtgcggcgaggacgacgagaccatccccagcgagtacagactgaagcccgccaccgacaaggacggcaagcccctgctgcccgagcccgaggagaagcccaagcccagaagcgagagcgagctgatcgacgagctgagcgaggacttcgacagaagcgagtgcaaggagaagcccagcaagcccaccgagaagaccgaggagagcaaggccgccgcccccgcccccgtgagcgaggccgtgtgcagaaccagcatgtgcagcatccagagcgccccccccgagcccgccaccctgaagggcaccgtgcccgacgacgccgtggaggccctggccgacagcctgggcaagaaggaggccgaccccgaggacggcaagcccgtgatggacaaggtgaaggagaaggccaaggaggaggacagagagaagctgggcgagaaggaggagaccatcccccccgactacagactggaggaggtgaaggacaaggacggcaagcccctgctgcccaaggagagcaaggagcagctgccccccatgagcgaggacttcctgctggacgccctgagcgaggacttcagcggcccccagaacgccagcagcctgaagttcgaggacgccaagctggccgccgccatcagcgaggtggtgagccagacccccgccagcaccacccaggccggcgccccccccagagacaccagccagagcgacaaggacctggacgacgccctggacaagctgagcgacagcctgggccagagacagcccgaccccgacgagaacaagcccatggaggacaaggtgaaggagaaggccaaggccgagcacagagacaagctgggcgagagagacgacaccatcccccccgagtacagacacctgctggacgacaacggccaggacaagcccgtgaagccccccaccaagaagagcgaggacagcaagaagcccgccgacgaccaggaccccatcgacgccctgagcggcgacctggacagctgccccagcaccaccgagaccagccagaacaccgccaaggacaagtgcaagaaggccgccagcagcagcaaggcccccaagaacggcggcaaggccaaggacagcgccaagaccaccgaggagaccagcaagcccaaggacgactag

SEQ ID NO: 75216 - DNA, 2376 bp, Artificial Sequence; identical to SEQ ID NO: 75214
  Description of Artificial Sequence: Synthetic coding sequence

SEQ ID NO: 75217 - DNA, 1929 bp, Artificial Sequence
  Description of Artificial Sequence: Synthetic coding sequence
atgaaccccaccgagaccaaggccatccccgtgagccagcagatggagggcccccacctgcccaacaagaagaagcacaagaagcaggccgtgaagaccgagcccgagaagaagagccagagcaccaagctgagcgtggtgcacgagaagaagagccaggagggcaagcccaaggagcacaccgagcccaagagcctgcccaagcaggccagcgacaccggcagcaacgacgcccacaacaagaaggccgtgagcagaagcgccgagcagcagcccagcgagaagagcaccgagcccaagaccaagccccaggacatgatcagcgccggcggcgagagcgtggccggcatcaccgccatcagcggcaagcccggcgacaagaagaaggagaagaagagcctgacccccgccgtgcccgtggagagcaagcccgacaagcccagcggcaagagcggcatggacgccgccctggacgacctgatcgacaccctgggcggccccgaggagaccgaggaggagaacaccacctacaccggccccgaggtgagcgaccccatgagcagcacctacatcgaggagctgggcaagagagaggtgaccatcccccccaagtacagagagctgctggccaagaaggagggcatcaccggcccccccgccgacagcagcaagcccatcggccccgacgacgccatcgacgccctgagcagcgacttcacctgcggcagccccaccgccgccggcaagaagaccgagaaggaggagagcaccgaggtgctgaaggcccagagcgccggcaccgtgagaagcgccgcccccccccaggagaagaagagaaaggtggagaaggacaccatgagcgaccaggccctggaggccctgagcgccagcctgggcaccagacaggccgagcccgagctggacctgagaagcatcaaggaggtggacgaggccaaggccaaggaggagaagctggagaagtgcggcgaggacgacgagaccatccccagcgagtacagactgaagcccgccaccgacaaggacggcaagcccctgctgcccgagcccgaggagaagcccaagcccagaagcgagagcgagctgatcgacgagctgagcgaggacttcgacagaagcgagtgcaaggagaagcccagcaagcccaccgagaagaccgaggagagcaaggccgccgcccccgcccccgtgagcgaggccgtgtgcagaaccagcatgtgcagcatccagagcgccccccccgagcccgccaccctgaagggcaccgtgcccgacgacgccgtggaggccctggccgacagcctgggcaagaaggaggccgaccccgaggacggcaagcccgtgatggacaaggtgaaggagaaggccaaggaggaggacagagagaagctgggcgagaaggaggagaccatcccccccgactacagactggaggaggtgaaggacaaggacggcaagcccctgctgcccaaggagagcaaggagcagctgccccccatgagcgaggacttcctgctggacgccctgagcgaggacttcagcggcccccagaacgccagcagcctgaagttcgaggacgccaagctggccgccgccatcagcgaggtggtgagccagacccccgccagcaccacccaggccggcgccccccccagagacaccagccagagcgacaaggacctggacgacgccctggacaagctgagcgacagcctgggccagagacagcccgaccccgacgagaacaagcccatggaggacaaggtgaaggagaaggccaaggccgagcacagagacaagctgggcgagagagacgacaccatcccccccgagtacagacacctgctggacgacaacggccaggacaagcccgtgaagccccccaccaagaagagcgaggacagcaagtag

SEQ ID NO: 75218 - DNA, 2085 bp, Artificial Sequence
  Description of Artificial Sequence: Synthetic coding sequence
atggagggcccccacctgcccaacaagaagaagcacaagaagcaggccgtgaagaccgagcccgagaagaagagccagagcaccaagctgagcgtggtgcacgagaagaagagccaggagggcaagcccaaggagcacaccgagcccaagagcctgcccaagcaggccagcgacaccggcagcaacgacgcccacaacaagaaggccgtgagcagaagcgccgagcagcagcccagcgagaagagcaccgagcccaagaccaagccccaggacatgatcagcgccggcggcgagagcgtggccggcatcaccgccatcagcggcaagcccggcgacaagaagaaggagaagaagagcctgacccccgccgtgcccgtggagagcaagcccgacaagcccagcggcaagagcggcatggacgccgccctggacgacctgatcgacaccctgggcggccccgaggagaccgaggaggagaacaccacctacaccggccccgaggtgagcgaccccatgagcagcacctacatcgaggagctgggcaagagagaggtgaccatcccccccaagtacagagagctgctggccaagaaggagggcatcaccggcccccccgccgacagcagcaagcccatcggccccgacgacgccatcgacgccctgagcagcgacttcacctgcggcagccccaccgccgccggcaagaagaccgagaaggaggagagcaccgaggtgctgaaggcccagagcgccggcaccgtgagaagcgccgcccccccccaggagaagaagagaaaggtggagaaggacaccatgagcgaccaggccctggaggccctgagcgccagcctgggcaccagacaggccgagcccgagctggacctgagaagcatcaaggaggtggacgaggccaaggccaaggaggagaagctggagaagtgcggcgaggacgacgagaccatccccagcgagtacagactgaagcccgccaccgacaaggacggcaagcccctgctgcccgagcccgaggagaagcccaagcccagaagcgagagcgagctgatcgacgagctgagcgaggacttcgacagaagcgagtgcaaggagaagcccagcaagcccaccgagaagaccgaggagagcaaggccgccgcccccgcccccgtgagcgaggccgtgtgcagaaccagcatgtgcagcatccagagcgccccccccgagcccgccaccctgaagggcaccgtgcccgacgacgccgtggaggccctggccgacagcctgggcaagaaggaggccgaccccgaggacggcaagcccgtgatggacaaggtgaaggagaaggccaaggaggaggacagagagaagctgggcgagaaggaggagaccatcccccccgactacagactggaggaggtgaaggacaaggacggcaagcccctgctgcccaaggagagcaaggagcagctgccccccatgagcgaggacttcctgctggacgccctgagcgaggacttcagcggcccccagaacgccagcagcctgaagttcgaggacgccaagctggccgccgccatcagcgaggtggtgagccagacccccgccagcaccacccaggccggcgccccccccagagacaccagccagagcgacaaggacctggacgacgccctggacaagctgagcgacagcctgggccagagacagcccgaccccgacgagaacaagcccatggaggacaaggtgaaggagaaggccaaggccgagcacagagacaagctgggcgagagagacgacaccatcccccccgagtacagacacctgctggacgacaacggccaggacaagcccgtgaagccccccaccaagaagagcgaggacagcaagaagcccgccgacgaccaggaccccatcgacgccctgagcggcgacctggacagctgccccagcaccaccgagaccagccagaacaccgccaaggacaagtgcaagaaggccgccagcagcagcaaggcccccaagaacggcggcaaggccaaggacagcgccaagaccaccgaggagaccagcaagcccaaggacgactag

SEQ ID NO: 75219 - DNA, 2253 bp, Artificial Sequence
  Description of Artificial Sequence: Synthetic coding sequence
atgagccagcccggccagaagcccgccgccagccccagacccagaagagccgccgccgccagaagaacccacgagcacgtgagcgagaagaccagcgagagccccagcaagcccggcgagaagaagggcagcgacgagaagaaggccgccagcctgggcagcagccagagcagcagaacctacgccggcggcaccgccagcgccaccaaggtgagcgccagcagcggcgccaccagcaagagcagcagcatgaaccccaccgagaccaaggccgtgaagaccgagcccgagaagaagagccagagcaccaagcccaagagcctgcccaagcaggccagcgacaccggcagcaacgacgcccacaacaagaaggccgtgagcagaagcgccgagcagcagcccagcgagaagagcaccgagcccaagaccaagccccaggacatgatcagcgccggcggcgagagcgtggccggcatcaccgccatcagcggcaagcccggcgacaagaagaaggagaagaagagcctgacccccgccgtgcccgtggagagcaagcccgacaagcccagcggcaagagcggcatggacgccgccctggacgacctgatcgacaccctgggcggccccgaggagaccgaggaggagaacaccacctacaccggccccgaggtgagcgaccccatgagcagcacctacatcgaggagctgggcaagagagaggtgaccatcccccccaagtacagagagctgctggccaagaaggagggcatcaccggcccccccgccgacagcagcaagcccatcggccccgacgacgccatcgacgccctgagcagcgacttcacctgcggcagccccaccgccgccggcaagaagaccgagaaggaggagagcaccgaggtgctgaaggcccagagcgccggcaccgtgagaagcgccgcccccccccaggagaagaagagaaaggtggagaaggacaccatgagcgaccaggccctggaggccctgagcgccagcctgggcaccagacaggccgagcccgagctggacctgagaagcatcaaggaggtggacgaggccaaggccaaggaggagaagctggagaagtgcggcgaggacgacgagaccatccccagcgagtacagactgaagcccgccaccgacaaggacggcaagcccctgctgcccgagcccgaggagaagcccaagcccagaagcgagagcgagctgatcgacgagctgagcgaggacttcgacagaagcgagtgcaaggagaagcccagcaagcccaccgagaagaccgaggagagcaaggccgccgcccccgcccccgtgagcgaggccgtgtgcagaaccagcatgtgcagcatccagagcgccccccccgagcccgccaccctgaagggcaccgtgcccgacgacgccgtggaggccctggccgacagcctgggcaagaaggaggccgaccccgaggacggcaagcccgtgatggacaaggtgaaggagaaggccaaggaggaggacagagagaagctgggcgagaaggaggagaccatcccccccgactacagactggaggaggtgaaggacaaggacggcaagcccctgctgcccaaggagagcaaggagcagctgccccccatgagcgaggacttcctgctggacgccctgagcgaggacttcagcggcccccagaacgccagcagcctgaagttcgaggacgccaagctggccgccgccatcagcgaggtggtgagccagacccccgccagcaccacccaggccggcgccccccccagagacaccagccagagcgacaaggacctggacgacgccctggacaagctgagcgacagcctgggccagagacagcccgaccccgacgagaacaagcccatggaggacaaggtgaaggagaaggccaaggccgagcacagagacaagctgggcgagagagacgacaccatcccccccgagtacagacacctgctggacgacaacggccaggacaagcccgtgaagccccccaccaagaagagcgaggacagcaagaagcccgccgacgaccaggaccccatcgacgccctgagcggcgacctggacagctgccccagcaccaccgagaccagccagaacaccgccaaggacaagtgcaagaaggccgccagcagcagcaaggcccccaagaacggcggcaaggccaaggacagcgccaagaccaccgaggagaccagcaagcccaaggacgactag

SEQ ID NO: 75220 - DNA, 1254 bp, Artificial Sequence
  Description of Artificial Sequence: Synthetic coding sequence
atgctgctgagcgtgcccctgctgctgggcctgctgggcctggccgtggccgagcccgccgtgtacttcaaggagcagttcctggacggcgacggctggaccagcagatggatcgagagcaagcacaagagcgacttcggcaagttcgtgctgagcagcggcaagttctacggcgacgaggagaaggacaagggcctgcagaccagccaggacgccagattctacgccctgagcgccagcttcgagcccttcagcaacaagggccagaccctggtggtgcagttcaccgtgaagcacgagcagaacatcgactgcggcggcggctacgtgaagctgttccccaacagcctggaccagaccgacatgcacggcgacagcgagtacaacatcatgttcggccccgacatctgcggccccggcaccaagaaggtgcacgtgatcttcaactacaagggcaagaacgtgctgatcaacaaggacatcagatgcaaggacgacgagttcacccacctgtacaccctgatcgtgagacccgacaacacctacgaggtgaagatcgacaacagccaggtggagagcggcagcctggaggacgactgggacttcctgccccccaagaagatcaaggaccccgacgccagcaagcccgaggactgggacgagagagccaagatcgacgaccccaccgacagcaagcccgaggactgggacaagcccgagcacatccccgaccccgacgccaagaagcccgaggactgggacgaggagatggacggcgagtgggagccccccgtgatccagaaccccgagtacaagggcgagtggaagcccagacagatcgacaaccccgactacaagggcacctggatccaccccgagatcgacaaccccgagtacagccccgaccccagcatctacgcctacgacaacttcggcgtgctgggcctggacctgtggcaggtgaagagcggcaccatcttcgacaacttcctgatcaccaacgacgaggcctacgccgaggagttcggcaacgagacctggggcgtgaccaaggccgccgagaagcagatgaaggacaagcaggacgaggagcagagactgaaggaggaggaggaggacaagaagagaaaggaggaggaggaggccgaggacaaggaggacgacgaggacaaggacgaggacgaggaggacgaggaggacaaggaggaggacgaggaggaggacgtgcccggccaggccaaggacgagctgtag

SEQ ID NO: 75221 - DNA, 891 bp, Artificial Sequence
  Description of Artificial Sequence: Synthetic coding sequence
atgcacggcgacagcgagtacaacatcatgttcggccccgacatctgcggccccggcaccaagaaggtgcacgtgatcttcaactacaagggcaagaacgtgctgatcaacaaggacatcagatgcaaggacgacgagttcacccacctgtacaccctgatcgtgagacccgacaacacctacgaggtgaagatcgacaacagccaggtggagagcggcagcctggaggacgactgggacttcctgccccccaagaagatcaaggaccccgacgccagcaagcccgaggactgggacgagagagccaagatcgacgaccccaccgacagcaagcccgaggactgggacaagcccgagcacatccccgaccccgacgccaagaagcccgaggactgggacgaggagatggacggcgagtgggagccccccgtgatccagaaccccgagtacaagggcgagtggaagcccagacagatcgacaaccccgactacaagggcacctggatccaccccgagatcgacaaccccgagtacagccccgaccccagcatctacgcctacgacaacttcggcgtgctgggcctggacctgtggcaggtgaagagcggcaccatcttcgacaacttcctgatcaccaacgacgaggcctacgccgaggagttcggcaacgagacctggggcgtgaccaaggccgccgagaagcagatgaaggacaagcaggacgaggagcagagactgaaggaggaggaggaggacaagaagagaaaggaggaggaggaggccgaggacaaggaggacgacgaggacaaggacgaggacgaggaggacgaggaggacaaggaggaggacgaggaggaggacgtgcccggccaggccaaggacgagctgtag

SEQ ID NO: 75222 - DNA, 1155 bp, Artificial Sequence
  Description of Artificial Sequence: Synthetic coding sequence
atggccagagccctggtgcagctgtgggccatctgcatgctgagagtggccctggccaccgtgtacttccaggaggagttcctggacggcgagcactggagaaacagatggctgcagagcaccaacgacagcagattcggccacttcagactgagcagcggcaagttctacggccacaaggagaaggacaagggcctgcagaccacccagaacggcagattctacgccatcagcgccagattcaagcccttcagcaacaagggcaagaccctggtgatccagtacaccgtgaagcacgagcagaagatggactgcggcggcggctacatcaaggtgttccccgccgacatcgaccagaagaacctgaacggcaagagccagtactacatcatgttcggccccgacatctgcggcttcgacatcaagaaggtgcacgtgatcctgcacttcaagaacaagtaccacgagaacaagaagctgatcagatgcaaggtggacggcttcacccacctgtacaccctgatcctgagacccgacctgagctacgacgtgaagatcgacggccagagcatcgagagcggcagcatcgagtacgactggaacctgaccagcctgaagaaggagaccagccccgccgagagcaaggactgggagcagaccaaggacaacaaggcccaggactgggagaagcacttcctggacgccagcaccagcaagcagagcgactggaacggcgacctggacggcgactggcccgcccccatgctgcagaagcccccctaccaggacggcctgaagcccgagggcatccacaaggacgtgtggctgcacagaaagatgaagaacaccgactacctgacccagtacgacctgagcgagttcgagaacatcggcgccatcggcctggagctgtggcaggtgagaagcggcaccatcttcgacaacttcctgatcaccgacgacgaggagtacgccgacaacttcggcaaggccacctggggcgagaccaagggccccgagagagagatggacgccatccaggccaaggaggagatgaagaaggccagagaggaggaggaggaggagctgctgagcggcaagatcaacagacacgagcactacttcaaccagttccacagaagaaacgagctgtag

SEQ ID NO: 75223 - DNA, 1191 bp, Artificial Sequence
  Description of Artificial Sequence: Synthetic coding sequence
atgagcgccaccgacagaatgggccccagagccgtgcccggcctgagactggccctgctgctgctgctggtgctgggcacccccaagagcggcgtgcagggccaggagggcctggacttccccgagtacgacggcgtggacagagtgatcaacgtgaacgccaagaactacaagaacgtgttcaagaagtacgaggtgctggccctgctgtaccacgagccccccgaggacgacaaggccagccagagacagttcgagatggaggagctgatcctggagctggccgcccaggtgctggaggacaagggcgtgggcttcggcctggtggacagcgagaaggacgccgccgtggccaagaagctgggcctgaccgaggtggacagcatgtacgtgttcaagggcgacgaggtgatcgagtacgacggcgagttcagcgccgacaccatcgtggagttcctgctggacgtgctggaggaccccgtggagctgatcgagggcgagagagagctgcaggccttcgagaacatcgaggacgagatcaagctgatcggctacttcaagagcaaggacagcgagcactacaaggccttcgaggacgccgccgaggagttccacccctacatccccttcttcgccaccttcgacagcaaggtggccaagaagctgaccctgaagctgaacgagatcgacttctacgaggccttcatggaggagcccgtgaccatccccgacaagcccaacagcgaggaggagatcgtgaacttcgtggaggagcacagaagaagcaccctgagaaagctgaagcccgagagcatgtacgagacctgggaggacgacatggacggcatccacatcgtggccttcgccgaggaggccgaccccgacggcttcgagttcctggagaccctgaaggccgtggcccaggacaacaccgagaaccccgacctgagcatcatctggatcgaccccgacgacttccccctgctggtgccctactgggagaagaccttcgacatcgacctgagcgccccccagatcggcgtggtgaacgtgaccgacgccgacagcgtgtggatggagatggacgacgaggaggacctgcccagcgccgaggagctggaggactggctggaggacgtgctggagggcgagatcaacaccgaggacgacgacgacgacgacgacgactag

SEQ ID NO: 75224 - DNA, 1173 bp, Artificial Sequence
  Description of Artificial Sequence: Synthetic coding sequence
atgggccccagagccgtgcccggcctgagactggccctgctgctgctgctggtgctgggcacccccaagagcggcgtgcagggccaggagggcctggacttccccgagtacgacggcgtggacagagtgatcaacgtgaacgccaagaactacaagaacgtgttcaagaagtacgaggtgctggccctgctgtaccacgagccccccgaggacgacaaggccagccagagacagttcgagatggaggagctgatcctggagctggccgcccaggtgctggaggacaagggcgtgggcttcggcctggtggacagcgagaaggacgccgccgtggccaagaagctgggcctgaccgaggtggacagcatgtacgtgttcaagggcgacgaggtgatcgagtacgacggcgagttcagcgccgacaccatcgtggagttcctgctggacgtgctggaggaccccgtggagctgatcgagggcgagagagagctgcaggccttcgagaacatcgaggacgagatcaagctgatcggctacttcaagagcaaggacagcgagcactacaaggccttcgaggacgccgccgaggagttccacccctacatccccttcttcgccaccttcgacagcaaggtggccaagaagctgaccctgaagctgaacgagatcgacttctacgaggccttcatggaggagcccgtgaccatccccgacaagcccaacagcgaggaggagatcgtgaacttcgtggaggagcacagaagaagcaccctgagaaagctgaagcccgagagcatgtacgagacctgggaggacgacatggacggcatccacatcgtggccttcgccgaggaggccgaccccgacggcttcgagttcctggagaccctgaaggccgtggcccaggacaacaccgagaaccccgacctgagcatcatctggatcgaccccgacgacttccccctgctggtgccctactgggagaagaccttcgacatcgacctgagcgccccccagatcggcgtggtgaacgtgaccgacgccgacagcgtgtggatggagatggacgacgaggaggacctgcccagcgccgaggagctggaggactggctggaggacgtgctggagggcgagatcaacaccgaggacgacgacgacgacgacgacgactag

SEQ ID NO: 75225 - DNA, 936 bp, Artificial Sequence
  Description of Artificial Sequence: Synthetic coding sequence
atgagcatgcagagaaccaccagaatgtgcagcagaagcatgagatgctggcacagcagcaccatgaacccccccagaatgaccagaccccacaaggacaacagcctgggcctgaccgaggtggacagcatgtacgtgttcaagggcgacgaggtgatcgagtacgacggcgagttcagcgccgacaccatcgtggagttcctgctggacgtgctggaggaccccgtggagctgatcgagggcgagagagagctgcaggccttcgagaacatcgaggacgagatcaagctgatcggctacttcaagagcaaggacagcgagcactacaaggccttcgaggacgccgccgaggagttccacccctacatccccttcttcgccaccttcgacagcaaggtggccaagaagctgaccctgaagctgaacgagatcgacttctacgaggccttcatggaggagcccgtgaccatccccgacaagcccaacagcgaggaggagatcgtgaacttcgtggaggagcacagaagaagcaccctgagaaagctgaagcccgagagcatgtacgagacctgggaggacgacatggacggcatccacatcgtggccttcgccgaggaggccgaccccgacggcttcgagttcctggagaccctgaaggccgtggcccaggacaacaccgagaaccccgacctgagcatcatctggatcgaccccgacgacttccccctgctggtgccctactgggagaagaccttcgacatcgacctgagcgccccccagatcggcgtggtgaacgtgaccgacgccgacagcgtgtggatggagatggacgacgaggaggacctgcccagcgccgaggagctggaggactggctggaggacgtgctggagggcgagatcaacaccgaggacgacgacgacgacgacgacgactag

SEQ ID NO: 75226 - DNA, 1200 bp, Artificial Sequence
  Description of Artificial Sequence: Synthetic coding sequence
atgaagagaacccacctgttcatcgtgggcatctacttcctgagcagctgcagagccgaggagggcctgaacttccccacctacgacggcaaggacagagtggtgagcctgagcgagaagaacttcaagcaggtgctgaagaagtacgacctgctgtgcctgtactaccacgagcccgtgagcagcgacaaggtgacccagaagcagttccagctgaaggagatcgtgctggagctggtggcccaggtgctggagcacaaggccatcggcttcgtgatggtggacgccaagaaggaggccaagctggccaagaagctgggcttcgacgaggagggcagcctgtacatcctgaagggcgacagaaccatcgagttcgacggcgagttcgccgccgacgtgctggtggagttcctgctggacctgatcgaggaccccgtggagatcatcagcagcaagctggaggtgcaggccttcgagagaatcgaggactacatcaagctgatcggcttcttcaagagcgaggacagcgagtactacaaggccttcgaggaggccgccgagcacttccagccctacatcaagttcttcgccaccttcgacaagggcgtggccaagaagctgagcctgaagatgaacgaggtggacttctacgagcccttcatggacgagcccatcgccatccccaacaagccctacaccgaggaggagctggtggagttcgtgaaggagcaccagagacccaccctgagaagactgagacccgaggagatgttcgagacctgggaggacgacctgaacggcatccacatcgtggccttcgccgagaagagcgaccccgacggctacgagttcctggagatcctgaagcaggtggccagagacaacaccgacaaccccgacctgagcatcctgtggatcgaccccgacgacttccccctgctggtggcctactgggagaagaccttcaagatcgacctgttcagaccccagatcggcgtggtgaacgtgaccgacgccgacagcgtgtggatggagatccccgacgacgacgacctgcccaccgccgaggagctggaggactggatcgaggacgtgctgagcggcaagatcaacaccgaggacgacgacgaggacgacgacgacgacgacaacagcgacgaggaggacaacgacgacagcgacgacgacgacgacgagtag

SEQ ID NO: 75227 - DNA, 1062 bp, Artificial Sequence
  Description of Artificial Sequence: Synthetic coding sequence
atgaagagaacccacctgttcatcgtgggcatctacttcctgagcagctgcagagccgaggagggcctgaacttccccacctacgacggcaaggacagagtggtgagcctgagcgagaagaacttcaagcaggtgctgaagaagtacgacctgctgtgcctgtactaccacgagcccgtgagcagcgacaaggtgacccagaagcagttccagctgaaggagatcgtgctggagctggtggcccaggtgctggagcacaaggccatcggcttcgtgatggtggacgccaagaaggaggccaagctggccaagaagctgggcttcgacgaggagggcagcctgtacatcctgaagggcgacagaaccatcgagttcgacggcgagttcgccgccgacgtgctggtggagttcctgctggacctgatcgaggaccccgtggagatcatcagcagcaagctggaggtgcaggccttcgagagaatcgaggactacatcaagctgatcggcttcttcaagagcgaggacagcgagtactacaaggccttcgaggaggccgccgagcacttccagccctacatcaagttcttcgccaccttcgacaagggcgtggccaagaagctgagcctgaagatgaacgaggtggacttctacgagcccttcatggacgagcccatcgccatccccaacaagccctacaccgacggctacgagttcctggagatcctgaagcaggtggccagagacaacaccgacaaccccgacctgagcatcctgtggatcgaccccgacgacttccccctgctggtggcctactgggagaagaccttcaagatcgacctgttcagaccccagatcggcgtggtgaacgtgaccgacgccgacagcgtgtggatggagatccccgacgacgacgacctgcccaccgccgaggagctggaggactggatcgaggacgtgctgagcggcaagatcaacaccgaggacgacgacgaggacgacgacgacgacgacaacagcgacgaggaggacaacgacgacagcgacgacgacgacgacgagtag

SEQ ID NO: 75228 - DNA, 987 bp, Artificial Sequence
  Description of Artificial Sequence: Synthetic coding sequence
atgaagagaacccacctgttcatcgtgggcatctacttcctgagcagctgcagagccgaggagggcctgaacttccccacctacgacggcaaggacagagtggtgagcctgagcgagaagaacttcaagcaggtgctgaagaagtacgacctgctgtgcctgtactaccacgagcccgtgagcagcgacaaggtgacccagaagcagttccagctgaaggagatcgtgctggagctggtggcccaggtgctggagcacaaggccatcggcttcgtgatggtggacgccaagaaggaggccaagctggccaagaagctggactacaaggccttcgaggaggccgccgagcacttccagccctacatcaagttcttcgccaccttcgacaagggcgtggccaagaagctgagcctgaagatgaacgaggtggacttctacgagcccttcatggacgagcccatcgccatccccaacaagccctacaccgaggaggagctggtggagttcgtgaaggagcaccagagacccaccctgagaagactgagacccgaggagatgttcgagacctgggaggacgacctgaacggcatccacatcgtggccttcgccgagaagagcgaccccgacggctacgagttcctggagatcctgaagcaggtggccagagacaacaccgacaaccccgacctgagcatcctgtggatcgaccccgacgacttccccctgctggtggcctactgggagaagaccttcaagatcgacctgttcagaccccagatcggcgtggtgaacgtgaccgacgccgacagcgtgtggatggagatccccgacgacgacgacctgcccaccgccgaggagctggaggactggatcgaggacgtgctgagcggcaagatcaacaccgaggacgacgacgaggacgacgacgacgacgacaacagcgacgaggaggacaacgacgacagcgacgacgacgacgacgagtag

SEQ ID NO: 75229 - DNA, 948 bp, Artificial Sequence
  Description of Artificial Sequence: Synthetic coding sequence
atggacctgagacagttcctgatgtgcctgagcctgtgcaccgccttcgccctgagcaagcccaccgagaagaaggacagagtgcaccacgagccccagctgagcgacaaggtgcacaacgacgcccagagcttcgactacgaccacgacgccttcctgggcgccgaggaggccaagaccttcgaccagctgacccccgaggagagcaaggagagactgggcaagatcgtgagcaagatcgacggcgacaaggacggcttcgtgaccgtggacgagctgaaggactggatcaagttcgcccagaagagatggatctacgaggacgtggagagacagtggaagggccacgacctgaacgaggacggcctggtgagctgggaggagtacaagaacgccacctacggctacgtgctggacgaccccgaccccgacgacggcttcaactacaagcagatgatggtgagagacgagagaagattcaagatggccgacaaggacggcgacctgatcgccaccaaggaggagttcaccgccttcctgcaccccgaggagtacgactacatgaaggacatcgtggtgcaggagaccatggaggacatcgacaagaacgccgacggcttcatcgacctggaggagtacatcggcgacatgtacagccacgacggcaacaccgacgagcccgagtgggtgaagaccgagagagagcagttcgtggagttcagagacaagaacagagacggcaagatggacaaggaggagaccaaggactggatcctgcccagcgactacgaccacgccgaggccgaggccagacacctggtgtacgagagcgaccagaacaaggacggcaagctgaccaaggaggagatcgtggacaagtacgacctgttcgtgggcagccaggccaccgacttcggcgaggccctggtgagacacgacgagttctag

SEQ ID NO: 75230 - DNA, 465 bp, Artificial Sequence
  Description of Artificial Sequence: Synthetic coding sequence
atggacctgagacagttcctgatgtgcctgagcctgtgcaccgccttcgccctgagcaagcccaccgagaagaaggacagagtgcaccacgagccccagctgagcgacaaggtgcacaacgacgcccagagcttcgactacgaccacgacgccttcctgggcgccgaggaggccaagaccttcgaccagctgacccccgaggagagcaaggagagactgggcaagatcgtgagcaagatcgacggcgacaaggacggcttcgtgaccgtggacgagctgaaggactggatcctgcccagcgactacgaccacgccgaggccgaggccagacacctggtgtacgagagcgaccagaacaaggacggcaagctgaccaaggaggagatcgtggacaagtacgacctgttcgtgggcagccaggccaccgacttcggcgaggccctggtgagacacgacgagttctag

SEQ ID NO: 75231 - DNA, 948 bp, Artificial Sequence
  Description of Artificial Sequence: Synthetic coding sequence
atggacctgagacagttcctgatgtgcctgagcctgtgcaccgccttcgccctgagcaagcccaccgagaagaaggacagagtgcaccacgagccccagctgagcgacaaggtgcacaacgacgcccagagcttcgactacgaccacgacgccttcctgggcgccgaggaggccaagaccttcgaccagctgacccccgaggagagcaaggagagactgggcatgatcgtggacaagatcgacgccgacaaggacggcttcgtgaccgagggcgagctgaagagctggatcaagcacgcccagaagaagtacatctacgacaacgtggagaaccagtggcaggagttcgacatgaaccaggacggcctgatcagctgggacgagtacagaaacgtgacctacggcacctacctggacgaccccgaccccgacgacggcttcaactacaagcagatgatggtgagagacgagagaagattcaagatggccgacaaggacggcgacctgatcgccaccaaggaggagttcaccgccttcctgcaccccgaggagtacgactacatgaaggacatcgtggtgcaggagaccatggaggacatcgacaagaacgccgacggcttcatcgacctggaggagtacatcggcgacatgtacagccacgacggcaacaccgacgagcccgagtgggtgaagaccgagagagagcagttcgtggagttcagagacaagaacagagacggcaagatggacaaggaggagaccaaggactggatcctgcccagcgactacgaccacgccgaggccgaggccagacacctggtgtacgagagcgaccagaacaaggacggcaagctgaccaaggaggagatcgtggacaagtacgacctgttcgtgggcagccaggccaccgacttcggcgaggccctggtgagacacgacgagttctag

SEQ ID NO: 75232 - DNA, 972 bp, Artificial Sequence
  Description of Artificial Sequence: Synthetic coding sequence
atgaaggagaccgacctgatcatcatggacctgagacagttcctgatgtgcctgagcctgtgcaccgccttcgccctgagcaagcccaccgagaagaaggacagagtgcaccacgagccccagctgagcgacaaggtgcacaacgacgcccagagcttcgactacgaccacgacgccttcctgggcgccgaggaggccaagaccttcgaccagctgacccccgaggagagcaaggagagactgggcaagatcgtgagcaagatcgacggcgacaaggacggcttcgtgaccgtggacgagctgaaggactggatcaagttcgcccagaagagatggatctacgaggacgtggagagacagtggaagggccacgacctgaacgaggacggcctggtgagctgggaggagtacaagaacgccacctacggctacgtgctggacgaccccgaccccgacgacggcttcaactacaagcagatgatggtgagagacgagagaagattcaagatggccgacaaggacggcgacctgatcgccaccaaggaggagttcaccgccttcctgcaccccgaggagtacgactacatgaaggacatcgtggtgcaggagaccatggaggacatcgacaagaacgccgacggcttcatcgacctggaggagtacatcggcgacatgtacagccacgacggcaacaccgacgagcccgagtgggtgaagaccgagagagagcagttcgtggagttcagagacaagaacagagacggcaagatggacaaggaggagaccaaggactggatcctgcccagcgactacgaccacgccgaggccgaggccagacacctggtgtacgagagcgaccagaacaaggacggcaagctgaccaaggaggagatcgtggacaagtacgacctgttcgtgggcagccaggccaccgacttcggcgaggccctggtgagacacgacgagttctag

SEQ ID NO: 75233 - DNA, 444 bp, Artificial Sequence
  Description of Artificial Sequence: Synthetic coding sequence
tgaatcgccaccaaggaggagttcaccgccttcctgcaccccgaggagtacgactacatgaaggacatcgtggtgcaggagaccatggaggacatcgacaagaacgccgacggcttcatcgacctggaggagtacatcggcgacatgtacagccacgacggcaacaccgacgagcccgagtgggtgaagaccgagagagagcagttcgtggagttcagagacaagaacagagacggcaagatggacaaggaggagaccaaggactggatcctgcccagcgactacgaccacgccgaggccgaggccagacacctggtgtacgagagcgaccagaacaaggacggcaagctgaccaaggaggagatcgtggacaagtacgacctgttcgtgggcagccaggccaccgacttcggcgaggccctggtgagacacgacgagttctag

SEQ ID NO: 75234 - DNA, 675 bp, Artificial Sequence
  Description of Artificial Sequence: Synthetic coding sequence
atggacctgagacagttcctgatgtgcctgagcctgtgcaccgccttcgccctgagcaagcccaccgagaagaaggacagagtgcaccacgagccccagctgagcgacaaggtgcacaacgacgcccagagcttcgactacgaccacgacgccttcctgggcgccgaggaggccaagaccttcgaccagctgacccccgaggagagcaaggagagactgggcaagatcgtgagcaagatcgacggcgacaaggacggcttcgtgaccgtggacgagctgaaggactggatcaagttcgcccagaagagatggatctacgaggacgtggagagacagtggaagggccacgacctgaacgaggacggcctggtgagctgggaggagtacaagaacgccacctacggctacgtgctggacgaccccgaccccgacgacggcttcaactacaagcagatgatggtgagagacgagagaagattcaagatggccgacaaggacggcgacctgatcgccaccaaggaggagttcaccgccttcctgcaccccgaggagtacgactacatgaaggacatcgtggtgcaggagaccatggaggacatcgacaagaacgccgacggcttcatcgacctggaggagtacatcggctggcaggcctaccagggcggcgacagatag

SEQ ID NO: 75235 - DNA, 444 bp, Artificial Sequence
  Description of Artificial Sequence: Synthetic coding sequence
atgaaggagaccgacctgatcatcatggacctgagacagttcctgatgtgcctgagcctgtgcaccgccttcgccctgagcaagcccaccgagaagaaggacagagtgcaccacgagccccagctgagcgacaaggtgcacaacgacgcccagagcttcgactacgaccacgacgccttcctgggcgccgaggaggccaagaccttcgaccagctgacccccgaggagagcaaggagagactgggcaagatcgtgagcaagatcgacggcgacaaggacggcttcgtgaccgtggacgagctgaaggactggatcaagttcgcccagaagagatggatctacgaggacgtggagagacagtggaagggccacgacctgaacgaggacggcctggtgagctgggaggagtacaagaacgccacctacggctacgtgctggagtag

SEQ ID NO: 75236 - DNA, 513 bp, Artificial Sequence
  Description of Artificial Sequence: Synthetic coding sequence
atggacctgagacagttcctgatgtgcctgagcctgtgcaccgccttcgccctgagcaagcccaccgagaagaaggacagagtgcaccacgagccccagctgagcgacaaggtgcacaacgacgcccagagcttcgactacgaccacgacgccttcctgggcgccgaggaggccaagaccttcgaccagctgacccccgaggagagcaaggagagactgggcatgatcgtggacaagatcgacgccgacaaggacggcttcgtgaccgagggcgagctgaagagctggatcaagcacgcccagaagaagtacatctacgacaacgtggagaaccagtggcaggagttcgacatgaaccaggacggcctgatcagctgggacgagtacagaaacgtgacctacggcacctacctggacgaccccgaccccgacgacggcttcaactacaagcagatgatggtgagagacgagagaagattcaagatggccgacagagccagagccgtgtgctag

SEQ ID NO: 75237 - DNA, 606 bp, Artificial Sequence
  Description of Artificial Sequence: Synthetic coding sequence
atggacctgagacagttcctgatgtgcctgagcctgtgcaccgccttcgccctgagcaagcccaccgagaagaaggacagagtgcaccacgagccccagctgagcgacaaggtgcacaacgacgcccagagcttcgactacgaccacgacgccttcctgggcgccgaggaggccaagaccttcgaccagctgacccccgaggagagcaaggagagactgggcatgatcgtggacaagatcgacgccgacaaggacggcttcgtgaccgagggcgagctgaagagctggatcaagcacgcccagaagaagtacatctacgacaacgtggagaaccagtggcaggagttcgacatgaaccaggacggcctgatcagctgggacgagtacagaaacgtgacctacggcacctacctggacgaccccgaccccgacgacggcttcaactacaagcagatgatggtgagagacgagagaagattcaagatggccgacaaggacggcgacctgatcgccaccaaggaggagatcgtggacaagtacgacctgttcgtgggcagccaggccaccgacttcggcgaggccctggtgagacacgacgagttctag

SEQ ID NO: 75238 - DNA, 798 bp, Artificial Sequence
  Description of Artificial Sequence: Synthetic coding sequence
atggacctgagacagttcctgatgtgcctgagcctgtgcaccgccttcgccctgagcaagcccaccgagaagaaggacagagtgcaccacgagccccagctgagcgacaaggtgcacaacgacgcccagagcttcgactacgaccacgacgccttcctgggcgccgaggaggccaagaccttcgaccagctgacccccgaggagagcaaggagagactgggcaagatcgtgagcaagatcgacggcgacaaggacggcttcgtgaccgtggacgagctgaaggactggatcaagttcgcccagaagagatggatctacgaggacgtggagagacagtggaagggccacgacctgaacgaggacggcctggtgagctgggaggagtacaagaacgccacctacggctacgtgctggacgaccccgaccccgacgacggcttcaactacaagcagatgatggtgagagacgagagaagattcaagatggccgacaaggacggcgacctgatcgccaccaaggaggagttcaccgccttcctgcaccccgaggagtacgactacatgaaggacatcgtggtgcaggagaccatggaggacatcgacaagaacgccgacggcttcatcgacctggaggagtacatcggcgacatgtacagccacgacggcaacaccgacgagagcgaccagaacaaggacggcaagctgaccaaggaggagatcgtggacaagtacgacctgttcgtgggcagccaggccaccgacttcggcgaggccctggtgagacacgacgagttctag

SEQ ID NO: 75239 - DNA, 495 bp, Artificial Sequence
  Description of Artificial Sequence: Synthetic coding sequence
atgatggtgagagacgagagaagattcaagatggccgacaaggacggcgacctgatcgccaccaaggaggagttcaccgccttcctgcaccccgaggagtacgactacatgaaggacatcgtggtgcaggagaccatggaggacatcgacaagaacgccgacggcttcatcgacctggaggagtacatcggcgacatgtacagccacgacggcaacaccgacgagcccgagtgggtgaagaccgagagagagcagttcgtggagttcagagacaagaacagagacggcaagatggacaaggaggagaccaaggactggatcctgcccagcgactacgaccacgccgaggccgaggccagacacctggtgtacgagagcgaccagaacaaggacggcaagctgaccaaggaggagatcgtggacaagtacgacctgttcgtgggcagccaggccaccgacttcggcgaggccctggtgagacacgacgagttctag

SEQ ID NO: 75240 - DNA, 972 bp, Artificial Sequence
  Description of Artificial Sequence: Synthetic coding sequence
atgaaggagaccgacctgatcatcatggacctgagacagttcctgatgtgcctgagcctgtgcaccgccttcgccctgagcaagcccaccgagaagaaggacagagtgcaccacgagccccagctgagcgacaaggtgcacaacgacgcccagagcttcgactacgaccacgacgccttcctgggcgccgaggaggccaagaccttcgaccagctgacccccgaggagagcaaggagagactgggcatgatcgtggacaagatcgacgccgacaaggacggcttcgtgaccgagggcgagctgaagagctggatcaagcacgcccagaagaagtacatctacgacaacgtggagaaccagtggcaggagttcgacatgaaccaggacggcctgatcagctgggacgagtacagaaacgtgacctacggcacctacctggacgaccccgaccccgacgacggcttcaactacaagcagatgatggtgagagacgagagaagattcaagatggccgacaaggacggcgacctgatcgccaccaaggaggagttcaccgccttcctgcaccccgaggagtacgactacatgaaggacatcgtggtgcaggagaccatggaggacatcgacaagaacgccgacggcttcatcgacctggaggagtacatcggcgacatgtacagccacgacggcaacaccgacgagcccgagtgggtgaagaccgagagagagcagttcgtggagttcagagacaagaacagagacggcaagatggacaaggaggagaccaaggactggatcctgcccagcgactacgaccacgccgaggccgaggccagacacctggtgtacgagagcgaccagaacaaggacggcaagctgaccaaggaggagatcgtggacaagtacgacctgttcgtgggcagccaggccaccgacttcggcgaggccctggtgagacacgacgagttctag

SEQ ID NO: 75241 - DNA, 1116 bp, Artificial Sequence
  Description of Artificial Sequence: Synthetic coding sequence
atggagctggagctggacgccggcgaccaggacctgctggccttcctgctggaggagagcggcgacctgggcaccgcccccgacgaggccgtgagagcccccctggactgggccctgcccctgagcgaggtgcccagcgactgggaggtggacgacctgctgtgcagcctgctgagcccccccgccagcctgaacatcctgagcagcagcaacccctgcctggtgcaccacgaccacacctacagcctgcccagagagaccgtgagcatggacctggagagcgagagctgcagaaaggagggcacccagatgaccccccagcacatggaggagctggccgagcaggagatcgccagactggtgctgaccgacgaggagaagagcctgctggagaaggagggcctgatcctgcccgagaccctgcccctgaccaagaccgaggagcagatcctgaagagagtgagaagaaagatcagaaacaagagaagcgcccaggagagcagaagaaagaagaaggtgtacgtgggcggcctggagagcagagtgctgaagtacaccgcccagaacatggagctgcagaacaaggtgcagctgctggaggagcagaacctgagcctgctggaccagctgagaaagctgcaggccatggtgatcgagatcagcaacaagaccagcagcagcagcacctgcatcctggtgctgctggtgagcttctgcctgctgctggtgcccgccatgtacagcagcgacaccagaggcagcctgcccgccgagcacggcgtgctgagcagacagctgagagccctgcccagcgaggacccctaccagctggagctgcccgccctgcagagcgaggtgcccaaggacagcacccaccagtggctggacggcagcgactgcgtgctgcaggcccccggcaacaccagctgcctgctgcactacatgccccaggcccccagcgccgagccccccctggagtggcccttccccgacctgttcagcgagcccctgtgcagaggccccatcctgcccctgcaggccaacctgaccagaaagggcggctggctgcccaccggcagccccagcgtgatcctgcaggacagatacagcggctag

SEQ ID NO: 75242 - DNA, 1386 bp, Artificial Sequence
  Description of Artificial Sequence: Synthetic coding sequence
atgaacaccgacctggccgccggcaagatggccagcgccgcctgcagcatggaccccatcgacagcttcgagctgctggacctgctgttcgacagacaggacggcatcctgagacacgtggagctgggcgagggctggggccacgtgaaggaccagcaggtgctgcccaaccccgacagcgacgacttcctgagcagcatcctgggcagcggcgacagcctgcccagcagccccctgtggagccccgagggcagcgacagcggcatcagcgaggacctgcccagcgacccccaggacaccccccccagaagcggccccgccaccagccccgccggctgccaccccgcccagcccggcaagggcccctgcctgagctaccaccccggcaacagctgcagcaccaccacccccggccccgtgatccaggtgcccgaggccagcgtgaccatcgacctggagatgtggagccccggcggcagaatctgcgccgagaagcccgccgaccccgtggacctgagccccagatgcaacctgaccgtgaaggacctgctgctgagcggcagcagcggcgacctgcagcagcaccacctgggcgccagctacctgctgagacccggcgccggccactgccaggagctggtgctgaccgaggacgagaagaagctgctggccaaggagggcatcaccctgcccacccagctgcccctgaccaagtacgaggagagagtgctgaagaagatcagaagaaagatcagaaacaagcagagcgcccaggagagcagaaagaagaagaaggagtacatcgacggcctggagaccagaatgagcgcctgcaccgcccagaaccaggagctgcagagaaaggtgctgcacctggagaagcagaacctgagcctgctggagcagctgaagaagctgcaggccatcgtggtgcagagcaccagcaagagcgcccagaccggcacctgcgtggccgtgctgctgctgagcttcgccctgatcatcctgcccagcatcagccccttcggccccaacaagaccgagagccccggcgacttcgcccccgtgagagtgttcagcagaaccctgcacaacgacgccgccagcagagtggccgccgacgccgtgcccggcagcgaggcccccggccccagacccgaggccgacaccaccagagaggagagccccggcagccccggcgccgactggggcttccaggacaccgccaacctgaccaacagcaccgaggagctggacaacgccaccctggtgctgagaaacgccaccgagggcctgggccaggtggccctgctggactgggtggcccccggccccagcaccggcagcggcagagccggcctggaggccgccggcgacgagctgtag

SEQ ID NO: 75243 - DNA, 900 bp, Artificial Sequence
  Description of Artificial Sequence: Synthetic coding sequence
atggccagcgccgcctgcagcatggaccccatcgacagcttcgagctgctggacctgctgttcgacagacaggacggcatcctgagacacgtggagctgggcgagggctggggccacgtgaaggaccaggtgctgcccaaccccgacagcgacgacttcctgagcagcatcctgggcagcggcgacagcctgcccagcagccccctgtggagccccgagggcagcgacagcggcatcagcgaggacctgcccagcgacccccaggacaccccccccagaagcggccccgccaccagccccgccggctgccaccccgcccagcccggcaagggcccctgcctgagctaccaccccggcaacagctgcagcaccaccacccccggccccgtgatccagcagcagcaccacctgggcgccagctacctgctgagacccggcgccggccactgccaggagctggtgctgaccgaggacgagaagaagctgctggccaaggagggcatcaccctgcccacccagctgcccctgaccaagtacgaggagagagtgctgaagaagatcagaagaaagatcagaaacaagcagagcgcccaggagagcagaaagaagaagaaggagtacatcgacggcctggagaccagaagctgctgctgccccctgcccagcagcagcagcccccccagcgccctgctggcccccaccaagcccagagccctgggcaccctgagactgtacgagtgcagccccgagctgtgcaccaccatgctgccccccgcctggctgctgatgctgtgccaggcccccagaccccaggaccccgaccccagactgacccagcccgagaagagcctgcaggaggcccccggccagaccggcgccagcagaacccccagaacctag

SEQ ID NO: 75244 - DNA, 1260 bp, Artificial Sequence
  Description of Artificial Sequence: Synthetic coding sequence
atgaacaccgacctggccgccggcaagatggccagcgccgcctgcagcatggaccccatcgacagcttcgagctgctggacctgctgttcgacagacaggacggcatcctgagacacgtggagctgggcgagggctggggccacgtgaaggaccagcaggtgctgcccaaccccgacagcgacgacttcctgagcagcatcctgggcagcggcgacagcctgcccagcagccccctgtggagccccgagggcagcgacagcggcatcagcgaggacctgcccagcgacccccaggacaccccccccagaagcggccccgccaccagccccgccggctgccaccccgcccagcccggcaagggcccctgcctgagctaccaccccggcaacagctgcagcaccaccacccccggccccgtgatccaggtgcccgaggccagcgtgaccatcgacctggagatgtggagccccggcggcagaatctgcgccgagaagcccgccgaccccgtggacctgagccccagatgcaacctgaccgtgaaggacctgctgctgagcggcagcagcggcgacctgcagcagcaccacctgggcgccagctacctgctgagacccggcgccggccactgccaggagctggtgctgaccgaggacgagaagaagctgctggccaaggagggcatcaccctgcccacccagctgcccctgaccaagtacgaggagagagtgctgaagaagatcagaagaaagatcagaaacaagcagagcgcccaggagagcagaaagaagaagaaggccatcgtggtgcagagcaccagcaagagcgcccagaccggcacctgcgtggccgtgctgctgctgagcttcgccctgatcatcctgcccagcatcagccccttcggccccaacaagaccgagagccccggcgacttcgcccccgtgagagtgttcagcagaaccctgcacaacgacgccgccagcagagtggccgccgacgccgtgcccggcagcgaggcccccggccccagacccgaggccgacaccaccagagaggagagccccggcagccccggcgccgactggggcttccaggacaccgccaacctgaccaacagcaccgaggagctggacaacgccaccctggtgctgagaaacgccaccgagggcctgggccaggtggccctgctggactgggtggcccccggccccagcaccggcagcggcagagccggcctggaggccgccggcgacgagctgtag

SEQ ID NO: 75245 - DNA, 1188 bp, Artificial Sequence
  Description of Artificial Sequence: Synthetic coding sequence
atggacctgggcatccccgacctgctggacgcctggctggagccccccgaggacatcttcagcaccggcagcgtgctggagctgggcctgcactgccccccccccgaggtgcccgtgaccagactgcaggagcagggcctgcagggctggaagagcggcggcgacagaggctgcggcctgcaggagagcgagcccgaggacttcctgaagctgttcatcgaccccaacgaggtgtactgcagcgaggccagccccggcagcgacagcggcatcagcgaggacccctgccaccccgacagcccccccgcccccagagccaccagcagccccatgctgtacgaggtggtgtacgaggccggcgccctggagagaatgcagggcgagaccggccccaacgtgggcctgatcagcatccagctggaccagtggagccccgccttcatggtgcccgacagctgcatggtgagcgagctgcccttcgacgcccacgcccacatcctgcccagagccggcaccgtggcccccgtgccctgcaccaccctgctgccctgccagaccctgttcctgaccgacgaggagaagagactgctgggccaggagggcgtgagcctgcccagccacctgcccctgaccaaggccgaggagagagtgctgaagaaggtgagaagaaagatcagaaacaagcagagcgcccaggacagcagaagaagaaagaaggagtacatcgacggcctggagagcagagtggccgcctgcagcgcccagaaccaggagctgcagaagaaggtgcaggagctggagagacacaacatcagcctggtggcccagctgagacagctgcagaccctgatcgcccagaccagcaacaaggccgcccagaccagcacctgcgtgctgatcctgctgttcagcctggccctgatcatcctgcccagcttcagccccttccagagcagacccgaggccggcagcgaggactaccagccccacggcgtgaccagcagaaacatcctgacccacaaggacgtgaccgagaacctggagacccaggtggtggagagcagactgagagagccccccggcgccaaggacgccaacggcagcaccagaaccctgctggagaagatgggcggcaagcccagacccagcggcagaatcagaagcgtgctgcacgccgacgagatgtag

SEQ ID NO: 75246 - DNA, 1128 bp, Artificial Sequence
  Description of Artificial Sequence: Synthetic coding sequence
atggacctgggcatccccgacctgctggacgcctggctggagccccccgaggacatcttcagcaccggcagcgtgctggagctgggcctgcactgccccccccccgaggtgcccggcctgcaggagagcgagcccgaggacttcctgaagctgttcatcgaccccaacgaggtgtactgcagcgaggccagccccggcagcgacagcggcatcagcgaggacccctgccaccccgacagcccccccgcccccagagccaccagcagccccatgctgtacgaggtggtgtacgaggccggcgccctggagagaatgcagggcgagaccggccccaacgtgggcctgatcagcatccagctggaccagtggagccccgccttcatggtgcccgacagctgcatggtgagcgagctgcccttcgacgcccacgcccacatcctgcccagagccggcaccgtggcccccgtgccctgcaccaccctgctgccctgccagaccctgttcctgaccgacgaggagaagagactgctgggccaggagggcgtgagcctgcccagccacctgcccctgaccaaggccgaggagagagtgctgaagaaggtgagaagaaagatcagaaacaagcagagcgcccaggacagcagaagaagaaagaaggagtacatcgacggcctggagagcagagtggccgcctgcagcgcccagaaccaggagctgcagaagaaggtgcaggagctggagagacacaacatcagcctggtggcccagctgagacagctgcagaccctgatcgcccagaccagcaacaaggccgcccagaccagcacctgcgtgctgatcctgctgttcagcctggccctgatcatcctgcccagcttcagccccttccagagcagacccgaggccggcagcgaggactaccagccccacggcgtgaccagcagaaacatcctgacccacaaggacgtgaccgagaacctggagacccaggtggtggagagcagactgagagagccccccggcgccaaggacgccaacggcagcaccagaaccctgctggagaagatgggcggcaagcccagacccagcggcagaatcagaagcgtgctgcacgccgacgagatgtag

SEQ ID NO: 75247 - DNA, 654 bp, Artificial Sequence
  Description of Artificial Sequence: Synthetic coding sequence
atggacctgggcatccccgacctgctggacgcctggctggagccccccgaggacatcttcagcaccggcagcgtgctggagctgggcctgcactgccccccccccgaggtgcccgtgaccagactgcaggagcagggcctgcagggctggaagagcggcggcgacagaggctgcggcctgcaggagagcgagcccgaggacttcctgaagctgttcatcgaccccaacgaggtgtactgcagcgaggccagccccggcagcgacagcggcatcagcgaggacccctgccaccccgacagcccccccgcccccagagccaccagcagccccatgctgtacgaggtggtgtacgaggccggcgccctggagagaatgcagggcgagaccggccccaacgtgggcctgatcagcatccagctggaccagtggagccccgccttcatggtgcccgacagctgcatggtgagcgagctgcccttcgacgcccacgcccacatcctgcccagagccggcaccgtggcccccgtgccctgcaccaccctgctgccctgccagaccctgttcctgaccgacgaggagaagagactgctgggccaggagggcgtgagcctgcccagccacctgcccctgaccaaggtgacctgcttcccctag

SEQ ID NO: 75248 - DNA, 1188 bp, Artificial Sequence; identical to SEQ ID NO: 75245
  Description of Artificial Sequence: Synthetic coding sequence

SEQ ID NO: 75249 - DNA, 1188 bp, Artificial Sequence; identical to SEQ ID NO: 75245
  Description of Artificial Sequence: Synthetic coding sequence

SEQ ID NO: 75250 - DNA, 747 bp, Artificial Sequence
  Description of Artificial Sequence: Synthetic coding sequence
atggtgcccgacagctgcatggtgagcgagctgcccttcgacgcccacgcccacatcctgcccagagccggcaccgtggcccccgtgccctgcaccaccctgctgccctgccagaccctgttcctgaccgacgaggagaagagactgctgggccaggagggcgtgagcctgcccagccacctgcccctgaccaaggccgaggagagagtgctgaagaaggtgagaagaaagatcagaaacaagcagagcgcccaggacagcagaagaagaaagaaggagtacatcgacggcctggagagcagagtggccgcctgcagcgcccagaaccaggagctgcagaagaaggtgcaggagctggagagacacaacatcagcctggtggcccagctgagacagctgcagaccctgatcgcccagaccagcaacaaggccgcccagaccagcacctgcgtgctgatcctgctgttcagcctggccctgatcatcctgcccagcttcagccccttccagagcagacccgaggccggcagcgaggactaccagccccacggcgtgaccagcagaaacatcctgacccacaaggacgtgaccgagaacctggagacccaggtggtggagagcagactgagagagccccccggcgccaaggacgccaacggcagcaccagaaccctgctggagaagatgggcggcaagcccagacccagcggcagaatcagaagcgtgctgcacgccgacgagatgtag

SEQ ID NO: 75251 - DNA, 549 bp, Artificial Sequence
  Description of Artificial Sequence: Synthetic coding sequence
atggacctgggcatccccgacctgctggacgcctggctggagccccccgaggacatcttcagcaccggcagcgtgctggagctgggcctgcactgccccccccccgaggtgcccgtgaccagactgcaggagcagggcctgcagggctggaagagcggcggcgacagaggctgcggcctgcaggagagcgagcccgaggacttcctgaagctgttcatcgaccccaacgaggtgtactgcagcgaggccagccccggcagcgacagcggcatcagcgaggacccctgccaccccgacagcccccccgcccccagagccaccagcagccccatgctgtacgaggtggtgtacgaggccggcgccctggagagaatgcagggcgagaccggccccaacgtgggcctgatcagcatccagctggaccagtggagccccgccttcatggtgcccgacagctgcatggtgagcgagctgcccttcgacgcccacgcccacatcctgcccagagccggcaccgtggcccccgtgccctgcaccaccctggtgtag

SEQ ID NO: 75252 - DNA, 687 bp, Artificial Sequence
  Description of Artificial Sequence: Synthetic coding sequence
atggacctgggcatccccgacctgctggacgcctggctggagccccccgaggacatcttcagcaccggcagcgtgctggagctgggcctgcactgccccccccccgaggtgcccggcctgcaggagagcgagcccgaggacttcctgaagctgttcatcgaccccaacgaggtgtactgcagcgaggccagccccggcagcgacagcggcatcagcgaggacccctgccaccccgacagcccccccgcccccagagccaccagcagccccatgctgtacgaggtggtgtacgaggccggcgccctggagagaatgcagggcgagaccggccccaacgtgggcctgatcagcatccagctggaccagtggagccccgccttcatggtgcccgacagctgcatggtgagcgagctgcccttcgacgcccacgcccacatcctgcccagagccggcaccgtggcccccgtgccctgcaccaccctgctgccctgccagaccctgttcctgaccgacgaggagaagagactgctgggccaggagggcgtgagcctgcccagccacctgcccctgaccaaggccgaggagagagtgctgaagaaggtgagaagaaagatcagaaacaagcagagcgcccaggacagcagaagaagaaagaaggagtacatcgacggcctggagagcagatag

SEQ ID NO: 75253 - DNA, 1047 bp, Artificial Sequence
  Description of Artificial Sequence: Synthetic coding sequence
atgagcaagtgcgccagaaagaagtacatcaagaccaaccccagacagatgaccatggagaccgtggagagccagcacgacggcagcatcaccgccagcctgaccgagagcaagagcgcccacgtgcagacccagaccggccagaacagcatccccgccctggcccaggtgagcgtggccggcagcggcaccagaagaggcagccccgccgtgaccctggtgcagctgcccagcggccagaccatccacgtgcagggcgtgatccagaccccccagccctgggtgatccagagcagcgagatccacaccgtgcaggtggccgccatcgccgagaccgacgagagcgccgagagcgagggcgtgatcgacagccacaagagaagagagatcctgagcagaagacccagctacagaaagatcctgaacgagctgagcagcgacgtgcccggcgtgcccaagatcgaggaggagagaagcgaggaggagggcaccccccccagcatcgccaccatggccgtgcccaccagcatctaccagaccagcaccggccagtacatcgccatcgcccagggcggcaccatccagatcagcaaccccggcagcgacggcgtgcagggcctgcaggccctgaccatgaccaacagcggcgcccccccccccggcgccaccatcgtgcagtacgccgcccagagcgccgacggcacccagcagttcttcgtgcccggcagccaggtggtggtgcaggccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccagagagtgcagaagaaagaagaaggagtacgtgaagtgcctggagaacagagtggccgtgctggagaaccagaacaagaccctgatcgaggagctgaaggccctgaaggacctgtactgccacaaggtggagtag

SEQ ID NO: 75254 - DNA, 900 bp, Artificial Sequence
  Description of Artificial Sequence: Synthetic coding sequence
atgagcaagtgcgccagaaagaagtacatcaagaccaaccccagacagatgaccatggagaccgtggagagccagcacgacggcagcatcaccgccagcctgaccgagagcaagagcgcccacgtgcagacccagaccggccagaacagcatccccgccctggcccaggtggccgccatcgccgagaccgacgagagcgccgagagcgagggcgtgatcgacagccacaagagaagagagatcctgagcagaagacccagctacagaaagatcctgaacgagctgagcagcgacgtgcccggcgtgcccaagatcgaggaggagagaagcgaggaggagggcaccccccccagcatcgccaccatggccgtgcccaccagcatctaccagaccagcaccggccagtacatcgccatcgcccagggcggcaccatccagatcagcaaccccggcagcgacggcgtgcagggcctgcaggccctgaccatgaccaacagcggcgcccccccccccggcgccaccatcgtgcagtacgccgcccagagcgccgacggcacccagcagttcttcgtgcccggcagccaggtggtggtgcaggccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccagagagtgcagaagaaagaagaaggagtacgtgaagtgcctggagaacagagtggccgtgctggagaaccagaacaagaccctgatcgaggagctgaaggccctgaaggacctgtactgccacaaggtggagtag

SEQ ID NO: 75255 - DNA, 738 bp, Artificial Sequence
  Description of Artificial Sequence: Synthetic coding sequence
atggtggccgccatcgccgagaccgacgagagcgccgagagcgagggcgtgatcgacagccacaagagaagagagatcctgagcagaagacccagctacagaaagatcctgaacgagctgagcagcgacgtgcccggcgtgcccaagatcgaggaggagagaagcgaggaggagggcaccccccccagcatcgccaccatggccgtgcccaccagcatctaccagaccagcaccggccagtacatcgccatcgcccagggcggcaccatccagatcagcaaccccggcagcgacggcgtgcagggcctgcaggccctgaccatgaccaacagcggcgcccccccccccggcgccaccatcgtgcagtacgccgcccagagcgccgacggcacccagcagttcttcgtgcccggcagccaggtggtggtgcaggccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccaaggagtgcagaagaagaaagaaggagtacgtgaagtgcctggagagcagagtggccgtgctggaggtgcagaacaagaagctgatcgaggagctggagaccctgaaggacatctgcagccccaagaccgactactag

SEQ ID NO: 75256 - DNA, 288 bp, Artificial Sequence
  Description of Artificial Sequence: Synthetic coding sequence
atgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccagagagtgcagaagaaagaagaaggagtacgtgaagtgcctggagaacagagtggccgtgctggagaaccagaacaagaccctgatcgaggagctgaaggccctgaaggacctgtactgccacaaggtggagtag

SEQ ID NO: 75257 - DNA, 903 bp, Artificial Sequence
  Description of Artificial Sequence: Synthetic coding sequence
atgagcaagtgcgccagaaagaagtacatcaagaccaaccccagacagatgaccatggagaccgtggagagccagcacgacggcagcatcaccgccagcctgaccgagagcaagagcgcccacgtgcagacccagaccggccagaacagcatccccgccctggcccaggtggccgccatcgccgagaccgacgagagcgccgagagcgagggcgtgatcgacagccacaagagaagagagatcctgagcagaagacccagctacagaaagatcctgaacgagctgagcagcgacgtgcccggcgtgcccaagatcgaggaggagagaagcgaggaggagggcaccccccccagcatcgccaccatggccgtgcccaccagcatctaccagaccagcaccggccagtacatcgccatcgcccagggcggcaccatccagatcagcaaccccggcagcgacggcgtgcagggcctgcaggccctgaccatgaccaacagcggcgcccccccccccggcgccaccatcgtgcagtacgccgcccagagcgccgacggcacccagcagttcttcgtgcccggcagccaggtggtggtgcaggccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccaaggagtgcagaagaagaaagaaggagtacgtgaagtgcctggagagcagagtggccgtgctggaggtgcagaacaagaagctgatcgaggagctggagaccctgaaggacatctgcagccccaagaccgactactag

SEQ ID NO: 75258 - DNA, 666 bp, Artificial Sequence
  Description of Artificial Sequence: Synthetic coding sequence
atgaccatggagaccgtggagagccagcacgacggcagcatcaccgccagcctgaccgagagcaagagcgcccacgtgcagacccagaccggccagaacagcatccccgccctggcccaggtggccgccatcgccgagaccgacgagagcgccgagagcgagggcgtgatcgacagccacaagagaagagagatcctgagcagaagacccagctacagaaagatcctgaacgagctgagcagcgacgtgcccggcgtgcccaagatcgaggaggagagaagcgaggaggagggcaccccccccagcatcgccaccatggccgtgcccaccagcatctaccagaccagcaccggccagtacaccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccaaggagtgcagaagaagaaagaaggagtacgtgaagtgcctggagagcagagtggccgtgctggaggtgcagaacaagaagctgatcgaggagctggagaccctgaaggacatctgcagccccaagaccgactactag

SEQ ID NO: 75259 - DNA, 747 bp, Artificial Sequence
  Description of Artificial Sequence: Synthetic coding sequence
atgagcaagtgcgccagaaagaagtacatcaagaccaaccccagacagatgaccatggagaccgtggagagccagcacgacggcagcatcaccgccagcctgaccgagagcaagagcgcccacgtgcagacccagaccggccagaacagcatccccgccctggcccaggtggccgccatcgccgagaccgacgagagcgccgagagcgagggcgtgatcgacagccacaagagaagagagatcctgagcagaagacccagctacagaaagatcctgaacgagctgagcagcgacgtgcccggcgtgcccaagatcgaggaggagagaagcgaggaggagggcaccccccccagcatcgccaccatggccgtgcccaccagcatctaccagaccagcaccggccagtacaacgaggagaccgagctggcccccagccacatggccgccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccagagagtgcagaagaaagaagaaggagtacgtgaagtgcctggagaacagagtggccgtgctggagaaccagaacaagaccctgatcgaggagctgaaggccctgaaggacctgtactgccacaaggtggagtag

SEQ ID NO: 75260 - DNA, 327 bp, Artificial Sequence
  Description of Artificial Sequence: Synthetic coding sequence
atggccgtgaccggcgacgacaccgccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccagagagtgcagaagaaagaagaaggagtacgtgaagtgcctggagaacagagtggccgtgctggagaaccagaacaagaccctgatcgaggagctgaaggccctgaaggacctgtactgccacaaggtggagtag

SEQ ID NO: 75261 - DNA, 813 bp, Artificial Sequence
  Description of Artificial Sequence: Synthetic coding sequence
atgtggtggcaccagcacaacctgtgcttcagaagacccatcgaggaggactacagcagcggcgacgtggaggagaaggtggccgccatcgccgagaccgacgagagcgccgagagcgagggcgtgatcgacagccacaagagaagagagatcctgagcagaagacccagctacagaaagatcctgaacgagctgagcagcgacgtgcccggcgtgcccaagatcgaggaggagagaagcgaggaggagggcaccccccccagcatcgccaccatggccgtgcccaccagcatctaccagaccagcaccggccagtacatcgccatcgcccagggcggcaccatccagatcagcaaccccggcagcgacggcgtgcagggcctgcaggccctgaccatgaccaacagcggcgcccccccccccggcgccaccatcgtgcagtacgccgcccagagcgccgacggcacccagcagttcttcgtgcccggcagccaggtggtggtgcaggccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccaaggagtgcagaagaagaaagaaggagtacgtgaagtgcctggagagcagagtggccgtgctggaggtgcagaacaagaagctgatcgaggagctggagaccctgaaggacatctgcagccccaagaccgactactag

SEQ ID NO: 75262 - DNA, 999 bp, Artificial Sequence
  Description of Artificial Sequence: Synthetic coding sequence
atgaccatggagaccgtggagagccagcacgacggcagcatcaccgccagcctgaccgagagcaagagcgcccacgtgcagacccagaccggccagaacagcatccccgccctggcccaggtgagcgtggccggcagcggcaccagaagaggcagccccgccgtgaccctggtgcagctgcccagcggccagaccatccacgtgcagggcgtgatccagaccccccagccctgggtgatccagagcagcgagatccacaccgtgcaggtggccgccatcgccgagaccgacgagagcgccgagagcgagggcgtgatcgacagccacaagagaagagagatcctgagcagaagacccagctacagaaagatcctgaacgagctgagcagcgacgtgcccggcgtgcccaagatcgaggaggagagaagcgaggaggagggcaccccccccagcatcgccaccatggccgtgcccaccagcatctaccagaccagcaccggccagtacatcgccatcgcccagggcggcaccatccagatcagcaaccccggcagcgacggcgtgcagggcctgcaggccctgaccatgaccaacagcggcgcccccccccccggcgccaccatcgtgcagtacgccgcccagagcgccgacggcacccagcagttcttcgtgcccggcagccaggtggtggtgcaggccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccagagagtgcagaagaaagaagaaggagtacgtgaagtgcctggagaacagagtggccgtgctggagaaccagaacaagaccctgatcgaggagctgaaggccctgaaggacctgtactgccacaaggtggagtag

SEQ ID NO: 75263 - DNA, 1002 bp, Artificial Sequence
  Description of Artificial Sequence: Synthetic coding sequence
atgaccatggagaccgtggagagccagcacgacggcagcatcaccgccagcctgaccgagagcaagagcgcccacgtgcagacccagaccggccagaacagcatccccgccctggcccaggtgagcgtggccggcagcggcaccagaagaggcagccccgccgtgaccctggtgcagctgcccagcggccagaccatccacgtgcagggcgtgatccagaccccccagccctgggtgatccagagcagcgagatccacaccgtgcaggtggccgccatcgccgagaccgacgagagcgccgagagcgagggcgtgatcgacagccacaagagaagagagatcctgagcagaagacccagctacagaaagatcctgaacgagctgagcagcgacgtgcccggcgtgcccaagatcgaggaggagagaagcgaggaggagggcaccccccccagcatcgccaccatggccgtgcccaccagcatctaccagaccagcaccggccagtacatcgccatcgcccagggcggcaccatccagatcagcaaccccggcagcgacggcgtgcagggcctgcaggccctgaccatgaccaacagcggcgcccccccccccggcgccaccatcgtgcagtacgccgcccagagcgccgacggcacccagcagttcttcgtgcccggcagccaggtggtggtgcaggccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccaaggagtgcagaagaagaaagaaggagtacgtgaagtgcctggagagcagagtggccgtgctggaggtgcagaacaagaagctgatcgaggagctggagaccctgaaggacatctgcagccccaagaccgactactag

SEQ ID NO: 75264 - DNA, 414 bp, Artificial Sequence
  Description of Artificial Sequence: Synthetic coding sequence
atgaccatggagaccgtggagagccagcacgacggcagcatcaccgccagcctgaccgagagcaagagcgcccacgtgcagacccagaccggccagaacagcatccccgccctggcccaggtggccgccatcgccgagaccgacgagagcgccgagagcgagggcgtgatcgacagccacaagagaagagagatcctgagcagaagacccagctacagaaagatcctgaacgagctgagcagcgacgtgcccggcgtgcccaagatcgaggaggagagaagcgaggaggagggcaccccccccagcatcgccaccatggccgtgcccaccagcatctaccagaccagcaccggccagtacagcatgtacgccgccatcagatacgacaccgtgctggccctgagcctgctgtag

SEQ ID NO: 75265 - DNA, 666 bp, Artificial Sequence; identical to SEQ ID NO: 75258
  Description of Artificial Sequence: Synthetic coding sequence

SEQ ID NO: 75266 - DNA, 711 bp, Artificial Sequence
  Description of Artificial Sequence: Synthetic coding sequence
atgagcaagtgcgccagaaagaagtacatcaagaccaaccccagacagatgaccatggagaccgtggagagccagcacgacggcagcatcaccgccagcctgaccgagagcaagagcgcccacgtgcagacccagaccggccagaacagcatccccgccctggcccaggtggccgccatcgccgagaccgacgagagcgccgagagcgagggcgtgatcgacagccacaagagaagagagatcctgagcagaagacccagctacagaaagatcctgaacgagctgagcagcgacgtgcccggcgtgcccaagatcgaggaggagagaagcgaggaggagggcaccccccccagcatcgccaccatggccgtgcccaccagcatctaccagaccagcaccggccagtacaccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccagagagtgcagaagaaagaagaaggagtacgtgaagtgcctggagaacagagtggccgtgctggagaaccagaacaagaccctgatcgaggagctgaaggccctgaaggacctgtactgccacaaggtggagtag

SEQ ID NO: 75267 - DNA, 849 bp, Artificial Sequence
  Description of Artificial Sequence: Synthetic coding sequence
atgtggtggcaccagcacaacctgtgcttcagaagacccatcgaggaggactacagcagcggcgacgtggaggagaaggtggccgccatcgccgagaccgacgagagcgccgagagcgagggcgtgatcgacagccacaagagaagagagatcctgagcagaagacccagctacagaaagatcctgaacgagctgagcagcgacgtgcccggcgtgcccaagatcgaggaggagagaagcgaggaggagggcaccccccccagcatcgccaccatggccgtgcccaccagcatctaccagaccagcaccggccagtacatcgccatcgcccagggcggcaccatccagatcagcaaccccggcagcgacggcgtgcagggcctgcaggccctgaccatgaccaacagcggcgcccccccccccggcgccaccatcgtgcagtacgccgcccagagcgccgacggcacccagcagttcttcgtgcccggcagccaggtggtggtgcaggacgaggagaccgagctggcccccagccacatggccgccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccaaggagtgcagaagaagaaagaaggagtacgtgaagtgcctggagagcagagtggccgtgctggaggtgcagaacaagaagctgatcgaggagctggagaccctgaaggacatctgcagccccaagaccgactactag

SEQ ID NO: 75268 - DNA, 1086 bp, Artificial Sequence
  Description of Artificial Sequence: Synthetic coding sequence
atgagcaagtgcgccagaaagaagtacatcaagaccaaccccagacagatgaccatggagaccgtggagagccagcacgacggcagcatcaccgccagcctgaccgagagcaagagcgcccacgtgcagacccagaccggccagaacagcatccccgccctggcccaggtgagcgtggccggcagcggcaccagaagaggcagccccgccgtgaccctggtgcagctgcccagcggccagaccatccacgtgcagggcgtgatccagaccccccagccctgggtgatccagagcagcgagatccacaccgtgcaggtggccgccatcgccgagaccgacgagagcgccgagagcgagggcgtgatcgacagccacaagagaagagagatcctgagcagaagacccagctacagaaagatcctgaacgagctgagcagcgacgtgcccggcgtgcccaagatcgaggaggagagaagcgaggaggagggcaccccccccagcatcgccaccatggccgtgcccaccagcatctaccagaccagcaccggccagtacatcgccatcgcccagggcggcaccatccagatcagcaaccccggcagcgacggcgtgcagggcctgcaggccctgaccatgaccaacagcggcgcccccccccccggcgccaccatcgtgcagtacgccgcccagagcgccgacggcacccagcagttcttcgtgcccggcagccaggtggtggtgcaggacgaggagaccgagctggcccccagccacatggccgccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccaaggagtgcagaagaagaaagaaggagtacgtgaagtgcctggagagcagagtggccgtgctggaggtgcagaacaagaagctgatcgaggagctggagaccctgaaggacatctgcagccccaagaccgactactag

SEQ ID NO: 75269 - DNA, 474 bp, Artificial Sequence
  Description of Artificial Sequence: Synthetic coding sequence
atgagcaagtgcgccagaaagaagtacatcaagaccaaccccagacagatgaccatggagaccgtggagagccagcacgacggcagcatcaccgccagcctgaccgagagcaagagcgcccacgtgcagacccagaccggccagaacagcatccccgccctggcccaggtggccgccatcgccgagaccgacgagagcgccgagagcgagggcgtgatcgacagccacaagagaagagagatcctgagcagaagacccagctacagaaagatcctgaacgagctgagcagcgacgtgcccggcgtgcccaagatcgaggaggagagaagcgaggaggagggcaccccccccagcatcgccaccatggccgtgcccaccagcatctaccagaccagcaccggccagtacatcgccatcgcccagggcggcaccatccagatcagcaaccccggcagcgacggcgtgcagggctag

SEQ ID NO: 75270 - DNA, 1038 bp, Artificial Sequence
  Description of Artificial Sequence: Synthetic coding sequence
atgaccatggagaccgtggagagccagcacgacggcagcatcaccgccagcctgaccgagagcaagagcgcccacgtgcagacccagaccggccagaacagcatccccgccctggcccaggtgagcgtggccggcagcggcaccagaagaggcagccccgccgtgaccctggtgcagctgcccagcggccagaccatccacgtgcagggcgtgatccagaccccccagccctgggtgatccagagcagcgagatccacaccgtgcaggtggccgccatcgccgagaccgacgagagcgccgagagcgagggcgtgatcgacagccacaagagaagagagatcctgagcagaagacccagctacagaaagatcctgaacgagctgagcagcgacgtgcccggcgtgcccaagatcgaggaggagagaagcgaggaggagggcaccccccccagcatcgccaccatggccgtgcccaccagcatctaccagaccagcaccggccagtacatcgccatcgcccagggcggcaccatccagatcagcaaccccggcagcgacggcgtgcagggcctgcaggccctgaccatgaccaacagcggcgcccccccccccggcgccaccatcgtgcagtacgccgcccagagcgccgacggcacccagcagttcttcgtgcccggcagccaggtggtggtgcaggacgaggagaccgagctggcccccagccacatggccgccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccaaggagtgcagaagaagaaagaaggagtacgtgaagtgcctggagagcagagtggccgtgctggaggtgcagaacaagaagctgatcgaggagctggagaccctgaaggacatctgcagccccaagaccgactactag

SEQ ID NO: 75271 - DNA, 858 bp, Artificial Sequence
  Description of Artificial Sequence: Synthetic coding sequence
atgagcaagtgcgccagaaagaagtacatcaagaccaaccccagacagatgaccatggagaccgtggagagccagcacgacggcagcatcaccgccagcctgaccgagagcaagagcgcccacgtgcagacccagaccggccagaacagcatccccgccctggcccaggtgagcgtggccggcagcggcaccagaagaggcagccccgccgtgaccctggtgcagctgcccagcggccagaccatccacgtgcagggcgtgatccagaccccccagccctgggtgatccagagcagcgagatccacaccgtgcaggtggccgccatcgccgagaccgacgagagcgccgagagcgagggcgtgatcgacagccacaagagaagagagatcctgagcagaagacccagctacagaaagatcctgaacgagctgagcagcgacgtgcccggcgtgcccaagatcgaggaggagagaagcgaggaggagggcaccccccccagcatcgccaccatggccgtgcccaccagcatctaccagaccagcaccggccagtacaccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccagagagtgcagaagaaagaagaaggagtacgtgaagtgcctggagaacagagtggccgtgctggagaaccagaacaagaccctgatcgaggagctgaaggccctgaaggacctgtactgccacaaggtggagtag

SEQ ID NO: 75272 - DNA, 288 bp, Artificial Sequence; identical to SEQ ID NO: 75256
  Description of Artificial Sequence: Synthetic coding sequence

SEQ ID NO: 75273 - DNA, 810 bp, Artificial Sequence
  Description of Artificial Sequence: Synthetic coding sequence
atgaccatggagaccgtggagagccagcacgacggcagcatcaccgccagcctgaccgagagcaagagcgcccacgtgcagacccagaccggccagaacagcatccccgccctggcccaggtgagcgtggccggcagcggcaccagaagaggcagccccgccgtgaccctggtgcagctgcccagcggccagaccatccacgtgcagggcgtgatccagaccccccagccctgggtgatccagagcagcgagatccacaccgtgcaggtggccgccatcgccgagaccgacgagagcgccgagagcgagggcgtgatcgacagccacaagagaagagagatcctgagcagaagacccagctacagaaagatcctgaacgagctgagcagcgacgtgcccggcgtgcccaagatcgaggaggagagaagcgaggaggagggcaccccccccagcatcgccaccatggccgtgcccaccagcatctaccagaccagcaccggccagtacaccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccagagagtgcagaagaaagaagaaggagtacgtgaagtgcctggagaacagagtggccgtgctggagaaccagaacaagaccctgatcgaggagctgaaggccctgaaggacctgtactgccacaaggtggagtag

SEQ ID NO: 75274 - DNA, 585 bp, Artificial Sequence
  Description of Artificial Sequence: Synthetic coding sequence
atggtggccgccatcgccgagaccgacgagagcgccgagagcgagggcgtgatcgacagccacaagagaagagagatcctgagcagaagacccagctacagaaagatcctgaacgagctgagcagcgacgtgcccggcgtgcccaagatcgaggaggagagaagcgaggaggagggcaccccccccagcatcgccaccatggccgtgcccaccagcatctaccagaccagcaccggccagtacaacgaggagaccgagctggcccccagccacatggccgccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccaaggagtgcagaagaagaaagaaggagtacgtgaagtgcctggagagcagagtggccgtgctggaggtgcagaacaagaagctgatcgaggagctggagaccctgaaggacatctgcagccccaagaccgactactag

SEQ ID NO: 75275 - DNA, 363 bp, Artificial Sequence
  Description of Artificial Sequence: Synthetic coding sequence
atggccgtgaccggcgacgacaccgacgaggagaccgagctggcccccagccacatggccgccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccagagagtgcagaagaaagaagaaggagtacgtgaagtgcctggagaacagagtggccgtgctggagaaccagaacaagaccctgatcgaggagctgaaggccctgaaggacctgtactgccacaaggtggagtag

SEQ ID NO: 75276 - DNA, 291 bp, Artificial Sequence
  Description of Artificial Sequence: Synthetic coding sequence
atgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccaaggagtgcagaagaagaaagaaggagtacgtgaagtgcctggagagcagagtggccgtgctggaggtgcagaacaagaagctgatcgaggagctggagaccctgaaggacatctgcagccccaagaccgactactag

SEQ ID NO: 75277 - DNA, 339 bp, Artificial Sequence
  Description of Artificial Sequence: Synthetic coding sequence
atgaacagaacccaggagctgagcggccagctgagcgccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccagagagtgcagaagaaagaagaaggagtacgtgaagtgcctggagaacagagtggccgtgctggagaaccagaacaagaccctgatcgaggagctgaaggccctgaaggacctgtactgccacaaggtggagtag

SEQ ID NO: 75278 - DNA, 939 bp, Artificial Sequence
  Description of Artificial Sequence: Synthetic coding sequence
atgagcaagtgcgccagaaagaagtacatcaagaccaaccccagacagatgaccatggagaccgtggagagccagcacgacggcagcatcaccgccagcctgaccgagagcaagagcgcccacgtgcagacccagaccggccagaacagcatccccgccctggcccaggtggccgccatcgccgagaccgacgagagcgccgagagcgagggcgtgatcgacagccacaagagaagagagatcctgagcagaagacccagctacagaaagatcctgaacgagctgagcagcgacgtgcccggcgtgcccaagatcgaggaggagagaagcgaggaggagggcaccccccccagcatcgccaccatggccgtgcccaccagcatctaccagaccagcaccggccagtacatcgccatcgcccagggcggcaccatccagatcagcaaccccggcagcgacggcgtgcagggcctgcaggccctgaccatgaccaacagcggcgcccccccccccggcgccaccatcgtgcagtacgccgcccagagcgccgacggcacccagcagttcttcgtgcccggcagccaggtggtggtgcaggacgaggagaccgagctggcccccagccacatggccgccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccaaggagtgcagaagaagaaagaaggagtacgtgaagtgcctggagagcagagtggccgtgctggaggtgcagaacaagaagctgatcgaggagctggagaccctgaaggacatctgcagccccaagaccgactactag

SEQ ID NO: 75279 - DNA, 660 bp, Artificial Sequence
  Description of Artificial Sequence: Synthetic coding sequence
atgtggtggcaccagcacaacctgtgcttcagaagacccatcgaggaggactacagcagcggcgacgtggaggagaaggtggccgccatcgccgagaccgacgagagcgccgagagcgagggcgtgatcgacagccacaagagaagagagatcctgagcagaagacccagctacagaaagatcctgaacgagctgagcagcgacgtgcccggcgtgcccaagatcgaggaggagagaagcgaggaggagggcaccccccccagcatcgccaccatggccgtgcccaccagcatctaccagaccagcaccggccagtacaacgaggagaccgagctggcccccagccacatggccgccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccaaggagtgcagaagaagaaagaaggagtacgtgaagtgcctggagagcagagtggccgtgctggaggtgcagaacaagaagctgatcgaggagctggagaccctgaaggacatctgcagccccaagaccgactactag

SEQ ID NO: 75280 - DNA, 366 bp, Artificial Sequence
  Description of Artificial Sequence: Synthetic coding sequence
atggccgtgaccggcgacgacaccgacgaggagaccgagctggcccccagccacatggccgccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccaaggagtgcagaagaagaaagaaggagtacgtgaagtgcctggagagcagagtggccgtgctggaggtgcagaacaagaagctgatcgaggagctggagaccctgaaggacatctgcagccccaagaccgactactag

SEQ ID NO: 75281 - DNA, 330 bp, Artificial Sequence
  Description of Artificial Sequence: Synthetic coding sequence
atggccgtgaccggcgacgacaccgccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccaaggagtgcagaagaagaaagaaggagtacgtgaagtgcctggagagcagagtggccgtgctggaggtgcagaacaagaagctgatcgaggagctggagaccctgaaggacatctgcagccccaagaccgactactag

SEQ ID NO: 75282 - DNA, 309 bp, Artificial Sequence
  Description of Artificial Sequence: Synthetic coding sequence
atggccgccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccagagagtgcagaagaaagaagaaggagtacgtgaagtgcctggagaacagagtggccgtgctggagaaccagaacaagaccctgatcgaggagctgaaggccctgaaggacctgtactgccacaaggtggagtag

SEQ ID NO: 75283 - DNA, 414 bp, Artificial Sequence; identical to SEQ ID NO: 75264
  Description of Artificial Sequence: Synthetic coding sequence

SEQ ID NO: 75284 - DNA, 618 bp, Artificial Sequence
  Description of Artificial Sequence: Synthetic coding sequence
atgaccatggagaccgtggagagccagcacgacggcagcatcaccgccagcctgaccgagagcaagagcgcccacgtgcagacccagaccggccagaacagcatccccgccctggcccaggtggtggccatcgcccagggcggcaccatccagatcagcaaccccggcagcgacggcgtgcagggcctgcaggccctgaccatgaccaacagcggcgcccccccccccggcgccaccatcgtgcagtacgccgcccagagcgccgacggcacccagcagttcttcgtgcccggcagccaggtggtggtgcaggccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccaaggagtgcagaagaagaaagaaggagtacgtgaagtgcctggagagcagagtggccgtgctggaggtgcagaacaagaagctgatcgaggagctggagaccctgaaggacatctgcagccccaagaccgactactag

SEQ ID NO: 75285 - DNA, 813 bp, Artificial Sequence
  Description of Artificial Sequence: Synthetic coding sequence
atgaccatggagaccgtggagagccagcacgacggcagcatcaccgccagcctgaccgagagcaagagcgcccacgtgcagacccagaccggccagaacagcatccccgccctggcccaggtgagcgtggccggcagcggcaccagaagaggcagccccgccgtgaccctggtgcagctgcccagcggccagaccatccacgtgcagggcgtgatccagaccccccagccctgggtgatccagagcagcgagatccacaccgtgcaggtggccgccatcgccgagaccgacgagagcgccgagagcgagggcgtgatcgacagccacaagagaagagagatcctgagcagaagacccagctacagaaagatcctgaacgagctgagcagcgacgtgcccggcgtgcccaagatcgaggaggagagaagcgaggaggagggcaccccccccagcatcgccaccatggccgtgcccaccagcatctaccagaccagcaccggccagtacaccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccaaggagtgcagaagaagaaagaaggagtacgtgaagtgcctggagagcagagtggccgtgctggaggtgcagaacaagaagctgatcgaggagctggagaccctgaaggacatctgcagccccaagaccgactactag

SEQ ID NO: 75286 - DNA, 342 bp, Artificial Sequence
  Description of Artificial Sequence: Synthetic coding sequence
atgaacagaacccaggagctgagcggccagctgagcgccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccaaggagtgcagaagaagaaagaaggagtacgtgaagtgcctggagagcagagtggccgtgctggaggtgcagaacaagaagctgatcgaggagctggagaccctgaaggacatctgcagccccaagaccgactactag

SEQ ID NO: 75287 - DNA, 465 bp, Artificial Sequence
  Description of Artificial Sequence: Synthetic coding sequence
atgaccatggagaccgtggagagccagcacgacggcagcatcaccgccagcctgaccgagagcaagagcgcccacgtgcagacccagaccggccagaacagcatccccgccctggcccaggtggacgaggagaccgagctggcccccagccacatggccgccgccaccggcgacatgcccacctaccagatcagagcccccaccgccgccctgccccagggcgtggtgatggccgccagccccggcagcctgcacagcccccagcagctggccgaggaggccaccagaaagagagagctgagactgatgaagaacagagaggccgccaaggagtgcagaagaagaaagaaggagtacgtgaagtgcctggagagcagagtggccgtgctggaggtgcagaacaagaagctgatcgaggagctggagaccctgaaggacatctgcagccccaagaccgactactag

SEQ ID NO: 75288 - DNA, 339 bp, Artificial Sequence
  Description of Artificial Sequence: Synthetic coding sequence
atgagcgccgaggtgcccgaggccgccagcgccgaggagcagaaggagatggaggacaaggtgaccagccccgagaaggccgaggaggccaagctgaaggccagatacccccacctgggccagaagcccggcggcagcgacttcctgagaaagagactgcagaagggccagaagtacttcgacagcggcgactacaacatggccaaggccaagatgaagaacaagcagctgcccaccgccgcccccgacaagaccgaggtgaccggcgaccacatccccaccccccaggacctgccccagagaaagcccagcctggtggccagcaagctggccggctag

SEQ ID NO: 75289 - DNA, 1926 bp, Artificial Sequence
  Description of Artificial Sequence: Synthetic coding sequence
atgaccgagaagcccgagttccagagccaggtgtacaactacgccaaggacaacaacatcaagcaggacagcttcaaggaggagaaccccatggagaccagcgtgagcgccaacaccgaccagctgggcaacgagtacttcagacagcccccccccagaagcccccccctgatccactgcagcggcgagatgctgaagttcaccgagaagagcctggccaagagcatcgccaaggagagcgccctgaaccccagccagccccccagcttcctgtgcaagaccgccgtgcccagcaaggagatccagaactacggcgagatccccgagatgagcgtgagctacgagaaggaggtgaccgccgagggcgtggagagacccgagatcgtgagcacctggagcagcgccggcatcagctggagaagcgaggcctgcagagagaactgcgagatgcccgactgggagcagagcgccgagagcctgcagcccgtgcaggaggacatggccctgaacgaggtgctgcagaagctgaagcacaccaacagaaagcaggaggtgagaatccaggagctgcagtgcagcaacctgtacctggagaagagagtgaaggagctgcagatgaagatcaccaagcagcaggtgttcatcgacgtgatcaacaagctgaaggagaacgtggaggagctgatcgaggacaagtacaagatcatcctggagaagaacgacaccaagaagaccctgcagaacctggaggaggtgctggccaacacccagaagcacctgcaggagagcagaaacgacaaggagatgctgcagctgcagttcaagaagatcaaggccaactacgtgtgcctgcaggagagatacatgaccgagatgcagcagaagaacaagagcgtgagccagtacctggagatggacaagaccctgagcaagaaggaggaggaggtggagagactgcagcagctgaagaaggagctggagaaggccaccgccagcgccctggacctgctgaagagagagaaggaggcccaggagcaggagttcctgagcctgcaggaggagttccagaagctggagaaggagaacctggaggagagacagaagctgaagagcagactggagaagctgctgacccaggtgagaaacctgcagttcatgagcgagaacgagagaaccaagaacatcaagctgcagcagcagatcaacgaggtgaagaacgagaacgccaagctgaagcagcaggtggccagaagcgaggagcagaactacgtgcccaagttcgagaccgcccagctgaaggaccagctggaggaggtgctgaagagcgacatcaccaaggacaccaagaccacccacagcaacctgctgcccgactgcagcccctgcgaggagagactgaaccccgccgacatcaagagagccagccagctggccagcaagatgcacagcctgctggccctgatggtgggcctgctgacctgccaggacatcatcaacagcgacgccgagcacttcaaggagagcgagaaggtgagcgacatcatgctgcagaagctgaagagcctgcacctgaagaagaagaccctggacaaggaggtgatcgactgcgacagcgacgaggccaagagcatcagagacgtgcccaccctgctgggcgccaagctggacaagtaccacagcctgaacgaggagctggacttcctggtgaccagctacgaggagatcatcgagtgcgccgaccagagactggccatcagccacagccagatcgcccacctggaggagagaaacaagcacctggaggacctgatcagaaagcccagagagaaggccagaaagcccagaagcaagagcctggagaaccaccccaagagcatgaccatgatgcccgccctgttcaaggagaacagaaacgacctggactag

SEQ ID NO: 75290 - DNA, 2475 bp, Artificial Sequence
  Description of Artificial Sequence: Synthetic coding sequence
atgaacaaggactaccagaagttctggagcagccccagcgaccccgtgcacttcgaggtggacaccagccacgagaaggtggagagcatgagcgagagcgacaccatgaacgtgagcaacctgagccagggcgtgatgctgagccacagccccatctgcatggagaccaccggcaccacctgcgacctgccccagaacgagatcaagaacttcgagagagagaacgagtacgagagcaccctgtgcgaggacgcctacggcaccctggacaacctgctgaacgacaacaacatcgagaactacagcaccaacgccctgatccagcccgtggacaccatcagcatcagcagcctgagacagttcgagaccgtgtgcaagttccactgggtggaggccttcgacgacgagatgaccgagaagcccgagttccagagccaggtgtacaactacgccaaggacaacaacatcaagcaggacagcttcaaggaggagaaccccatggagaccagcgtgagcgccaacaccgaccagctgggcaacgagtacttcagacagcccccccccagaagcccccccctgatccactgcagcggcgagatgctgaagttcaccgagaagagcctggccaagagcatcgccaaggagagcgccctgaaccccagccagccccccagcttcctgtgcaagaccgccgtgcccagcaaggagatccagaactacggcgagatccccgagatgagcgtgagctacgagaaggaggtgaccgccgagggcgtggagagacccgagatcgtgagcacctggagcagcgccggcatcagctggagaagcgaggcctgcagagagaactgcgagatgcccgactgggagcagagcgccgagagcctgcagcccgtgcaggaggacatggccctgaacgaggtgctgcagaagctgaagcacaccaacagaaagcaggaggtgagaatccaggagctgcagtgcagcaacctgtacctggagaagagagtgaaggagctgcagatgaagatcaccaagcagcaggtgttcatcgacgtgatcaacaagctgaaggagaacgtggaggagctgatcgaggacaagtacaagatcatcctggagaagaacgacaccaagaagaccctgcagaacctggaggaggtgctggccaacacccagaagcacctgcaggagagcagaaacgacaaggagatgctgcagctgcagttcaagaagatcaaggccaactacgtgtgcctgcaggagagatacatgaccgagatgcagcagaagaacaagagcgtgagccagtacctggagatggacaagaccctgagcaagaaggaggaggaggtggagagactgcagcagctgaagaaggagctggagaaggccaccgccagcgccctggacctgctgaagagagagaaggaggcccaggagcaggagttcctgagcctgcaggaggagttccagaagctggagaaggagaacctggaggagagacagaagctgaagagcagactggagaagctgctgacccaggtgagaaacctgcagttcatgagcgagaacgagagaaccaagaacatcaagctgcagcagcagatcaacgaggtgaagaacgagaacgccaagctgaagcagcaggtggccagaagcgaggagcagaactacgtgcccaagttcgagaccgcccagctgaaggaccagctggaggaggtgctgaagagcgacatcaccaaggacaccaagaccacccacagcaacctgctgcccgactgcagcccctgcgaggagagactgaaccccgccgacatcaagagagccagccagctggccagcaagatgcacagcctgctggccctgatggtgggcctgctgacctgccaggacatcatcaacagcgacgccgagcacttcaaggagagcgagaaggtgagcgacatcatgctgcagaagctgaagagcctgcacctgaagaagaagaccctggacaaggagctgctgaagcacaaggacagaatcaccaccttcagagagctgatcgccaaggagaaggccttccaggaccacgccatcaaggtgatcgactgcgacagcgacgaggccaagagcatcagagacgtgcccaccctgctgggcgccaagctggacaagtaccacagcctgaacgaggagctggacttcctggtgaccagctacgaggagatcatcgagtgcgccgaccagagactggccatcagccacagccagatcgcccacctggaggagagaaacaagcacctggaggacctgatcagaaagcccagagagaaggccagaaagcccagaagcaagagcctggagaaccaccccaagagcatgaccatgctggcctacaacctgtacatcttcatcggctacagactgggcgccgtggccgacgcctgcaaccccagcaccctgggcggcagaggcggctggatcacctag

SEQ ID NO: 75291 - DNA, 2334 bp, Artificial Sequence
  Description of Artificial Sequence: Synthetic coding sequence
atgaacaaggactaccagaagttctggagcagccccagcgaccccgtgcacttcgaggtggacaccagccacgagaaggtggagagcatgagcgagagcgacaccatgaacgtgagcaacctgagccagggcgtgatgctgagccacagccccatctgcatggagaccaccggcaccacctgcgacctgccccagaacgagatcaagaacttcgagagagagaacgagtacgagagcaccctgtgcgaggacgcctacggcaccctggacaacctgctgaacgacaacaacatcgagaactacagcaccaacgccctgatccagcccgtggacaccatcagcatcagcagcctgagacagttcgagaccgtgtgcaagttccactgggtggaggccttcgacgacgagatgaccgagaagcccgagttccagagccaggtgtacaactacgccaaggacaacaacatcaagcaggacagcttcaaggaggagaaccccatggagaccagcgtgagcgccaacaccgaccagctgggcaacgagtacttcagacagcccccccccagaagcccccccctgatccactgcagcggcgagatgctgaagttcaccgagaagagcctggccaagagcatcgccaaggagagcgccctgaaccccagccagccccccagcttcctgtgcaagaccgccgtgcccagcaaggagatccagaactacggcgagatccccgagatgagcgtgagctacgagaaggaggtgaccgccgagggcgtggagagacccgagatcgtgagcacctggagcagcgccggcatcagctggagaagcgaggcctgcagagagaactgcgagatgcccgactgggagcagagcgccgagagcctgcagcccgtgcaggaggacatggccctgaacgaggtgctgcagaagctgaagcacaccaacagaaagcaggaggtgagaatccaggagctgcagtgcagcaacctgtacctggagaagagagtgaaggagctgcagatgaagatcaccaagcagcaggtgttcatcgacgtgatcaacaagctgaaggagaacgtggaggagctgatcgaggacaagtacaagatcatcctggagaagaacgacaccaagaagaccctgcagaacctggaggaggtgctggccaacacccagaagcacctgcaggagagcagaaacgacaaggagatgctgcagctgcagttcaagaagatcaaggccaactacgtgtgcctgcaggagagatacatgaccgagatgcagcagaagaacaagagcgtgagccagtacctggagatggacaagaccctgagcaagaaggaggaggaggtggagagactgcagcagctgaagaaggagctggagaaggccaccgccagcgccctggacctgctgaagagagagaaggaggcccaggagcaggagttcctgagcctgcaggaggagttccagaagctggagaaggagaacctggaggagagacagaagctgaagagcagactggagaagctgctgacccaggtgagaaacctgcagttcatgagcgagaacgagagaaccaagaacatcaagctgcagcagcagatcaacgaggtgaagaacgagaacgccaagctgaagcagcaggtggccagaagcgaggagcagaactacgtgcccaagttcgagaccgcccagctgaaggaccagctggaggaggtgctgaagagcgacatcaccaaggacaccaagaccacccacagcaacctgctgcccgactgcagcccctgcgaggagagactgaaccccgccgacatcaagagagccagccagctggccagcaagatgcacagcctgctggccctgatggtgggcctgctgacctgccaggacatcatcaacagcgacgccgagcacttcaaggagagcgagaaggtgagcgacatcatgctgcagaagctgaagagcctgcacctgaagaagaagaccctggacaaggaggtgatcgactgcgacagcgacgaggccaagagcatcagagacgtgcccaccctgctgggcgccaagctggacaagtaccacagcctgaacgaggagctggacttcctggtgaccagctacgaggagatcatcgagtgcgccgaccagagactggccatcagccacagccagatcgcccacctggaggagagaaacaagcacctggaggacctgatcagaaagcccagagagaaggccagaaagcccagaagcaagagcctggagaaccaccccaagagcatgaccatgatgcccgccctgttcaaggagaacagaaacgacctggactag

SEQ ID NO: 75292 - DNA, 2103 bp, Artificial Sequence
  Description of Artificial Sequence: Synthetic coding sequence
atgaacaaggactaccagaagttctggagcagccccagcgaccccgtgcacttcgaggtggacaccagccacgagaaggtggagagcatgagcgagagcgacaccatgaacgtgagcaacctgagccagggcgtgatgctgagccacagccccatctgcatggagaccaccggcaccacctgcgacctgccccagaacgagatcaagaacttcgagagagagaacgagtacgagagcaccctgtgcgaggacgcctacggcaccctggacaacctgctgaacgacaacaacatcgagaactacagcaccaacgccctgatccagcccgtggacaccatcagcatcagcagcctgagacagttcgagaccgtgtgcaagttccactgggtggaggccttcgacgacgagatgaccgagaagcccgagttccagagccaggtgtacaactacgccaaggacaacaacatcaagcaggacagcttcaaggaggagaaccccatggagaccagcgtgagcgccaacaccgaccagctgggcaacgagtacttcagacagcccccccccagaagcccccccctgatccactgcagcggcgagatgctgaagttcaccgagaagagcctggccaagagcatcgccaaggagagcgccctgaaccccagccagccccccagcttcctgtgcaagaccgccgtgcccagcaaggagatccagaactacggcgagatccccgagatgagcgtgagctacgagaaggaggtgaccgccgagggcgtggagagacccgagatcgtgagcacctggagcagcgccggcatcagctggagaagcgaggcctgcagagagaactgcgagatgcccgactgggagcagagcgccgagagcctgcagcccgtgcaggaggacatggccctgaacgaggtgctgcagaagctgaagcacaccaacagaaagcaggaggtgagaatccaggagctgcagtgcagcaacctgtacctggagaagagagtgaaggagctgcagatgaagatcaccaagcagcaggtgttcatcgacgtgatcaacaagctgaaggagaacgtggaggagctgatcgaggacaagtacaagatcatcctggagaagaacgacaccaagaagaccctgcagaacctggaggaggtgctggccaacacccagaagcacctgcaggagagcagaaacgacaaggagatgctgcagctgcagttcaagaagatcaaggccaactacgtgtgcctgcaggagagatacatgaccgagatgcagcagaagaacaagagcgtgagccagtacctggagatggacaagaccctgagcaagaaggaggaggaggtggagagactgcagcagctgaagaaggagctggagaaggccaccgccagcgccctggacctgctgaagagagagaaggaggcccaggagcaggagttcctgagcctgcaggaggagttccagaagctggagaaggagaacctggaggagagacagaagctgaagagcagactggagaagctgctgacccaggtgagaaacctgcagttcatgagcgagaacgagagaaccaagaacatcaagctgcagcagcagatcaacgaggtgaagaacgagaacgccaagctgaagcagcaggtggccagaagcgaggagcagaactacgtgcccaagttcgagaccgcccagctgaaggaccagctggaggaggtgctgaagagcgacatcaccaaggacaccaagaccacccacagcaacctgctgcccgactgcagcccctgcgaggagagactgaaccccgccgacatcaagagagccagccagctggccagcaagatgcacagcctgctggccctgatggtgggcctgctgacctgccaggacatcatcaacagcgacgccgagcacttcaaggagagcgagaaggtgagcgacatcatgctgcagaagctgaagagcctgcacctgaagaagaagaccctggacaaggagctgctgaagcacaaggacagaatcaccaccttcagagagctgatcgccaaggagaaggccttccaggaccacgccatcaaggtgttccagggcgtgtag

SEQ ID NO: 75293 - DNA, 2520 bp, Artificial Sequence
  Description of Artificial Sequence: Synthetic coding sequence
atgaacaaggactaccagaagttctggagcagccccagcgaccccgtgcacttcgaggtggacaccagccacgagaaggtggagagcatgagcgagagcgacaccatgaacgtgagcaacctgagccagggcgtgatgctgagccacagccccatctgcatggagaccaccggcaccacctgcgacctgccccagaacgagatcaagaacttcgagagagagaacgagtacgagagcaccctgtgcgaggacgcctacggcaccctggacaacctgctgaacgacaacaacatcgagaactacagcaccaacgccctgatccagcccgtggacaccatcagcatcagcagcctgagacagttcgagaccgtgtgcaagttccactgggtggaggccttcgacgacgagatgaccgagaagcccgagttccagagccaggtgtacaactacgccaaggacaacaacatcaagcaggacagcttcaaggaggagaaccccatggagaccagcgtgagcgccaacaccgaccagctgggcaacgagtacttcagacagcccccccccagaagcccccccctgatccactgcagcggcgagatgctgaagttcaccgagaagagcctggccaagagcatcgccaaggagagcgccctgaaccccagccagccccccagcttcctgtgcaagaccgccgtgcccagcaaggagatccagaactacggcgagatccccgagatgagcgtgagctacgagaaggaggtgaccgccgagggcgtggagagacccgagatcgtgagcacctggagcagcgccggcatcagctggagaagcgaggcctgcagagagaactgcgagatgcccgactgggagcagagcgccgagagcctgcagcccgtgcaggaggacatggccctgaacgaggtgctgcagaagctgaagcacaccaacagaaagcaggaggtgagaatccaggagctgcagtgcagcaacctgtacctggagaagagagtgaaggagctgcagatgaagatcaccaagcagcaggtgttcatcgacgtgatcaacaagctgaaggagaacgtggaggagctgatcgaggacaagtacaagatcatcctggagaagaacgacaccaagaagaccctgcagaacctggaggaggtgctggccaacacccagaagcacctgcaggagagcagaaacgacaaggagatgctgcagctgcagttcaagaagatcaaggccaactacgtgtgcctgcaggagagatacatgaccgagatgcagcagaagaacaagagcgtgagccagtacctggagatggacaagaccctgagcaagaaggaggaggaggtggagagactgcagcagctgaagaaggagctggagaaggccaccgccagcgccctggacctgctgaagagagagaaggaggcccaggagcaggagttcctgagcctgcaggaggagttccagaagctggagaaggagaacctggaggagagacagaagctgaagagcagactggagaagctgctgacccaggtgagaaacctgcagttcatgagcgagaacgagagaaccaagaacatcaagctgcagcagcagatcaacgaggtgaagaacgagaacgccaagctgaagcagcaggtggccagaagcgaggagcagaactacgtgcccaagttcgagaccgcccagctgaaggaccagctggaggaggtgctgaagagcgacatcaccaaggacaccaagaccacccacagcaacctgctgcccgactgcagcccctgcgaggagagactgaaccccgccgacatcaagagagccagccagctggccagcaagatgcacagcctgctggccctgatggtgggcctgctgacctgccaggacatcatcaacagcgacgccgagcacttcaaggagagcgagaaggtgagcgacatcatgctgcagaagctgaagagcctgcacctgaagaagaagaccctggacaaggagctgctgaagcacaaggacagaatcaccaccttcagagagctgatcgccaaggagaaggccttccaggaccacgccatcaaggtgatcgactgcgacagcgacgaggccaagagcatcagagacgtgcccaccctgctgggcgccaagctggacaagtaccacagcctgaacgaggagctggacttcctgatcaccaagctgggccacctgctggagagcaaggagaaccactgcaacagactgatcgaggagaacgacaagtaccagagacacctgggcaacctgatcaagaaggtgaccagctacgaggagatcatcgagtgcgccgaccagagactggccatcagccacagccagatcgcccacctggaggagagaaacaagcacctggaggacctgatcagaaagcccagagagaaggccagaaagcccagaagcaagagcctggagaaccaccccaagagcatgaccatgatgcccgccctgttcaaggagaacagaaacgacctggactag

SEQ ID NO: 75294 - DNA, 2112 bp, Artificial Sequence
  Description of Artificial Sequence: Synthetic coding sequence
atggccgacagaagaagacagagagccagccaggacaccgaggacgaggagagcggcgccagcggcagcgacagcggcggcagccccctgagaggcggcggcagctgcagcggcagcgccggcggcggcggcagcggcagcctgcccagccagagaggcggcagaaccggcgccctgcacctgagaagagtggagagcggcggcgccaagagcgccgaggagagcgagtgcgagagcgaggacggcatcgagggcgacgccgtgctgagcgactacgagagcgccgaggacagcgagggcgaggagggcgagtacagcgaggaggagaacagcaaggtggagctgaagagcgaggccaacgacgccgtgaacagcagcaccaaggaggagaagggcgaggagaagcccgacaccaagagcaccgtgaccggcgagagacagagcggcgacggccaggagagcaccgagcccgtggagaacaaggtgggcaagaagggccccaagcacctggacgacgacgaggacagaaagaaccccgcctacatccccagaaagggcctgttcttcgagcacgacctgagaggccagacccaggaggaggaggtgagacccaagggcagacagagaaagctgtggaaggacgagggcagatgggagcacgacaagttcagagaggacgagcaggcccccaagagcagacaggagctgatcgccctgtacggctacgacatcagaagcgcccacaaccccgacgacatcaagcccagaagaatcagaaagcccagatacggcagccccccccagagagaccccaactggaacggcgagagactgaacaagagccacagacaccagggcctgggcggcaccctgccccccagaaccttcatcaacagaaacgccgccggcaccggcagaatgagcgcccccagaaactacagcagaagcggcggcttcaaggagggcagagccggcttcagacccgtggaggccggcggccagcacggcggcagaagcggcgagaccgtgaagcacgagatcagctacagaagcagaagactggagcagaccagcgtgagagaccccagccccgaggccgacgcccccgtgctgggcagccccgagaaggaggaggccgccagcgagccccccgccgccgcccccgacgccgccccccccccccccgacagacccatcgagaagaagagctacagcagagccagaagaaccagaaccaaggtgggcgacgccgtgaagctggccgaggaggtgccccccccccccgagggcctgatccccgccccccccgtgcccgagaccacccccaccccccccaccaagaccggcacctgggaggcccccgtggacagcagcaccagcggcctggagcaggacgtggcccagctgaacatcgccgagcagaactggagccccggccagcccagcttcctgcagcccagagagctgagaggcatgcccaaccacatccacatgggcgccggcccccccccccagttcaacagaatggaggagatgggcgtgcagggcggcagagccaagagatacagcagccagagacagagacccgtgcccgagccccccgccccccccgtgcacatcagcatcatggagggccactactacgaccccctgcagttccagggccccatctacacccacggcgacagccccgcccccctgcccccccagggcatgctggtgcagcccggcatgaacctgccccaccccggcctgcacccccaccagacccccgcccccctgcccaaccccggcctgtaccccccccccgtgagcatgagccccggccagccccccccccagcagctgctggcccccacctacttcagcgcccccggcgtgatgaacttcggcaaccccagctacccctacgcccccggcgccctgcccccccccccccccccccacctgtaccccaacacccaggcccccagccaggtgtacggcggcgtgacctactacaaccccgcccagcagcaggtgcagcccaagcccagcccccccagaagaaccccccagcccgtgaccatcaagccccccccccccgaggtggtgagcagaggcagcagctag

SEQ ID NO: 75295 - DNA, 2112 bp, Artificial Sequence; identical to SEQ ID NO: 75294
  Description of Artificial Sequence: Synthetic coding sequence

SEQ ID NO: 75296 - DNA, 1926 bp, Artificial Sequence
  Description of Artificial Sequence: Synthetic coding sequence
atggccgacagaagaagacagagagccagccaggacaccgaggacgaggagagcggcgccagcggcagcgacagcggcggcagccccctgagaggcggcggcagctgcagcggcagcgccggcggcggcggcagcggcagcctgcccagccagagaggcggcagaaccggcgccctgcacctgagaagagtggagagcggcggcgccaagagcgccgaggagagcgagtgcgagagcgaggacggcatcgagggcgacgccgtgctgagcgactacgagagcgccgaggacagcgagggcgaggagggcgagtacagcgaggaggagaacagcaaggtggagctgaagagcgaggccaacgacgccgtgaacagcagcaccaaggaggagaagggcgaggagaagcccgacaccaagagcaccgtgaccggcgagagacagagcggcgacggccaggagagcaccgagcccgtggagaacaaggtgggcaagaagggccccaagcacctggacgacgacgaggacagaaagaaccccgcctacatccccagaaagggcctgttcttcgagcacgacctgagaggccagacccaggaggaggaggtgagacccaagggcagacagagaaagctgtggaaggacgagggcagatgggagcacgacaagttcagagaggacgagcaggcccccaagagcagacaggagctgatcgccctgtacggctacgacatcagaagcgcccacaaccccgacgacatcaagcccagaagaatcagaaagcccagatacggcagccccccccagagagaccccaactggaacggcgagagactgaacaagagccacagacaccagggcctgggcggcaccctgccccccagaaccttcatcaacagaaacgccgccggcaccggcagaatgagcgcccccagaaactacagcagaagcggcggcttcaaggagggcagagccggcttcagacccgtggaggccggcggccagcacggcggcagaagcggcgagaccgtgaagcacgagatcagctacagaagcagaagactggagcagaccagcgtgagagaccccagccccgaggccgacgcccccgtgctgggcagccccgagaaggaggaggccgccagcgagccccccgccgccgcccccgacgccgccccccccccccccgacagacccatcgagaagaagagctacagcagagccagaagaaccagaaccaaggtgggcgacgccgtgaagctggccgaggaggtgccccccccccccgagggcctgatccccgccccccccgtgcccgagaccacccccaccccccccaccaagaccggcacctgggaggcccccgtggacagcagcaccagcggcctggagcaggacgtggcccagctgaacatcgccgagcagaactggagccccggccagcccagcttcctgcagcccagagagctgagaggcatgcccaaccacatccacatgggcgccggcccccccccccagttcaacagaatggaggagatgggcgtgcagggcggcagagccaagagatacagcagccagagacagagacccgtgcccgagccccccgccccccccgtgcacatcagcatcatggagggccactactacgaccccctgcagttccagggccccatctacacccacggcgacagccccgcccccctgcccccccagggcatgctggtgcagcccggcatgaacctgccccaccccggcctgcacccccaccagacccccgcctgccccgacagccagaccctgagacactgcgagagctgcctgtgctggagcaccgtgttcagctgcaaggacttcagcatgtgcggcggcgtgttctgctactgcttcaagggctgccccttcgtgatcagcatcgtgacctggagatag

SEQ ID NO: 75297 - DNA, 543 bp, Artificial Sequence
  Description of Artificial Sequence: Synthetic coding sequence
atgcaggccgagggcagaggcaccggcggcagcaccggcgacgccgacggccccggcggccccggcatccccgacggccccggcggcaacgccggcggccccggcgaggccggcgccaccggcggcagaggccccagaggcgccggcgccgccagagccagcggccccggcggcggcgcccccagaggcccccacggcggcgccgccagcggcctgaacggctgctgcagatgcggcgccagaggccccgagagcagactgctggagttctacctggccatgcccttcgccacccccatggaggccgagctggccagaagaagcctggcccaggacgccccccccctgcccgtgcccggcgtgctgctgaaggagttcaccgtgagcggcaacatcctgaccatcagactgaccgccgccgaccacagacagctgcagctgagcatcagcagctgcctgcagcagctgagcctgctgatgtggatcacccagtgcttcctgcccgtgttcctggcccagccccccagcggccagagaagatag

SEQ ID NO: 75298 - DNA, 570 bp, Artificial Sequence
  Description of Artificial Sequence: Synthetic coding sequence
atgaccgacaagaccgagaaggtggccgtggaccccgagaccgtgttcaagagacccagagagtgcgacagccccagctaccagaagagacagagaatggccctgctggccagaaagcagggcgccggcgacagcctgatcgccggcagcgccatgagcaaggccaagaagctgatgaccggccacgccatcccccccagccagctggacagccagatcgacgacttcaccggcttcagcaaggacagaatgatgcagaagcccggcagcaacgcccccgtgggcggcaacgtgaccagcagcttcagcggcgacgacctggagtgcagagagaccgccagcagccccaagagccagagagagatcaacgccgacatcaagagaaagctggtgaaggagctgagatgcgtgggccagaagtacgagaagatcttcgagatgctggagggcgtgcagggccccaccgccgtgagaaagagattcttcgagagcatcatcaaggaggccgccagatgcatgagaagagacttcgtgaagcacctgaagaagaagctgaagagaatgatctag

SEQ ID NO: 75299 - DNA, 570 bp, Artificial Sequence
  Description of Artificial Sequence: Synthetic coding sequence
atgaccgacaagaccgagaaggtggccgtggaccccgagaccgtgttcaagagacccagagagtgcgacagccccagctaccagaagagacagagaatggccctgctggccagaaagcagggcgccggcgacagcctgatcgccggcagcgccatgagcaaggagaagaagctgatgaccggccacgccatcccccccagccagctggacagccagatcgacgacttcaccggcttcagcaaggacagaatgatgcagaagcccggcagcaacgcccccgtgggcggcaacgtgaccagcagcttcagcggcgacgacctggagtgcagagagaccgccagcagccccaagagccagcaggagatcaacgccgacatcaagagaaagctggtgaaggagctgagatgcgtgggccagaagtacgagaagatcttcgagatgctggagggcgtgcagggccccaccgccgtgagaaagagattcttcgagagcatcatcaaggaggccgccagatgcatgagaagagacttcgtgaagcacctgaagaagaagctgaagagaatgatctag

SEQ ID NO: 75300 - DNA, 570 bp, Artificial Sequence; identical to SEQ ID NO: 75299
  Description of Artificial Sequence: Synthetic coding sequence

SEQ ID NO: 75301 - DNA, 570 bp, Artificial Sequence
  Description of Artificial Sequence: Synthetic coding sequence
atgaccgacaagaccgagaaggtggccgtggaccccgagaccgtgttcaagagacccagagagtgcgacagccccagctaccagaagagacagagaatggccctgctggccagaaagcagggcgccggcgacagcctgatcgccggcagcgccatgagcaaggagaagaagctgatgaccggccacgccatcccccccagccagctggacagccagatcgacgacttcaccggcttcagcaaggacagaatgatgcagaagcccggcagcaacgcccccgtgggcggcaacgtgaccagcagcttcagcggcgacgacctggagtgcagagagaccgccagcagccccaagagccagagagagatcaacgccgacatcaagagaaagctggtgaaggagctgagatgcgtgggccagaagtacgagaagatcttcgagatgctggagggcgtgcagggccccaccgccgtgagaaagagattcttcgagagcatcatcaaggaggccgccagatgcatgagaagagacttcgtgaagcacctgaagaagaagctgaagagaatgatctag

SEQ ID NO: 75302 - DNA, 570 bp, Artificial Sequence; identical to SEQ ID NO: 75301
  Description of Artificial Sequence: Synthetic coding sequence

SEQ ID NO: 75303 - DNA, 570 bp, Artificial Sequence; identical to SEQ ID NO: 75299
  Description of Artificial Sequence: Synthetic coding sequence

SEQ ID NO: 75304 - DNA, 570 bp, Artificial Sequence
  Description of Artificial Sequence: Synthetic coding sequence
atgaccgacaagaccgagaaggtggccgtggaccccgagaccgtgttcaagagacccagagagtgcgacagccccagctaccagaagagacagagaatggccctgctggccagaaagcagggcgccggcgacagcctgatcgccggcagcgccatgagcaaggccaagaagctgatgaccggccacgccatcccccccagccagctggacagccagatcgacgacttcaccggcttcagcaaggacagaatgatgcagaagcccggcagcaacgcccccgtgggcggcaacgtgaccagcagcttcagcggcgacgacctggagtgcagagagaccgccagcagccccaagagccagcaggagatcaacgccgacatcaagagaaagctggtgaaggagctgagatgcgtgggccagaagtacgagaagatcttcgagatgctggagggcgtgcagggccccaccgccgtgagaaagagattcttcgagagcatcatcaaggaggccgccagatgcatgagaagagacttcgtgaagcacctgaagaagaagctgaagagaatgatctag

SEQ ID NO: 75305 - DNA, 570 bp, Artificial Sequence; identical to SEQ ID NO: 75304
  Description of Artificial Sequence: Synthetic coding sequence

SEQ ID NO: 75306 - DNA, 570 bp, Artificial Sequence
  Description of Artificial Sequence: Synthetic coding sequence
atgaccgacaagaccgagaaggtggccgtggaccccgagaccgtgttcaagagacccagagagtgcgacagccccagctaccagaagagacagagaatggccctgctggccagaaagcagggcgccggcgacagcctgatcgccggcagcgccatgagcaaggagaagaagctgatgaccggccacgccatcccccccagccagctggacagccagatcgacgacttcaccggcttcagcaaggacggcatgatgcagaagcccggcagcaacgcccccgtgggcggcaacgtgaccagcaacttcagcggcgacgacctggagtgcagaggcatcgccagcagccccaagagccagcaggagatcaacgccgacatcaagtgccaggtggtgaaggagatcagatgcctgggcagaaagtacgagaagatcttcgagatgctggagggcgtgcagggccccaccgccgtgagaaagagattcttcgagagcatcatcaaggaggccgccagatgcatgagaagagacttcgtgaagcacctgaagaagaagctgaagagaatgatctag

SEQ ID NO: 75307 - DNA, 570 bp, Artificial Sequence; identical to SEQ ID NO: 75306
  Description of Artificial Sequence: Synthetic coding sequence

SEQ ID NO: 75308 - DNA, 570 bp, Artificial Sequence; identical to SEQ ID NO: 75304
  Description of Artificial Sequence: Synthetic coding sequence

SEQ ID NO: 75309 - DNA, 570 bp, Artificial Sequence; identical to SEQ ID NO: 75304
  Description of Artificial Sequence: Synthetic coding sequence

SEQ ID NO: 75310 - DNA, 867 bp, Artificial Sequence
  Description of Artificial Sequence: Synthetic coding sequence
atgagcgccaccggcgacagacaccccacccagggcgaccaggaggcccccgtgagccaggagggcgcccaggccgaggccgccggcgccggcaaccaggagggcggcgacagcggccccgacagcagcgacgtggtgcccgccgccgaggtggtgggcgtggccggccccgtggagggcctgggcgaggaggagggcgagcaggccgccggcctggccgccgtgcccagaggcggcagcgccgaggaggacagcgacatcggccccgccaccgaggaggaggaggaggaggagggcaacgaggccgccaacttcgacctggccgtggtggccagaagataccccgccagcggcatccacttcgtgctgctggacatggtgcacagcctgctgcacagactgagccacaacgaccacatcctgatcgagaacagacagctgagcagactgatggtgggcccccacgccgccgccagaaacctgtggggcaacctgccccccctgctgctgccccagagactgggcgccggcgccgccgccagagccggcgagggcctgggcctgatccaggaggccgccagcgtgcccgagcccgccgtgcccgccgacctggccgagatggccagagagcccgccgaggaggccgccgaggagaagctgagcgaggaggccaccgaggagcccgacgccgaggagcccgccaccgaggagcccaccgcccaggaggccaccgcccccgaggaggtgaccaagagccagcccgagaagtgggacgaggaggcccaggacgccgccggcgaggaggagaaggagcaggagaaggagaaggacgccgagaacaaggtgaagaacagcaagggcacctag

SEQ ID NO: 75311 - DNA, 867 bp, Artificial Sequence; identical to SEQ ID NO: 75310
  Description of Artificial Sequence: Synthetic coding sequence

SEQ ID NO: 75312 - DNA, 867 bp, Artificial Sequence; identical to SEQ ID NO: 75310
  Description of Artificial Sequence: Synthetic coding sequence

SEQ ID NO: 75313 - DNA, 867 bp, Artificial Sequence; identical to SEQ ID NO: 75310
  Description of Artificial Sequence: Synthetic coding sequence

SEQ ID NO: 75314 - DNA, 867 bp, Artificial Sequence; identical to SEQ ID NO: 75310
  Description of Artificial Sequence: Synthetic coding sequence

SEQ ID NO: 75315 - DNA, 867 bp, Artificial Sequence; identical to SEQ ID NO: 75310
  Description of Artificial Sequence: Synthetic coding sequence

SEQ ID NO: 75316 - DNA, 867 bp, Artificial Sequence; identical to SEQ ID NO: 75310
  Description of Artificial Sequence: Synthetic coding sequence

SEQ ID NO: 75317 - DNA, 867 bp, Artificial Sequence; identical to SEQ ID NO: 75310
  Description of Artificial Sequence: Synthetic coding sequence

SEQ ID NO: 75318 - DNA, 867 bp, Artificial Sequence; identical to SEQ ID NO: 75310
  Description of Artificial Sequence: Synthetic coding sequence

SEQ ID NO: 75319 - DNA, 867 bp, Artificial Sequence; identical to SEQ ID NO: 75310
  Description of Artificial Sequence: Synthetic coding sequence

SEQ ID NO: 75320 - DNA, 867 bp, Artificial Sequence; identical to SEQ ID NO: 75310
  Description of Artificial Sequence: Synthetic coding sequence

SEQ ID NO: 75321 - DNA, 867 bp, Artificial Sequence; identical to SEQ ID NO: 75310
  Description of Artificial Sequence: Synthetic coding sequence

SEQ ID NO: 75322 - DNA, 867 bp, Artificial Sequence; identical to SEQ ID NO: 75310
  Description of Artificial Sequence: Synthetic coding sequence

SEQ ID NO: 75323 - DNA, 867 bp, Artificial Sequence; identical to SEQ ID NO: 75310
  Description of Artificial Sequence: Synthetic coding sequence

SEQ ID NO: 75324 - DNA, 900 bp, Artificial Sequence
  Description of Artificial Sequence: Synthetic coding sequence
atgagcgccaccggcgacagacaccccacccagggcgaccaggaggcccccgtgagccaggagggcgcccaggccgaggccgccggcgccggcaaccaggagggcggcgacagcggccccgacagcagcgacatggtgcccgccgccgaggtggtgggcgtggccggccccgtggagggcctgggcgaggaggagggcgagcaggccgccggcctggccgccgtgccccagggcggcagcgccgaggaggacagcgacatcggccccgccaccgaggaggaggaggaggaggaggagggcaacgaggccgccaacttcgacctggccgtggccaccagaagataccccgccgccggcatcggcttcgtgttcctgtacctggtgcacagcctgctgagaagactgtaccacaacgaccacatccagatcgccaacagacacctgagcagactgatggtgggcccccacgccgccgtgcccaacctgtgggacaacccccccctgctgctgctgagccagagactgggcgccggcgccgccgcccccgagggcgagggcctgggcctgatccaggaggccgccagcgtgcaggaggccgccagcgtgcccgagcccgccgtgcccgccgacctggccgagatggccagagagcccgccgaggaggccgccgacgagaagccccccgaggaggccgccgaggagaagctgaccgaggaggccaccgaggagcccgccgccgaggagcccaccagcgaggaggccgtggcccccgaggaggtgaccaagagccagcccgagaagtgggacgaggaggcccaggacgccgccggcgaggaggagaaggagcaggagaaggagaaggacgtggagaacaaggtgaagaacagcaagggcacctag

SEQ ID NO: 75325 - DNA, 1419 bp, Artificial Sequence
  Description of Artificial Sequence: Synthetic coding sequence
atgaagagcatcctggacggcctggccgacaccaccttcagaaccatcaccaccgacctgctgtacgtgggcagcaacgacatccagtacgaggacatcaagggcgacatggccagcaagctgggctacttcccccagaagttccccctgaccagcttcagaggcagccccttccaggagaagatgaccgccggcgacaacccccagctggtgcccgccgaccaggtgaacatcaccgagttctacaacaagagcctgagcagcttcaaggagaacgaggagaacatccagtgcggcgagaacttcatggacatcgagtgcttcatggtgctgaaccccagccagcagctggccatcgccgtgctgagcctgaccctgggcaccttcaccgtgctggagaacctgctggtgctgtgcgtgatcctgcacagcagaagcctgagatgcagacccagctaccacttcatcggcagcctggccgtggccgacctgctgggcagcgtgatcttcgtgtacagcttcatcgacttccacgtgttccacagaaaggacagcagaaacgtgttcctgttcaagctgggcggcgtgaccgccagcttcaccgccagcgtgggcagcctgttcctgaccgccatcgacagatacatcagcatccacagacccctggcctacaagagaatcgtgaccagacccaaggccgtggtggccttctgcctgatgtggaccatcgccatcgtgatcgccgtgctgcccctgctgggctggaactgcgagaagctgcagagcgtgtgcagcgacatcttcccccacatcgacgagacctacctgatgttctggatcggcgtgaccagcgtgctgctgctgttcatcgtgtacgcctacatgtacatcctgtggaaggcccacagccacgccgtgagaatgatccagagaggcacccagaagagcatcatcatccacaccagcgaggacggcaaggtgcaggtgaccagacccgaccaggccagaatggacatcagactggccaagaccctggtgctgatcctggtggtgctgatcatctgctggggccccctgctggccatcatggtgtacgacgtgttcggcaagatgaacaagctgatcaagaccgtgttcgccttctgcagcatgctgtgcctgctgaacagcaccgtgaaccccatcatctacgccctgagaagcaaggacctgagacacgccttcagaagcatgttccccagctgcgagggcaccgcccagcccctggacaacagcatgggcgacagcgactgcctgcacaagcacgccaacaacgccgccagcgtgcacagagccgccgagagctgcatcaagagcaccgtgaagatcgccaaggtgaccatgagcgtgagcaccgacaccagcgccgaggccctgtag

SEQ ID NO: 75326 - DNA, 1419 bp, Artificial Sequence; identical to SEQ ID NO: 75325
  Description of Artificial Sequence: Synthetic coding sequence

SEQ ID NO: 75327 - DNA, 1419 bp, Artificial Sequence; identical to SEQ ID NO: 75325
  Description of Artificial Sequence: Synthetic coding sequence

SEQ ID NO: 75328 - DNA, 1320 bp, Artificial Sequence
  Description of Artificial Sequence: Synthetic coding sequence
atgaagagcatcctggacggcctggccgacaccaccttcagaaccatcaccaccgacctgctgggcagccccttccaggagaagatgaccgccggcgacaacccccagctggtgcccgccgaccaggtgaacatcaccgagttctacaacaagagcctgagcagcttcaaggagaacgaggagaacatccagtgcggcgagaacttcatggacatcgagtgcttcatggtgctgaaccccagccagcagctggccatcgccgtgctgagcctgaccctgggcaccttcaccgtgctggagaacctgctggtgctgtgcgtgatcctgcacagcagaagcctgagatgcagacccagctaccacttcatcggcagcctggccgtggccgacctgctgggcagcgtgatcttcgtgtacagcttcatcgacttccacgtgttccacagaaaggacagcagaaacgtgttcctgttcaagctgggcggcgtgaccgccagcttcaccgccagcgtgggcagcctgttcctgaccgccatcgacagatacatcagcatccacagacccctggcctacaagagaatcgtgaccagacccaaggccgtggtggccttctgcctgatgtggaccatcgccatcgtgatcgccgtgctgcccctgctgggctggaactgcgagaagctgcagagcgtgtgcagcgacatcttcccccacatcgacgagacctacctgatgttctggatcggcgtgaccagcgtgctgctgctgttcatcgtgtacgcctacatgtacatcctgtggaaggcccacagccacgccgtgagaatgatccagagaggcacccagaagagcatcatcatccacaccagcgaggacggcaaggtgcaggtgaccagacccgaccaggccagaatggacatcagactggccaagaccctggtgctgatcctggtggtgctgatcatctgctggggccccctgctggccatcatggtgtacgacgtgttcggcaagatgaacaagctgatcaagaccgtgttcgccttctgcagcatgctgtgcctgctgaacagcaccgtgaaccccatcatctacgccctgagaagcaaggacctgagacacgccttcagaagcatgttccccagctgcgagggcaccgcccagcccctggacaacagcatgggcgacagcgactgcctgcacaagcacgccaacaacgccgccagcgtgcacagagccgccgagagctgcatcaagagcaccgtgaagatcgccaaggtgaccatgagcgtgagcaccgacaccagcgccgaggccctgtag

SEQ ID NO: 75329 - DNA, 1419 bp, Artificial Sequence; identical to SEQ ID NO: 75325
  Description of Artificial Sequence: Synthetic coding sequence

SEQ ID NO: 75330 - DNA, 1419 bp, Artificial Sequence; identical to SEQ ID NO: 75325
  Description of Artificial Sequence: Synthetic coding sequence

SEQ ID NO: 75331 - DNA, 1236 bp, Artificial Sequence
  Description of Artificial Sequence: Synthetic coding sequence
atggccctgcagatcccccccagcgcccccagccccctgaccagctgcacctgggcccagatgaccttcagcaccaagaccagcaaggagaacgaggagaacatccagtgcggcgagaacttcatggacatcgagtgcttcatggtgctgaaccccagccagcagctggccatcgccgtgctgagcctgaccctgggcaccttcaccgtgctggagaacctgctggtgctgtgcgtgatcctgcacagcagaagcctgagatgcagacccagctaccacttcatcggcagcctggccgtggccgacctgctgggcagcgtgatcttcgtgtacagcttcatcgacttccacgtgttccacagaaaggacagcagaaacgtgttcctgttcaagctgggcggcgtgaccgccagcttcaccgccagcgtgggcagcctgttcctgaccgccatcgacagatacatcagcatccacagacccctggcctacaagagaatcgtgaccagacccaaggccgtggtggccttctgcctgatgtggaccatcgccatcgtgatcgccgtgctgcccctgctgggctggaactgcgagaagctgcagagcgtgtgcagcgacatcttcccccacatcgacgagacctacctgatgttctggatcggcgtgaccagcgtgctgctgctgttcatcgtgtacgcctacatgtacatcctgtggaaggcccacagccacgccgtgagaatgatccagagaggcacccagaagagcatcatcatccacaccagcgaggacggcaaggtgcaggtgaccagacccgaccaggccagaatggacatcagactggccaagaccctggtgctgatcctggtggtgctgatcatctgctggggccccctgctggccatcatggtgtacgacgtgttcggcaagatgaacaagctgatcaagaccgtgttcgccttctgcagcatgctgtgcctgctgaacagcaccgtgaaccccatcatctacgccctgagaagcaaggacctgagacacgccttcagaagcatgttccccagctgcgagggcaccgcccagcccctggacaacagcatgggcgacagcgactgcctgcacaagcacgccaacaacgccgccagcgtgcacagagccgccgagagctgcatcaagagcaccgtgaagatcgccaaggtgaccatgagcgtgagcaccgacaccagcgccgaggccctgtag

SEQ ID NO: 75332 - DNA, 1419 bp, Artificial Sequence; identical to SEQ ID NO: 75325
  Description of Artificial Sequence: Synthetic coding sequence

SEQ ID NO: 75333 - DNA, 237 bp, Artificial Sequence
  Description of Artificial Sequence: Synthetic coding sequence
atgaagagcatcctggacggcctggccgacaccaccttcagaaccatcaccaccgacctgctgtacgtgggcagcaacgacatccagtacgaggacatcaagggcgacatggccagcaagctgggctacttcccccagaagttccccctgaccagcttcagaggcagccccttccaggagaagatgaccgccggcgacaacccccagctggtgcccgccgaccaggtgaacatctag

SEQ ID NO: 75334 - DNA, 1083 bp, Artificial Sequence
  Description of Artificial Sequence: Synthetic coding sequence
atggaggagtgctgggtgaccgagatcgccaacggcagcaaggacggcctggacagcaaccccatgaaggactacatgatcctgagcggcccccagaagaccgccgtggccgtgctgtgcaccctgctgggcctgctgagcgccctggagaacgtggccgtgctgtacctgatcctgagcagccaccagctgagaagaaagcccagctacctgttcatcggcagcctggccggcgccgacttcctggccagcgtggtgttcgcctgcagcttcgtgaacttccacgtgttccacggcgtggacagcaaggccgtgttcctgctgaagatcggcagcgtgaccatgaccttcaccgccagcgtgggcagcctgctgctgaccgccatcgacagatacctgtgcctgagatacccccccagctacaaggccctgctgaccagaggcagagccctggtgaccctgggcatcatgtgggtgctgagcgccctggtgagctacctgcccctgatgggctggacctgctgccccagaccctgcagcgagctgttccccctgatccccaacgactacctgctgagctggctgctgttcatcgccttcctgttcagcggcatcatctacacctacggccacgtgctgtggaaggcccaccagcacgtggccagcctgagcggccaccaggacagacaggtgcccggcatggccagaatgagactggacgtgagactggccaagaccctgggcctggtgctggccgtgctgctgatctgctggttccccgtgctggccctgatggcccacagcctggccaccaccctgagcgaccaggtgaagaaggccttcgccttctgcagcatgctgtgcctgatcaacagcatggtgaaccccgtgatctacgccctgagaagcggcgagatcagaagcagcgcccaccactgcctggcccactggaagaagtgcgtgagaggcctgggcagcgaggccaaggaggaggcccccagaagcagcgtgaccgagaccgaggccgacggcaagatcaccccctggcccgacagcagagacctggacctgagcgactgctag

SEQ ID NO: 75335 - DNA, 1083 bp, Artificial Sequence; identical to SEQ ID NO: 75334
  Description of Artificial Sequence: Synthetic coding sequence

SEQ ID NO: 75336 - DNA, 837 bp, Artificial Sequence
  Description of Artificial Sequence: Synthetic coding sequence
atggacagcatgcccgagcccgccagcagatgcctgctgctgctgcccctgctgctgctgctgctgctgctgctgcccgcccccgagctgggccccagccaggccggcgccgaggagaacgactgggtgagactgcccagcaagtgcgaggtgtgcaagtacgtggccgtggagctgaagagcgccttcgaggagaccggcaagaccaaggaggtgatcggcaccggctacggcatcctggaccagaaggccagcggcgtgaagtacaccaagagcgacctgagactgatcgaggtgaccgagaccatctgcaagagactgctggactacagcctgcacaaggagagaaccggcagcaacagattcgccaagggcatgagcgagaccttcgagaccctgcacaacctggtgcacaagggcgtgaaggtggtgatggacatcccctacgagctgtggaacgagaccagcgccgaggtggccgacctgaagaagcagtgcgacgtgctggtggaggagttcgaggaggtgatcgaggactggtacagaaaccaccaggaggaggacctgaccgagttcctgtgcgccaaccacgtgctgaagggcaaggacaccagctgcctggccgagcagtggagcggcaagaagggcgacaccgccgccctgggcggcaagaagagcaagaagaagagcagcagagccaaggccgccggcggcagaagcagcagcagcaagcagagaaaggagctgggcggcctggagggcgaccccagccccgaggaggacgagggcatccagaaggccagccccctgacccacagcccccccgacgagctgtag

SEQ ID NO: 75337 - DNA, 165 bp, Artificial Sequence
  Description of Artificial Sequence: Synthetic coding sequence
atggacagcatgcccgagcccgccagcagatgcctgctgctgctgcccctgctgctgctgctgctgctgctgctgcccgcccccgagctgggccccagccaggccggcgccgaggagaacgactgggtgagactgcccagcaagtgcgagggcacctgcggctag

SEQ ID NO: 75338 - DNA, 747 bp, Artificial Sequence
  Description of Artificial Sequence: Synthetic coding sequence
atgggccccgtgagactgggcatcctgctgttcctgttcctggccgtgcacgaggcctgggccggcatgctgaaggaggaggacgacgacaccgagagactgcccagcaagtgcgaggtgtgcaagctgctgagcaccgagctgcaggccgagctgagcagaaccggcagaagcagagaggtgctggagctgggccaggtgctggacaccggcaagagaaagagacacgtgccctacagcgtgagcgagaccagactggaggaggccctggagaacctgtgcgagagaatcctggactacagcgtgcacgccgagagaaagggcagcctgagatacgccaagggccagagccagaccatggccaccctgaagggcctggtgcagaagggcgtgaaggtggacctgggcatccccctggagctgtgggacgagcccagcgtggaggtgacctacctgaagaagcagtgcgagaccatgctggaggagttcgaggacatcgtgggcgactggtacttccaccaccaggagcagcccctgcagaacttcctgtgcgagggccacgtgctgcccgccgccgagaccgcctgcctgcaggagacctggaccggcaaggagatcaccgacggcgaggagaagaccgagggcgaggaggagcaggaggaggaggaggaggaggaggaggaggagggcggcgacaagatgaccaagaccggcagccaccccaagctggacagagaggacctgtag

SEQ ID NO: 75339 - DNA, 798 bp, Artificial Sequence
  Description of Artificial Sequence: Synthetic coding sequence
atgagagaggagatgagcctgggctgccaggaggccttcgagatcttcaagagagaccacgccgacagcgtgaccatcgacgacaacaagcagatcctgaagcagagattcagcgaggccaaggccctgggcgagagcatcaacgaggccagaagcaagatcggccacctgaaggaggagatcacccagagacacatccagcaggtggccctgggcatcagcgagaacatggccgtgcccctgatgcccgaccagcaggaggagaagctgagaagccagctggaggaggagaagagaagatacaagaccatgttcaccagactgaaggccctgaaggtggagatcgagcacctgcagctgctgatggacaaggccaaggtgaagctgcagaaggagttcgaggtgtggtgggccgaggaggccaccaacctgcaggtgaacagccccgccgtgaacagcctggaccacaccaagcccttcctgcagaccagcgacagccagcacgagtggagccagctgctgagcaacaagagcagcggcggctgggaggtgcaggaccagggcaccggcagattcgacgtgtgcgacgtgaacgccagaaagatcctgcccagcccctgccccagcccccacagccagaagcagagcagcaccagcacccccctggaggacagcatccccaagagacccgtgagcagcatccccctgaccggcgacagccagaccgacagcgacatcatcgccttcatcaaggccagacagagcatcctgcagaagcagtgcctgggcagcaactag

SEQ ID NO: 75340 - DNA, 1185 bp, Artificial Sequence
  Description of Artificial Sequence: Synthetic coding sequence
atggccaacatgcagggcctggtggagagactggagagagccgtgagcagactggagagcctgagcgccgagagccacagaccccccggcaactgcggcgaggtgaacggcgtgatcgccggcgtggcccccagcgtggaggccttcgacaagctgatggacagcatggtggccgagttcctgaagaacagcagaatcctggccggcgacgtggagacccacgccgagatggtgcacagcgccttccaggcccagagagccttcctgctgatggccagccagtaccagcagccccacgagaacgacgtggccgccctgctgaagcccatcagcgagaagatccaggagatccagaccttcagagagagaaacagaggcagcaacatgttcaaccacctgagcgccgtgagcgagagcatccccgccctgggctggatcgccgtgagccccaagcccccccccctgcccccccccggccccccccccctgttcgagaacgagggcaagaaggaggagagcagccccagcagaagcgccctgttcgcccagctgaaccagggcgaggccatcaccaagggcctgagacacgtgaccgacgaccagaagacctacaagaaccccagcctgagagcccagggcggccagacccagagccccaccaagagccacacccccagccccaccagccccaagagctaccccagccagaagcacgcccccgtgctggagctggagggcaagaagtggagagtggagtaccaggaggacagaaacgacctggtgatcagcgagaccgagctgaagcaggtggcctacatcttcaagtgcgagaagagcaccatccagatcaagggcaaggtgaacagcatcatcatcgacaactgcaagaagctgggcctggtgttcgacaacgtggtgggcatcgtggaggtgatcaacagccaggacatccagatccaggtgatgggcagagtgcccaccatcagcatcaacaagaccgagggctgccacatctacctgagcgaggacgccctggactgcgagatcgtgagcgccaagagcagcgagatgaacatcctgatcccccaggacggcgactacagagagttccccatccccgagcagttcaagaccgcctgggacggcagcaagctgatcaccgagcccgccgagatcatggcctag

SEQ ID NO: 75341 - DNA, 597 bp, Artificial Sequence
  Description of Artificial Sequence: Synthetic coding sequence
atgaagctgtacagcctgagcgtgctgtacaagggcgaggccaaggtggtgctgctgaaggccgcctacgacgtgagcagcttcagcttcttccagagaagcagcgtgcaggagttcatgaccttcaccagccagctgatcgtggagagaagcagcaagggcaccagagccagcgtgaaggagcaggactacctgtgccacgtgtacgtgagaaacgacagcctggccggcgtggtgatcgccgacaacgagtaccccagcagagtggccttcaccctgctggagaaggtgctggacgagttcagcaagcaggtggacagaatcgactggcccgtgggcagccccgccaccatccactaccccgccctggacggccacctgagcagataccagaaccccagagaggccgaccccatgaccaaggtgcaggccgagctggacgagaccaagatcatcctgcacaacaccatggagagcctgctggagagaggcgagaagctggacgacctggtgagcaagagcgaggtgctgggcacccagagcaaggccttctacaagaccgccagaaagcagaacagctgctgcgccatcatgtag

SEQ ID NO: 75342 - DNA, 3036 bp, Artificial Sequence
  Description of Artificial Sequence: Synthetic coding sequence
atgcagaagcccagcggcctgaagccccccggcagaggcggcaagcacagcagccccatgggcagaaccagcaccggcagcgccagcagcagcgccgccgtggccgccagcagcaaggagggcagccccctgcacaagcagagcagcggccccagcagcagccccgccgccgccgccgcccccgagaagcccggccccaaggccgccgaggtgggcgacgacttcctgggcgacttcgtggtgggcgagagagtgtgggtgaacggcgtgaagcccggcgtggtgcagtacctgggcgagacccagttcgcccccggccagtgggccggcgtggtgctggacgaccccgtgggcaagaacgacggcgccgtgggcggcgtgagatacttcgagtgccccgccctgcagggcatcttcaccagacccagcaagctgaccagacagcccaccgccgagggcagcggcagcgacgcccacagcgtggagagcctgaccgcccagaacctgagcctgcacagcggcaccgccaccccccccctgaccagcagagtgatccccctgagagagagcgtgctgaacagcagcgtgaagaccggcaacgagagcggcagcaacctgagcgacagcggcagcgtgaagagaggcgagaaggacctgagactgggcgacagagtgctggtgggcggcaccaagaccggcgtggtgagatacgtgggcgagaccgacttcgccaagggcgagtggtgcggcgtggagctggacgagcccctgggcaagaacgacggcgccgtggccggcaccagatacttccagtgcccccccaagttcggcctgttcgcccccatccacaaggtgatcagaatcggcttccccagcaccagccccgccaaggccaagaagaccaagagaatggccatgggcgtgagcgccctgacccacagccccagcagcagcagcatcagcagcgtgagcagcgtggccagcagcgtgggcggcagacccagcagaagcggcctgctgaccgagaccagcagcagatacgccagaaagatcagcggcaccaccgccctgcaggaggccctgaaggagaagcagcagcacatcgagcagctgctggccgagagagacctggagagagccgaggtggccaaggccaccagccacatctgcgaggtggagaaggagatcgccctgctgaaggcccagcacgagcagtacgtggccgaggccgaggagaagctgcagagagccagactgctggtggagagcgtgagaaaggagaaggtggacctgagcaaccagctggaggaggagagaagaaaggtggaggacctgcagttcagagtggaggaggagagcatcaccaagggcgacctggagctgaccaccgtggccgagaagagcagagtgctgcagctggaggaggagctgaccctgagaagaggcgagatcgaggagctgcagcagtgcctgctgcacagcggcccccccccccccgaccaccccgacgccgccgagatcctgagactgagagagagactgctgagcgccagcaaggagcaccagagagagagcggcgtgctgagagacaagtacgagaaggccctgaaggcctaccaggccgaggtggacaagctgagagccgccaacgagaagtacgcccaggaggtggccggcctgaaggacaaggtgcagcaggccaccagcgagaacatgggcctgatggacaactggaagagcaagctggacagcctggccagcgaccaccagaagagcctggaggacctgaaggccaccctgaacagcggccccggcgcccagcagaaggagatcggcgagctgaaggccgtgatggagggcatcaagatggagcaccagctggagctgggcaacctgcaggccaagcacgacctggagaccgccatgcacgtgaaggagaaggaggccctgagagagaagctgcaggaggcccaggaggagctggccggcctgcagagacactggagagcccagctggaggtgcaggccagccagcacagactggagctgcaggaggcccaggaccagagaagagacgccgagctgagagtgcacgagctggagaagctggacgtggagtacagaggccaggcccaggccatcgagttcctgaaggagcagatcagcctggccgagaagaagatgctggactacgagagactgcagagagccgaggcccagggcaagcaggaggtggagagcctgagagagaagctgctggtggccgagaacagactgcaggccgtggaggccctgtgcagcagccagcacacccacatgatcgagagcaacgacatcagcgaggagaccatcagaaccaaggagaccgtggagggcctgcaggacaagctgaacaagagagacaaggaggtgaccgccctgaccagccagaccgagatgctgagagcccaggtgagcgccctggagagcaagtgcaagagcggcgagaagaaggtggacgccctgctgaaggagaagagaagactggaggccgagctggagaccgtgagcagaaagacccacgacgccagcggccagctggtgctgatcagccaggagctgctgagaaaggagagaagcctgaacgagctgagagtgctgctgctggaggccaacagacacagccccggccccgagagagacctgagcagagaggtgcacaaggccgagtggagaatcaaggagcagaagctgaaggacgacatcagaggcctgagagagaagctgaccggcctggacaaggagaagagcctgagcgaccagagaagatacagcctgatcgacagaagcagcgcccccgagctgctgagactgcagcaccagctgatgagcaccgaggacgccctgagagacgccctggaccaggcccagcaggtggagaagctgatggaggccatgagaagctgccccgacaaggcccagaccatcggcaacagcggcagcgccaacggcatccaccagcaggacaaggcccagaagcaggaggacaagcactag

SEQ ID NO: 75343 - DNA, 3141 bp, Artificial Sequence
  Description of Artificial Sequence: Synthetic coding sequence
atgcagaagcccagcggcctgaagccccccggcagaggcggcaagcacagcagccccatgggcagaaccagcaccggcagcgccagcagcagcgccgccgtggccgccagcagcaaggagggcagccccctgcacaagcagagcagcggccccagcagcagccccgccgccgccgccgcccccgagaagcccggccccaaggccgccgaggtgggcgacgacttcctgggcgacttcgtggtgggcgagagagtgtgggtgaacggcgtgaagcccggcgtggtgcagtacctgggcgagacccagttcgcccccggccagtgggccggcgtggtgctggacgaccccgtgggcaagaacgacggcgccgtgggcggcgtgagatacttcgagtgccccgccctgcagggcatcttcaccagacccagcaagctgaccagacagcccaccgccgagggcagcggcagcgacgcccacagcgtggagagcctgaccgcccagaacctgagcctgcacagcggcaccgccaccccccccctgaccagcagagtgatccccctgagagagagcgtgctgaacagcagcgtgaagaccggcaacgagagcggcagcaacctgagcgacagcggcagcgtgaagagaggcgagaaggacctgagactgggcgacagagtgctggtgggcggcaccaagaccggcgtggtgagatacgtgggcgagaccgacttcgccaagggcgagtggtgcggcgtggagctggacgagcccctgggcaagaacgacggcgccgtggccggcaccagatacttccagtgcccccccaagttcggcctgttcgcccccatccacaaggtgatcagaatcggcttccccagcaccagccccgccaaggccaagaagaccaagagaatggccatgggcgtgagcgccctgacccacagccccagcagcagcagcatcagcagcgtgagcagcgtggccagcagcgtgggcggcagacccagcagaagcggcctgctgaccgagaccagcagcagatacgccagaaagatcagcggcaccaccgccctgcaggaggccctgaaggagaagcagcagcacatcgagcagctgctggccgagagagacctggagagagccgaggtggccaaggccaccagccacatctgcgaggtggagaaggagatcgccctgctgaaggcccagcacgagcagtacgtggccgaggccgaggagaagctgcagagagccagactgctggtggagagcgtgagaaaggagaaggtggacctgagcaaccagctggaggaggagagaagaaaggtggaggacctgcagttcagagtggaggaggagagcatcaccaagggcgacctggagacccagacccagctggagcacgccagaatcggcgagctggagcagagcctgctgctggagaaggcccaggccgagagactgctgagagagctggccgacaacagactgaccaccgtggccgagaagagcagagtgctgcagctggaggaggagctgaccctgagaagaggcgagatcgaggagctgcagcagtgcctgctgcacagcggcccccccccccccgaccaccccgacgccgccgagatcctgagactgagagagagactgctgagcgccagcaaggagcaccagagagagagcggcgtgctgagagacaagtacgagaaggccctgaaggcctaccaggccgaggtggacaagctgagagccgccaacgagaagtacgcccaggaggtggccggcctgaaggacaaggtgcagcaggccaccagcgagaacatgggcctgatggacaactggaagagcaagctggacagcctggccagcgaccaccagaagagcctggaggacctgaaggccaccctgaacagcggccccggcgcccagcagaaggagatcggcgagctgaaggccgtgatggagggcatcaagatggagcaccagctggagctgggcaacctgcaggccaagcacgacctggagaccgccatgcacgtgaaggagaaggaggccctgagagagaagctgcaggaggcccaggaggagctggccggcctgcagagacactggagagcccagctggaggtgcaggccagccagcacagactggagctgcaggaggcccaggaccagagaagagacgccgagctgagagtgcacgagctggagaagctggacgtggagtacagaggccaggcccaggccatcgagttcctgaaggagcagatcagcctggccgagaagaagatgctggactacgagagactgcagagagccgaggcccagggcaagcaggaggtggagagcctgagagagaagctgctggtggccgagaacagactgcaggccgtggaggccctgtgcagcagccagcacacccacatgatcgagagcaacgacatcagcgaggagaccatcagaaccaaggagaccgtggagggcctgcaggacaagctgaacaagagagacaaggaggtgaccgccctgaccagccagaccgagatgctgagagcccaggtgagcgccctggagagcaagtgcaagagcggcgagaagaaggtggacgccctgctgaaggagaagagaagactggaggccgagctggagaccgtgagcagaaagacccacgacgccagcggccagctggtgctgatcagccaggagctgctgagaaaggagagaagcctgaacgagctgagagtgctgctgctggaggccaacagacacagccccggccccgagagagacctgagcagagaggtgcacaaggccgagtggagaatcaaggagcagaagctgaaggacgacatcagaggcctgagagagaagctgaccggcctggacaaggagaagagcctgagcgaccagagaagatacagcctgatcgacagaagcagcgcccccgagctgctgagactgcagcaccagctgatgagcaccgaggacgccctgagagacgccctggaccaggcccagcaggtggagaagctgatggaggccatgagaagctgccccgacaaggcccagaccatcggcaacagcggcagcgccaacggcatccaccagcaggacaaggcccagaagcaggaggacaagcactag

SEQ ID NO: 75344 - DNA, 153 bp, Artificial Sequence
  Description of Artificial Sequence: Synthetic coding sequence
ctggaggaggagagaagaaaggtggaggacctgcagttcagagtggaggaggagagcatcaccaagggcgacctggaggccgaggaccacctgagccccgagcccagcatgctgaccaccgtggccgagaagagcagagtgctgcagctgtag

SEQ ID NO: 75345 - DNA, 3141 bp, Artificial Sequence
  Description of Artificial Sequence: Synthetic coding sequence
atgcagaagcccagcggcctgaagccccccggcagaggcggcaagcacagcagccccatgggcagaaccagcaccggcagcgccagcagcagcgccgccgtggccgccagcagcaaggagggcagccccctgcacaagcagagcagcggccccagcagcagccccgccgccgccgccgcccccgagaagcccggccccaaggccgccgaggtgggcgacgacttcctgggcgacttcgtggtgggcgagagagtgtgggtgaacggcgtgaagcccggcgtggtgcagtacctgggcgagacccagttcgcccccggccagtgggccggcgtggtgctggacgaccccgtgggcaagaacgacggcgccgtgggcggcgtgagatacttcgagtgccccgccctgcagggcatcttcaccagacccagcaagctgaccagacagcccaccgccgagggcagcggcagcgacgcccacagcgtggagagcctgaccgcccagaacctgagcctgcacagcggcaccgccaccccccccctgaccagcagagtgatccccctgagagagagcgtgctgaacagcagcgtgaagaccggcaacgagagcggcagcaacctgagcgacagcggcagcgtgaagagaggcgagaaggacctgagactgggcgacagagtgctggtgggcggcaccaagaccggcgtggtgagatacgtgggcgagaccgacttcgccaagggcgagtggtgcggcgtggagctggacgagcccctgggcaagaacgacggcgccgtggccggcaccagatacttccagtgcccccccaagttcggcctgttcgcccccatccacaaggtgatcagaatcggcttccccagcaccagccccgccaaggccaagaagaccaagagaatggccatgggcgtgagcgccctgacccacagccccagcagcagcagcatcagcagcgtgagcagcgtggccagcagcgtgggcggcagacccagcagaagcggcctgctgaccgagaccagcagcagatacgccagaaagatcagcggcaccaccgccctgcaggaggccctgaaggagaagcagcagcacatcgagcagctgctggccgagagagacctggagagagccgaggtggccaaggccaccagccacatctgcgaggtggagaaggagatcgccctgctgaaggcccagcacgagcagtacgtggccgaggccgaggagaagctgcagagagccagactgctggtggagagcgtgagaaaggagaaggtggacctgagcaaccagctggaggaggagagaagaaaggtggaggacctgcagttcagagtggaggaggagagcatcaccaagggcgacctggagacccagacccagctggagcacgccagaatcggcgagctggagcagagcctgctgctggagaaggcccaggccgagagactgctgagagagctggccgacaacagactgaccaccgtggccgagaagagcagagtgctgcagctggaggaggagctgaccctgagaagaggcgagatcgaggagctgcagcagtgcctgctgcacagcggcccccccccccccgaccaccccgacgccgccgagatcctgagactgagagagagactgctgagcgccagcaaggagcaccagagagagagcggcgtgctgagagacaagtacgagaaggccctgaaggcctaccaggccgaggtggacaagctgagagccgccaacgagaagtacgcccaggaggtggccggcctgaaggacaaggtgcagcaggccaccagcgagaacatgggcctgatggacaactggaagagcaagctggacagcctggccagcgaccaccagaagagcctggaggacctgaaggccaccctgaacagcggccccggcgcccagcagaaggagatcggcgagctgaaggccgtgatggagggcatcaagatggagcaccagctggagctgggcaacctgcaggccaagcacgacctggagaccgccatgcacgtgaaggagaaggaggccctgagagagaagctgcaggaggcccaggaggagctggccggcctgcagagacactggagagcccagctggaggtgcaggccagccagcacagactggagctgcaggaggcccaggaccagagaagagacgccgagctgagagtgcacgagctggagaagctggacgtggagtacagaggccaggcccaggccatcgagttcctgaaggagcagatcagcctggccgagaagaagatgctggactacgagagactgcagagagccgaggcccagggcaagcaggaggtggagagcctgagagagaagctgctggtggccgagaacagactgcaggccgtggaggccctgtgcagcagccagcacacccacatgatcgagagcaacgacatcagcgaggagaccatcagaaccaaggagaccgtggagggcctgcaggacaagctgaacaagagagacaaggaggtgaccgccctgaccagccagaccgagatgctgagagcccaggtgagcgccctggagagcaagtgcaagagcggcgagaagaaggtggacgccctgctgaaggagaagagaagactggaggccgagctggagaccgtgagcagaaagacccacgacgccagcggccagctggtgctgatcagccaggagctgctgagaaaggagagaagcctgaacgagctgagagtgctgctgctggaggccaacagacacagccccggccccgagagagacctgagcagagaggtgcacaaggccgagtggagaatcaaggagcagaagctgaaggacgacatcagaggcctgagagagaagctgaccggcctggacaaggagaagagcctgagcgaccagagaagatacagcctgatcgacagaagcagcgcccccgagctgctgagactgcagcaccagctgatgagcaccgaggacgccctgagagacgccctggaccaggcccagcaggtggagaagctgatggaggccatgagaagctgccccgacaaggcccagaccatcggcaacagcggcagcgccaacggcatccaccagcaggacaaggcccagaagcaggagaacacccactag

SEQ ID NO: 75346 - DNA, 4827 bp, Artificial Sequence
  Description of Artificial Sequence: Synthetic coding sequence
atgtacagcgcccacagacccctgatgcccgccagcagcgccgccagcagaggcctgggcatgttcgtgtggaccaacgtggagcccagaagcgtggccgtgttcccctggcacagcctggtgcccttcctggcccccagccagcccgaccccagcgtgcagcccagcgaggcccagcagcccgccagccaccccgtggccagcaaccagagcaaggagcccgccgagagcgccgccgtggcccacgagagaccccccggcggcaccggcagcgccgaccccgagagaccccccggcgccacctgccccgagagccccggccccggccccccccaccccctgggcgtggtggagagcggcaagggccccccccccaccaccgaggaggaggccagcggcccccccggcgagcccagactggacagcgagaccgagagcgaccacgacgacgccttcctgagcatcatgagccccgagatccagctgcccctgccccccggcaagagaagaacccagagcctgagcgccctgcccaaggagagagacagcagcagcgagaaggacggcagaagccccaacaagagagagaaggaccacatcagaagacccatgaacgccttcatgatcttcagcaagagacacagagccctggtgcaccagagacaccccaaccaggacaacagaaccgtgagcaagatcctgggcgagtggtggtacgccctgggccccaaggagaagcagaagtaccacgacctggccttccaggtgaaggaggcccacttcaaggcccaccccgactggaagtggtgcaacaaggacagaaagaagagcagcagcgaggccaagcccaccagcctgggcctggccggcggccacaaggagaccagagagagaagcatgagcgagaccggcaccgccgccgcccccggcgtgagcagcgagctgctgagcgtggccgcccagaccctgctgagcagcgacaccaaggcccccggcagcagcagctgcggcgccgagagactgcacaccgtgggcggccccggcagcgccagacccagagccttcagccacagcggcgtgcacagcctggacggcggcgaggtggacagccaggccctgcaggagctgacccagatggtgagcggccccgccagctacagcggccccaagcccagcacccagtacggcgcccccggccccttcgccgcccccggcgagggcggcgccctggccgccaccggcagaccccccctgctgcccaccagagccagcagaagccagagagccgccagcgaggacatgaccagcgacgaggagagaatggtgatctgcgaggaggagggcgacgacgacgtgatcgccgacgacggcttcggcaccaccgacatcgacctgaagtgcaaggagagagtgaccgacagcgagagcggcgacagcagcggcgaggaccccgagggcaacaagggcttcggcagaaaggtgttcagccccgtgatcagaagcagcttcacccactgcagaccccccctggaccccgagccccccggcccccccgacccccccgtggccttcggcaagggctacggcagcgcccccagcagcagcgccagcagccccgccagcagcagcgccagcgccgccaccagcttcagcctgggcagcggcaccttcaaggcccaggagagcggccagggcagcaccgccggccccctgagaccccccccccccggcgccggcggccccgccacccccagcaaggccaccagattcctgcccatggaccccgccaccttcagaagaaagagacccgagagcgtgggcggcctggagccccccggccccagcgtgatcgccgccccccccagcggcggcggcaacatcctgcagaccctggtgctgccccccaacaaggaggagcaggagggcggcggcgccagagtgcccagcgcccccgcccccagcctggcctacggcgcccccgccgcccccctgagcagacccgccgccaccatggtgaccaacgtggtgagacccgtgagcagcacccccgtgcccatcgccagcaagcccttccccaccagcggcagagccgaggccagccccaacgacaccgccggcgccagaaccgagatgggcaccggcagcagagtgcccggcggcagccccctgggcgtgagcctggtgtacagcgacaagaagagcgccgccgccaccagccccgccccccacctggtggccggccccctgctgggcaccgtgggcaaggcccccgccaccgtgaccaacctgctggtgggcacccccggctacggcgcccccgccccccccgccgtgcagttcatcgcccagggcgcccccggcggcggcaccaccgccggcagcggcgccggcgccggcagcggccccaacggccccgtgcccctgggcatcctgcagcccggcgccctgggcaaggccggcggcatcacccaggtgcagtacatcctgcccaccctgccccagcagctgcaggtggcccccgcccccgcccccgcccccggcaccaaggccgccgcccccagcggccccgcccccaccaccagcatcagattcaccctgccccccggcaccagcaccaacggcaaggtgctggccgccaccgcccccacccccggcatccccatcctgcagagcgtgcccagcgcccccccccccaaggcccagagcgtgagccccgtgcaggcccccccccccggcggcagcgcccagctgctgcccggcaaggtgctggtgcccctggccgcccccagcatgagcgtgagaggcggcggcgccggccagcccctgcccctggtgagcccccccttcagcgtgcccgtgcagaacggcgcccagccccccagcaagatcatccagctgacccccgtgcccgtgagcacccccagcggcctggtgccccccctgagccccgccaccctgcccggccccaccagccagccccagaaggtgctgctgcccagcagcaccagaatcacctacgtgcagagcgccggcggccacgccctgcccctgggcaccagccccgccagcagccaggccggcaccgtgaccagctacggccccaccagcagcgtggccctgggcttcaccagcctgggccccagcggccccgccttcgtgcagcccctgctgagcgccggccaggcccccctgctggcccccggccaggtgggcgtgagccccgtgcccagcccccagctgccccccgcctgcgccgcccccggcggccccgtgatcaccgccttctacagcggcagccccgcccccaccagcagcgcccccctggcccagcccagccaggccccccccagcctggtgtacaccgtggccaccagcaccaccccccccgccgccaccatcctgcccaagggcccccccgcccccgccaccgccacccccgcccccaccagccccttccccagcgccaccgccggcagcatgacctacagcctggtggcccccaaggcccagagacccagccccaaggccccccagaaggtgaaggccgccatcgccagcatccccgtgggcagcttcgaggccggcgccagcggcagacccggccccgcccccagacagcccctggagcccggccccgtgagagagcccaccgcccccgagagcgagctggagggccagcccaccccccccgcccccccccccctgcccgagacctggacccccaccgccagaagcagcccccccctgcccccccccgccgaggagagaaccagcgccaagggccccgagaccatggccagcaagttccccagcagcagcagcgactggagagtgcccggccagggcctggagaacagaggcgagccccccaccccccccagccccgcccccgcccccgccgtggcccccggcggcagcagcgagagcagcagcggcagagccgccggcgacacccccgagagaaaggaggccgccggcaccggcaagaaggtgaaggtgagacccccccccctgaagaagaccttcgacagcgtggacaacagagtgctgagcgaggtggacttcgaggagagattcgccgagctgcccgagttcagacccgaggaggtgctgcccagccccaccctgcagagcctggccaccagccccagagccatcctgggcagctacagaaagaagagaaagaacagcaccgacctggacagcgcccccgaggaccccaccagccccaagagaaagatgagaagaagaagcagctgcagcagcgagcccaacacccccaagagcgccaagtgcgagggcgacatcttcaccttcgacagaaccggcaccgaggccgaggacgtgctgggcgagctggagtacgacaaggtgccctacagcagcctgagaagaaccctggaccagagaagagccctggtgatgcagctgttccaggaccacggcttcttccccagcgcccaggccaccgccgccttccaggccagatacgccgacatcttccccagcaaggtgtgcctgcagctgaagatcagagaggtgagacagaagatcatgcaggccgccacccccaccgagcagccccccggcgccgaggcccccctgcccgtgcccccccccaccggcaccgccgccgcccccgcccccacccccagccccgccggcggccccgaccccaccagccccagcagcgacagcggcaccgcccaggccgccccccccctgccccccccccccgagagcggccccggccagcccggctgggagggcgccccccagcccagcccccccccccccggccccagcaccgccgccaccggcagatag

SEQ ID NO: 75347 - DNA, 1002 bp, Artificial Sequence
  Description of Artificial Sequence: Synthetic coding sequence
atgtacaccgccatcccccagagcggcagccccttccccggcagcgtgcaggaccccggcctgcacgtgtggagagtggagaagctgaagcccgtgcccgtggcccaggagaaccagggcgtgttcttcagcggcgacagctacctggtgctgcacaacggccccgaggaggtgagccacctgcacctgtggatcggccagcagagcagcagagacgagcagggcgcctgcgccgtgctggccgtgcacctgaacaccctgctgggcgagagacccgtgcagcacagagaggtgcagggcaacgagagcgacctgttcatgagctacttccccagaggcctgaagtaccaggagggcggcgtggagagcgccttccacaagaccagcaccggcgcccccgccgccatcaagaagctgtaccaggtgaagggcaagaagaacatcagagccaccgagagagccctgaactgggacagcttcaacaccggcgactgcttcatcctggacctgggccagaacatcttcgcctggtgcggcggcaagagcaacatcctggagagaaacaaggccagagacctggccctggccatcagagacagcgagagacagggcaaggcccaggtgctgggccccaagcccgccctgaaggagggcaaccccgaggaggacctgaccgccgacaaggccaacgcccaggccgccgccctgtacaaggtgagcgacgccaccggccagatgaacctgaccaaggtggccgacagcagccccttcgccctggagctgctgatcagcgacgactgcttcgtgctggacaacggcctgtgcggcaagatctacatctggaagggcagaaaggccaacgagaaggagagacaggccgccctgcaggtggccgagggcttcatcagcagaatgcagtacgcccccaacacccaggtggagatcctgccccagggccacgagagccccatcttcaagcagttcttcaaggactggaagtag

SEQ ID NO: 75348 - DNA, 861 bp, Artificial Sequence
  Description of Artificial Sequence: Synthetic coding sequence
atggccgacttcgacgacagagtgagcgacgaggagaaggtgagaatcgccgccaagttcatcacccacgccccccccggcgagttcaacgaggtgttcaacgacgtgagactgctgctgaacaacgacaacctgctgagagagggcgccgcccacgccttcgcccagtacaacatggaccagttcacccccgtgaagatcgagggctacgaggaccaggtgctgatcaccgagcacggcgacctgggcaacagcagattcctggaccccagaaacaagatcagcttcaagttcgaccacctgagaaaggaggccagcgacccccagcccgaggaggccgacggcggcctgaagagctggagagagagctgcgacagcgccctgagagcctacgtgaaggaccactacagcaacggcttctgcaccgtgtacgccaagaccatcgacggccagcagaccatcatcgcctgcatcgagagccaccagttccagcccaagaacttctggaacggcagatggagaagcgagtggaagttcaccatcaccccccccaccgcccaggtggtgggcgtgctgaagatccaggtgcactactacgaggacggcaacgtgcagctggtgagccacaaggacgtgcaggacagcctgaccgtgagcaacgaggcccagaccgccaaggagttcatcaagatcatcgagaacgccgagaacgagtaccagaccgccatcagcgagaactaccagaccatgagcgacaccaccttcaaggccctgagaagacagctgcccgtgaccagaaccaagatcgactggaacaagatcctgagctacaagatcggcaaggagatgcagaacgcctag

SEQ ID NO: 75349 - DNA, 861 bp, Artificial Sequence
  Description of Artificial Sequence: Synthetic coding sequence
atggccgacctggaggagcagctgagcgacgaggagaaggtgagaatcgccgccaagttcatcatccacgccccccccggcgagttcaacgaggtgttcaacgacgtgagactgctgctgaacaacgacaacctgctgagagagggcgccgcccacgccttcgcccagtacaacctggaccagttcacccccgtgaagatcgagggctacgaggaccaggtgctgatcaccgagcacggcgacctgggcaacggcaagttcctggaccccaagaacagaatctgcttcaagttcgaccacctgagaaaggaggccaccgaccccagaccctgcgaggtggagaacgccgtggagagctggagaaccagcgtggagaccgccctgagagcctacgtgaaggagcactaccccaacggcgtgtgcaccgtgtacggcaagaagatcgacggccagcagaccatcatcgcctgcatcgagagccaccagttccaggccaagaacttctggaacggcagatggagaagcgagtggaagttcaccatcacccccagcaccacccaggtggtgggcatcctgaagatccaggtgcactactacgaggacggcaacgtgcagctggtgagccacaaggacatccaggacagcctgaccgtgagcaacgaggtgcagaccgccaaggagttcatcaagatcgtggaggccgccgagaacgagtaccagaccgccatcagcgagaactaccagaccatgagcgacaccaccttcaaggccctgagaagacagctgcccgtgaccagaaccaagatcgactggaacaagatcctgagctacaagatcggcaaggagatgcagaacgcctag

SEQ ID NO: 75350 - DNA, 519 bp, Artificial Sequence
  Description of Artificial Sequence: Synthetic coding sequence
atggccgacctggaggagcagctgagcgacgaggagaaggtgagaatcgccgccaagttcatcatccacgccccccccggcgagttcaacgaggtgttcaacgacgtgagactgctgctgaacaacgacaacctgctgagagagggcgccgcccacgccttcgcccagtacaacctggaccagttcacccccgtgaagatcgagggctacgaggaccaggtgctgatcaccgagcacggcgacctgggcaacggcaagttcctggaccccaagaacagaatctgcttcaagttcgaccacctgagaaaggaggccaccgaccccagaccctgcgaggtggagaacgccgtggagagctggagaaccagcgtggagaccgccctgagagcctacgtgaaggagcactaccccaacggcgtgtgcaccgagtggagcctggaggtgagaatggaggtgtacaaccacagcttcaaccacagcagcggctggcacctggagaacagcggcagcctgctgtag

SEQ ID NO: 75351 - DNA, 900 bp, Artificial Sequence
  Description of Artificial Sequence: Synthetic coding sequence
atgaccctgagcgtgctgagcagaaaggacaaggagagagtgatcagaagactgctgctgcaggccccccccggcgagttcgtgaacgccttcgacgacctgtgcctgctgatcagagacgagaagctgatgcaccaccagggcgagtgcgccggccaccagcactgccagaagtacagcgtgcccctgtgcatcgacggcaaccccgtgctgctgagccaccacaacgtgatgggcgactacagattcttcgaccaccagagcaagctgagcttcaagtacgacctgctgcagaaccagctgaaggacatccagagccacggcatcatccagaacgaggccgagtacctgagagtggtgctgctgtgcgccctgaagctgtacgtgaacgaccactaccccaagggcaactgcaacatgctgagaaagaccgtgaagagcaaggagtacctgatcgcctgcatcgaggaccacaactacgagaccggcgagtgctggaacggcctgtggaagagcaagtggatcttccaggtgaaccccttcctgacccaggtgaccggcagaatcttcgtgcaggcccacttcttcagatgcgtgaacctgcacatcgagatcagcaaggacctgaaggagagcctggagatcgtgaaccaggcccagctggccctgagcttcgccagactggtggaggagcaggagaacaagttccaggccgccgtgctggaggagctgcaggagctgagcaacgaggccctgagaaagatcctgagaagagacctgcccgtgaccagaaccctgatcgactggcacagaatcctgagcgacctgaacctggtgatgtaccccaagctgggctacgtgatctacagcagaagcgtgctgtgcaactggatcatctag

SEQ ID NO: 75352 - DNA, 834 bp, Artificial Sequence
  Description of Artificial Sequence: Synthetic coding sequence
atgagcgaccagcagctggactgcgccctggacctgatgagaagactgcccccccagcagatcgagaagaacctgagcgacctgatcgacctggtgcccagcctgtgcgaggacctgctgagcagcgtggaccagcccctgaagatcgccagagacaaggtggtgggcaaggactacctgctgtgcgactacaacagagacggcgacagctacagaagcccctggagcaacaagtacgacccccccctggaggacggcgccatgcccagcgccagactgagaaagctggaggtggaggccaacaacgccttcgaccagtacagagacctgtacttcgagggcggcgtgagcagcgtgtacctgtgggacctggaccacggcttcgccggcgtgatcctgatcaagaaggccggcgacggcagcaagaagatcaagggctgctgggacagcatccacgtggtggaggtgcaggagaagagcagcggcagaaccgcccactacaagctgaccagcaccgtgatgctgtggctgcagaccaacaagagcggcagcggcaccatgaacctgggcggcagcctgaccagacagatggagaaggacgagaccgtgagcgactgcagcccccacatcgccaacatcggcagactggtggaggacatggagaacaagatcagaagcaccctgaacgagatctacttcggcaagaccaaggacatcgtgaacggcctgagaagcatcgacgccatccccgacaaccagaagttcaagcagctgcagagagagctgagccaggtgctgacccagagacagatctacatccagcccgacaactag

SEQ ID NO: 75353 - DNA, 783 bp, Artificial Sequence
  Description of Artificial Sequence: Synthetic coding sequence
atgcccagacagttccaggacaccggcttcagcagacccggcctgggccagcccagaagatgcgaccccgagcccagaaagagcgaccagcagctggactgcgccctggacctgatgagaagactgcccccccagcagatcgagaagaacctgagcgacctgatcgacctggtgcccagcctgtgcgaggacctgctgagcagcgtggaccagcccctgaagatcgccagagacaaggtggtgggcaaggactacctgctgtgcgactacaacagagacggcgacagctacagaagcccctggagcaacaagtacgacccccccctggaggacggcgccatgcccagcgccagactgagaaagctggaggtggaggccaacaacgccttcgaccagtacagagacctgtacttcgagggcggcgtgagcagcgtgtacctgtgggacctggaccacggcttcgccggcgtgatcctgatcaagaaggccggcgacggcagcaagaagatcaagggctgctgggacagcatccacgtggtggaggtgcaggagaagagcagcggcagaaccgcccactacaagctgaccagcaccgtgatgctgtggctgcagaccaacaagagcggcagcggcaccatgaacctgggcggcagcctgaccagacagatggagaaggacgagaccgtgagcgactgcagcccccacatcgccaacatcggcagactggtggaggtgtgcgccgacttctgcagacagatcaagaccagaagcagcgaggagtag

SEQ ID NO: 75354 - DNA, 834 bp, Artificial Sequence; identical to SEQ ID NO: 75352
  Description of Artificial Sequence: Synthetic coding sequence

SEQ ID NO: 75355 - DNA, 783 bp, Artificial Sequence
  Description of Artificial Sequence: Synthetic coding sequence
atgagaagactgcccccccagcagatcgagaagaacctgagcgacctgatcgacctggtgcccagcctgtgcgaggacctgctgagcagcgtggaccagcccctgaagatcgccagagacaaggtggtgggcaaggactacctgctgtgcgactacaacagagacggcgacagctacagaagcccctggagcaacaagtacgacccccccctggaggacggcgccatgcccagcgccagactgagaaagctggaggtggaggccaacaacgccttcgaccagtacagagacctgtacttcgagggcggcgtgagcagcgtgtacctgtgggacctggaccacggcttcgccggcgtgatcctgatcaagaaggccggcgacggcagcaagaagatcaagggctgctgggacagcatccacgtggtggaggtgcaggagaagagcagcggcagaaccgcccactacaagctgaccagcaccgtgatgctgtggctgcagaccaacaagagcggcagcggcaccatgaacctgggcggcagcctgaccagacagatggagaaggacgagaccgtgagcgactgcagcccccacatcgccaacatcggcagactggtggaggacatggagaacaagatcagaagcaccctgaacgagatctacttcggcaagaccaaggacatcgtgaacggcctgagaagcgtgcagaccttcgccgacaagagcaagcaggaggccctgaagaacgacctggtggaggccctgaagagaaagcagcagtgctag

SEQ ID NO: 75356 - DNA, 1005 bp, Artificial Sequence
  Description of Artificial Sequence: Synthetic coding sequence
atgggcggcccccaggacaaggacgagagaaccatcgccctggtgagaccctggccctggggccaccaggccctggaccccgcctacggcctggacaccatgcaccccagcagaagaagcctgcccttccccctgaactgccagctggccagagtgggcaccgccgactacggcagccccagcgaccagagcgaccagcagctggactgcgccctggacctgatgagaagactgcccccccagcagatcgagaagaacctgagcgacctgatcgacctggtgcccagcctgtgcgaggacctgctgagcagcgtggaccagcccctgaagatcgccagagacaaggtggtgggcaaggactacctgctgtgcgactacaacagagacggcgacagctacagaagcccctggagcaacaagtacgacccccccctggaggacggcgccatgcccagcgccagactgagaaagctggaggtggaggccaacaacgccttcgaccagtacagagacctgtacttcgagggcggcgtgagcagcgtgtacctgtgggacctggaccacggcttcgccggcgtgatcctgatcaagaaggccggcgacggcagcaagaagatcaagggctgctgggacagcatccacgtggtggaggtgcaggagaagagcagcggcagaaccgcccactacaagctgaccagcaccgtgatgctgtggctgcagaccaacaagagcggcagcggcaccatgaacctgggcggcagcctgaccagacagatggagaaggacgagaccgtgagcgactgcagcccccacatcgccaacatcggcagactggtggaggacatggagaacaagatcagaagcaccctgaacgagatctacttcggcaagaccaaggacatcgtgaacggcctgagaagcgtgcagaccttcgccgacaagagcaagcaggaggccctgaagaacgacctggtggaggccctgaagagaaagcagcagtgctag

SEQ ID NO: 75357 - DNA, 819 bp, Artificial Sequence
  Description of Artificial Sequence: Synthetic coding sequence
atgagcgaccagcagctggactgcgccctggacctgatgagaagactgcccccccagcagatcgagaagaacctgagcgacctgatcgacctggtgcccagcctgtgcgaggacctgctgagcagcgtggaccagcccctgaagatcgccagagacaaggtggtgggcaaggactacctgctgtgcgactacaacagagacggcgacagctacagaagcccctggagcaacaagtacgacccccccctggaggacggcgccatgcccagcgccagactgagaaagctggaggtggaggccaacaacgccttcgaccagtacagagacctgtacttcgagggcggcgtgagcagcgtgtacctgtgggacctggaccacggcttcgccggcgtgatcctgatcaagaaggccggcgacggcagcaagaagatcaagggctgctgggacagcatccacgtggtggaggtgcaggagaagagcagcggcagaaccgcccactacaagctgaccagcaccgtgatgctgtggctgcagaccaacaagagcggcagcggcaccatgaacctgggcggcagcctgaccagacagatggagaaggacgagaccgtgagcgactgcagcccccacatcgccaacatcggcagactggtggaggacatggagaacaagatcagaagcaccctgaacgagatctacttcggcaagaccaaggacatcgtgaacggcctgagaagcgtgcagaccttcgccgacaagagcaagcaggaggccctgaagaacgacctggtggaggccctgaagagaaagcagcagtgctag

SEQ ID NO: 75358 - DNA, 621 bp, Artificial Sequence
  Description of Artificial Sequence: Synthetic coding sequence
atgagaagactgcccccccagcagatcgagaagaacctgagcgacctgatcgacctggtgcccagcctgtgcgaggacctgctgagcagcgtggaccagcccctgaagatcgccagagacaaggtggtgggcaaggactacctgctgtgcgactacaacagagacggcgacagctacagaagcccctggagcaacaagtacgacccccccctggaggacggcgccatgcccagcgccagactgagaaagctggaggtggaggccaacaacgccttcgaccagtacagagacctgtacttcgagggcggcgtgagcagcgtgtacctgtgggacctggaccacggcttcgccggcgtgatcctgatcaagaaggccggcgacggcagcaagaagatcaagggctgctgggacagcatccacgtggtggaggtgcaggagaagagcagcggcagaaccgcccactacaagctgaccagcaccgtgatgctgtggctgcagaccaacaagagcggcagcggcaccatgaacctgggcggcagcctgaccagacagatggagaaggacgagaccgtgagcgactgcagcccccacatcgccaacatcggcagactggtggagtag

SEQ ID NO: 75359 - DNA, 906 bp, Artificial Sequence
  Description of Artificial Sequence: Synthetic coding sequence
atgcaccccagcagaagaagcctgcccttccccctgaactgccagctggccagagtgggcaccgccgactacggcagccccagcgaccagagcgaccagcagctggactgcgccctggacctgatgagaagactgcccccccagcagatcgagaagaacctgagcgacctgatcgacctggtgcccagcctgtgcgaggacctgctgagcagcgtggaccagcccctgaagatcgccagagacaaggtggtgggcaaggactacctgctgtgcgactacaacagagacggcgacagctacagaagcccctggagcaacaagtacgacccccccctggaggacggcgccatgcccagcgccagactgagaaagctggaggtggaggccaacaacgccttcgaccagtacagagacctgtacttcgagggcggcgtgagcagcgtgtacctgtgggacctggaccacggcttcgccggcgtgatcctgatcaagaaggccggcgacggcagcaagaagatcaagggctgctgggacagcatccacgtggtggaggtgcaggagaagagcagcggcagaaccgcccactacaagctgaccagcaccgtgatgctgtggctgcagaccaacaagagcggcagcggcaccatgaacctgggcggcagcctgaccagacagatggagaaggacgagaccgtgagcgactgcagcccccacatcgccaacatcggcagactggtggaggacatggagaacaagatcagaagcaccctgaacgagatctacttcggcaagaccaaggacatcgtgaacggcctgagaagcgtgcagaccttcgccgacaagagcaagcaggaggccctgaagaacgacctggtggaggccctgaagagaaagcagcagtgctag

SEQ ID NO: 75360 - DNA, 366 bp, Artificial Sequence
  Description of Artificial Sequence: Synthetic coding sequence
atgctgaaggtgcccagcctgtgcgaggacctgctgagcagcgtggaccagcccctgaagatcgccagagacaaggtggtgggcaaggactacctgctgtgcgactacaacagagacggcgacagctacagaagcccctggagcaacaagtacgacccccccctggaggacggcgccatgcccagcgccagactgagaaagctggaggtggaggccaacaacgccttcgaccagtacagagacctgtacttcgagggcggcgtgagcagcgtgtacctgtgggacctggaccacggcttcgccggcgtgatcctgatcaagaaggccggcgacggcagcaagaagatcaagggctgctgggactag

SEQ ID NO: 75361 - DNA, 1047 bp, Artificial Sequence
  Description of Artificial Sequence: Synthetic coding sequence
atgtacaccgccatcccccagagcggcagccccttccccggcagcgtgcaggaccccggcctgcacgtgtggagagtggagaagctgaagcccgtgcccgtggcccaggagaaccagggcgtgttcttcagcggcgacagctacctggtgctgcacaacggccccgaggaggtgagccacctgcacctgtggatcggccagcagagcagcagagacgagcagggcgcctgcgccgtgctggccgtgcacctgaacaccctgctgggcgagagacccgtgcagcacagagaggtgcagggcaacgagagcgacctgttcatgagctacttccccagaggcctgaagtaccaggagggcggcgtggagagcgccttccacaagaccagcaccggcgcccccgccgccatcaagaagctgtaccaggtgaagggcaagaagaacatcagagccaccgagagagccctgaactgggacagcttcaacaccggcgactgcttcatcctggacctgggccagaacatcttcgcctggtgcggcggcaagagcaacatcctggagagaaacaaggccagagacctggccctggccatcagagacagcgagagacagggcaaggcccaggtggagatcgtgaccgacggcgaggagcccgccgagatgatccaggtgctgggccccaagcccgccctgaaggagggcaaccccgaggaggacctgaccgccgacaaggccaacgcccaggccgccgccctgtacaaggtgagcgacgccaccggccagatgaacctgaccaaggtggccgacagcagccccttcgccctggagctgctgatcagcgacgactgcttcgtgctggacaacggcctgtgcggcaagatctacatctggaagggcagaaaggccaacgagaaggagagacaggccgccctgcaggtggccgagggcttcatcagcagaatgcagtacgcccccaacacccaggtggagatcctgccccagggccacgagagccccatcttcaagcagttcttcaaggactggaagtag

SEQ ID NO: 75362 - DNA, 657 bp, Artificial Sequence
  Description of Artificial Sequence: Synthetic coding sequence
atgtacaccgccatcccccagagcggcagccccttccccggcagcgtgcaggaccccggcctgcacgtgtggagagtggagaagctgaagcccgtgcccgtggcccaggagaaccagggcgtgttcttcagcggcgacagctacctggtgctgcacaacggccccgaggaggtgagccacctgcacctgtggatcggccagcagagcagcagagacgagcagggcgcctgcgccgtgctggccgtgcacctgaacaccctgctgggcgagagacccgtgcagcacagagaggtgcagggcaacgagagcgacctgttcatgagctacttccccagaggcctgaagtaccaggagggcggcgtggagagcgccttccacaagaccagcaccggcgcccccgccgccatcaagaagctgtaccaggtgaagggcaagaagaacatcagagccaccgagagagccctgaactgggacagcttcaacaccggcgactgcttcatcctggacctgggccagaacatcttcgcctggtgcggcggcaagagcaacatcctggagagaaacaaggccagagacctggccctggccatcagagacagcgagagacagggcaaggcccaggtggagatcgtgaccgacggcgaggagcccgcctag

SEQ ID NO: 75363 - DNA, 1047 bp, Artificial Sequence; identical to SEQ ID NO: 75361
  Description of Artificial Sequence: Synthetic coding sequence

SEQ ID NO: 75364 - DNA, 1047 bp, Artificial Sequence; identical to SEQ ID NO: 75361
  Description of Artificial Sequence: Synthetic coding sequence

SEQ ID NO: 75365 - DNA, 762 bp, Artificial Sequence
  Description of Artificial Sequence: Synthetic coding sequence
atgtacaccgccatcccccagagcggcagccccttccccggcagcgtgcaggaccccggcctgcacgtgtggagagtggagaagctgaagcccgtgcccgtggcccaggagaaccagggcgtgttcttcagcggcgacagctacctggtgctgcacaacggccccgaggaggtgagccacctgcacctgtggatcggccagcagagcagcagagacgagcagggcgcctgcgccgtgctggccgtgcacctgaacaccctgctgggcgagagacccgtgcagcacagagaggtgcagggcaacgagagcgacctgttcatgagctacttccccagaggcctgaagtaccaggagggcggcgtggagagcgccttccacaagaccagcaccggcgcccccgccgccatcaagaagctgtaccaggtgaagggcaagaagaacatcagagccaccgagagagccctgaactgggacagcttcaacaccggcgactgcttcatcctggacctgggccagaacatcttcgcctggtgcggcggcaagagcaacatcctggagagaaacaaggccagagacctggccctggccatcagagacagcgagagacagggcaaggcccaggtggagatcgtgaccgacggcgaggagcccgccgagatgatccaggtgctgggccccaagcccgccctgaaggagggcaaccccgaggaggacctgaccgccgacaaggccaacgcccaggccgccgccctgtacaagtag

SEQ ID NO: 75366 - DNA, 762 bp, Artificial Sequence; identical to SEQ ID NO: 75365
  Description of Artificial Sequence: Synthetic coding sequence

SEQ ID NO: 75367 - DNA, 762 bp, Artificial Sequence; identical to SEQ ID NO: 75365
  Description of Artificial Sequence: Synthetic coding sequence

SEQ ID NO: 75368 - DNA, 984 bp, Artificial Sequence
  Description of Artificial Sequence: Synthetic coding sequence
atgtacaccgccatcccccagagcggcagccccttccccggcagcgtgcaggaccccggcctgcacgtgtggagagtggagaagctgaagcccgtgcccgtggcccaggagaaccagggcgtgttcttcagcggcgacagctacctggtgctgcacaacggccccgaggaggtgagccacctgcacctgaacaccctgctgggcgagagacccgtgcagcacagagaggtgcagggcaacgagagcgacctgttcatgagctacttccccagaggcctgaagtaccaggagggcggcgtggagagcgccttccacaagaccagcaccggcgcccccgccgccatcaagaagctgtaccaggtgaagggcaagaagaacatcagagccaccgagagagccctgaactgggacagcttcaacaccggcgactgcttcatcctggacctgggccagaacatcttcgcctggtgcggcggcaagagcaacatcctggagagaaacaaggccagagacctggccctggccatcagagacagcgagagacagggcaaggcccaggtggagatcgtgaccgacggcgaggagcccgccgagatgatccaggtgctgggccccaagcccgccctgaaggagggcaaccccgaggaggacctgaccgccgacaaggccaacgcccaggccgccgccctgtacaaggtgagcgacgccaccggccagatgaacctgaccaaggtggccgacagcagccccttcgccctggagctgctgatcagcgacgactgcttcgtgctggacaacggcctgtgcggcaagatctacatctggaagggcagaaaggccaacgagaaggagagacaggccgccctgcaggtggccgagggcttcatcagcagaatgcagtacgcccccaacacccaggtggagatcctgccccagggccacgagagccccatcttcaagcagttcttcaaggactggaagtag

SEQ ID NO: 75369 - DNA, 654 bp, Artificial Sequence
  Description of Artificial Sequence: Synthetic coding sequence
atggagggcagcttcagcgacggcggcgccctgcccgagggcctggccgaggaggccgagccccagggcgccgcctggagcggcgacagcggcaccgtgagccagagccacagcagcgccagcggcccctgggaggacgagggcgccgaggacggcgcccccggcagagacctgcccctgctgagaagagccgccgccggctacgccgcctgcctgctgcccggcgccggcgccagacccgaggtggaggccctggacgccagcctggaggacctgctgaccagagtggacgagttcgtgggcatgctggacatgctgagaggcgacagcagccacgtggtgagcgagggcgtgcccagaatccacgccaaggccgccgagatgagaagaatctacagcagaatcgacagactggaggccttcgtgagaatggtgggcggcagagtggccagaatggaggagcaggtgaccaaggccgaggccgagctgggcaccttccccagagccttcaagaagctgctgcacaccatgaacgtgcccagcctgttcagcaagagcgcccccagcagaccccagcaggccggctacgaggcccccgtgctgttcagaaccgaggactacttcccctgctgcagcgagagaccccagctgtag

SEQ ID NO: 75370 - DNA, 6678 bp, Artificial Sequence
  Description of Artificial Sequence: Synthetic coding sequence
atggccgccctggtgctggaggacggcagcgtgctgagaggccagcccttcggcgccgccgtgagcaccgccggcgaggtggtgttccagaccggcatggtgggctaccccgaggccctgaccgaccccagctacaaggcccagatcctggtgctgacctaccccctgatcggcaactacggcatcccccccgacgagatggacgagttcggcctgtgcaagtggttcgagagcagcggcatccacgtggccgccctggtggtgggcgagtgctgccccacccccagccactggagcgccaccagaaccctgcacgagtggctgcagcagcacggcatccccggcctgcagggcgtggacaccagagagctgaccaagaagctgagagagcagggcagcctgctgggcaagctggtgcagaacggcaccgagcccagcagcctgcccttcctggaccccaacgccagacccctggtgcccgaggtgagcatcaagacccccagagtgttcaacaccggcggcgcccccagaatcctggccctggactgcggcctgaagtacaaccagatcagatgcctgtgccagagaggcgccgaggtgaccgtggtgccctgggaccacgccctggacagccaggagtacgagggcctgttcctgagcaacggccccggcgaccccgccagctaccccagcgtggtgagcaccctgagcagagtgctgagcgagcccaaccccagacccgtgttcggcatctgcctgggccaccagctgctggccctggccatcggcgccaagacctacaagatgagatacggcaacagaggccacaaccagccctgcctgctggtgggcagcggcagatgcttcctgaccagccagaaccacggcttcgccgtggagaccgacagcctgcccgccgactgggcccccctgttcaccaacgccaacgacggcagcaacgagggcatcgtgcacaacagcctgcccttcttcagcgtgcagttccaccccgagcaccaggccggccccagcgacatggagctgctgttcgacatcttcctggagaccgtgaaggaggccaccgccggcaaccccggcggccagaccgtgagagagagactgaccgagagactgtgcccccccggcatccccacccccggcagcggcctgcccccccccagaaaggtgctgatcctgggcagcggcggcctgagcatcggccaggccggcgagttcgactacagcggcagccaggccatcaaggccctgaaggaggagaacatccagaccctgctgatcaaccccaacatcgccaccgtgcagaccagccagggcctggccgacaaggtgtacttcctgcccatcaccccccactacgtgacccaggtgatcagaaacgagagacccgacggcgtgctgctgaccttcggcggccagaccgccctgaactgcggcgtggagctgaccaaggccggcgtgctggccagatacggcgtgagagtgctgggcacccccgtggagaccatcgagctgaccgaggacagaagagccttcgccgccagaatggccgagatcggcgagcacgtggcccccagcgaggccgccaacagcctggagcaggcccaggccgccgccgagagactgggctaccccgtgctggtgagagccgccttcgccctgggcggcctgggcagcggcttcgccagcaacagagaggagctgagcgccctggtggcccccgccttcgcccacaccagccaggtgctggtggacaagagcctgaagggctggaaggagatcgagtacgaggtggtgagagacgcctacggcaactgcgtgaccgtgtgcaacatggagaacctggaccccctgggcatccacaccggcgagagcatcgtggtggcccccagccagaccctgaacgacagagagtaccagctgctgagacagaccgccatcaaggtgacccagcacctgggcatcgtgggcgagtgcaacgtgcagtacgccctgaaccccgagagcgagcagtactacatcatcgaggtgaacgccagactgagcagaagcagcgccctggccagcaaggccaccggctaccccctggcctacgtggccgccaagctggccctgggcatccccctgcccgagctgagaaacagcgtgaccggcggcaccgccgccttcgagcccagcgtggactactgcgtggtgaagatccccagatgggacctgagcaagttcctgagagtgagcaccaagatcggcagctgcatgaagagcgtgggcgaggtgatgggcatcggcagaagcttcgaggaggccttccagaaggccctgagaatggtggacgagaactgcgtgggcttcgaccacaccgtgaagcccgtgagcgacatggagctggagacccccaccgacaagagaatcttcgtggtggccgccgccctgtgggccggctacagcgtggacagactgtacgagctgaccagaatcgacagatggttcctgcacagaatgaagagaatcatcgcccacgcccagctgctggagcagcacagaggccagcccctgccccccgacctgctgcagcaggccaagtgcctgggcttcagcgacaagcagatcgccctggccgtgctgagcaccgagctggccgtgagaaagctgagacaggagctgggcatctgccccgccgtgaagcagatcgacaccgtggccgccgagtggcccgcccagaccaactacctgtacctgacctactggggcaccacccacgacctgaccttcagaaccccccacgtgctggtgctgggcagcggcgtgtacagaatcggcagcagcgtggagttcgactggtgcgccgtgggctgcatccagcagctgagaaagatgggctacaagaccatcatggtgaactacaaccccgagaccgtgagcaccgactacgacatgtgcgacagactgtacttcgacgagatcagcttcgaggtggtgatggacatctacgagctggagaaccccgagggcgtgatcctgagcatgggcggccagctgcccaacaacatggccatggccctgcacagacagcagtgcagagtgctgggcaccagccccgaggccatcgacagcgccgagaacagattcaagttcagcagactgctggacaccatcggcatcagccagccccagtggagagagctgagcgacctggagagcgccagacagttctgccagaccgtgggctacccctgcgtggtgagacccagctacgtgctgagcggcgccgccatgaacgtggcctacaccgacggcgacctggagagattcctgagcagcgccgccgccgtgagcaaggagcaccccgtggtgatcagcaagttcatccaggaggccaaggagatcgacgtggacgccgtggccagcgacggcgtggtggccgccatcgccatcagcgagcacgtggagaacgccggcgtgcacagcggcgacgccaccctggtgacccccccccaggacatcaccgccaagaccctggagagaatcaaggccatcgtgcacgccgtgggccaggagctgcaggtgaccggccccttcaacctgcagctgatcgccaaggacgaccagctgaaggtgatcgagtgcaacgtgagagtgagcagaagcttccccttcgtgagcaagaccctgggcgtggacctggtggccctggccaccagagtgatcatgggcgaggaggtggagcccgtgggcctgatgaccggcagcggcgtggtgggcgtgaaggtgccccagttcagcttcagcagactggccggcgccgacgtggtgctgggcgtggagatgaccagcaccggcgaggtggccggcttcggcgagagcagatgcgaggcctacctgaaggccatgctgagcaccggcttcaagatccccaagaagaacatcctgctgaccatcggcagctacaagaacaagagcgagctgctgcccaccgtgagactgctggagagcctgggctacagcctgtacgccagcctgggcaccgccgacttctacaccgagcacggcgtgaaggtgaccgccgtggactggcacttcgaggaggccgtggacggcgagtgccccccccagagaagcatcctggagcagctggccgagaagaacttcgagctggtgatcaacctgagcatgagaggcgccggcggcagaagactgagcagcttcgtgaccaagggctacagaaccagaagactggccgccgacttcagcgtgcccctgatcatcgacatcaagtgcaccaagctgttcgtggaggccctgggccagatcggccccgccccccccctgaaggtgcacgtggactgcatgaccagccagaagctggtgagactgcccggcctgatcgacgtgcacgtgcacctgagagagcccggcggcacccacaaggaggacttcgccagcggcaccgccgccgccctggccggcggcatcaccatggtgtgcgccatgcccaacaccagaccccccatcatcgacgcccccgccctggccctggcccagaagctggccgaggccggcgccagatgcgacttcgccctgttcctgggcgccagcagcgagaacgccggcaccctgggcaccgtggccggcagcgccgccggcctgaagctgtacctgaacgagaccttcagcgagctgagactggacagcgtggtgcagtggatggagcacttcgagacctggcccagccacctgcccatcgtggcccacgccgagcagcagaccgtggccgccgtgctgatggtggcccagctgacccagagaagcgtgcacatctgccacgtggccagaaaggaggagatcctgctgatcaaggccgccaaggccagaggcctgcccgtgacctgcgaggtggccccccaccacctgttcctgagccacgacgacctggagagactgggccccggcaagggcgaggtgagacccgagctgggcagcagacaggacgtggaggccctgtgggagaacatggccgtgatcgactgcttcgccagcgaccacgccccccacaccctggaggagaagtgcggcagcagacccccccccggcttccccggcctggagaccatgctgcccctgctgctgaccgccgtgagcgagggcagactgagcctggacgacctgctgcagagactgcaccacaaccccagaagaatcttccacctgcccccccaggaggacacctacgtggaggtggacctggagcacgagtggaccatccccagccacatgcccttcagcaaggcccactggacccccttcgagggccagaaggtgaagggcaccgtgagaagagtggtgctgagaggcgaggtggcctacatcgacggccaggtgctggtgccccccggctacggccaggacgtgagaaagtggccccagggcgccgtgccccagctgccccccagcgcccccgccaccagcgagatgaccaccacccccgagagacccagaagaggcatccccggcctgcccgacggcagattccacctgccccccagaatccacagagccagcgaccccggcctgcccgccgaggagcccaaggagaagagcagcagaaaggtggccgagcccgagctgatgggcacccccgacggcacctgctacccccccccccccgtgcccagacaggccagcccccagaacctgggcacccccggcctgctgcacccccagaccagccccctgctgcacagcctggtgggccagcacatcctgagcgtgcagcagttcaccaaggaccagatgagccacctgttcaacgtggcccacaccctgagaatgatggtgcagaaggagagaagcctggacatcctgaagggcaaggtgatggccagcatgttctacgaggtgagcaccagaaccagcagcagcttcgccgccgccatggccagactgggcggcgccgtgctgagcttcagcgaggccaccagcagcgtgcagaagggcgagagcctggccgacagcgtgcagaccatgagctgctacgccgacgtggtggtgctgagacacccccagcccggcgccgtggagctggccgccaagcactgcagaagacccgtgatcaacgccggcgacggcgtgggcgagcaccccacccaggccctgctggacatcttcaccatcagagaggagctgggcaccgtgaacggcatgaccatcaccatggtgggcgacctgaagcacggcagaaccgtgcacagcctggcctgcctgctgacccagtacagagtgagcctgagatacgtggccccccccagcctgagaatgccccccaccgtgagagccttcgtggccagcagaggcaccaagcaggaggagttcgagagcatcgaggaggccctgcccgacaccgacgtgctgtacatgaccagaatccagaaggagagattcggcagcacccaggagtacgaggcctgcttcggccagttcatcctgaccccccacatcatgaccagagccaagaagaagatggtggtgatgcaccccatgcccagagtgaacgagatcagcgtggaggtggacagcgaccccagagccgcctacttcagacaggccgagaacggcatgtacatcagaatggccctgctggccaccgtgctgggcagattctag

SEQ ID NO: 75371 - DNA, 1440 bp, Artificial Sequence
  Description of Artificial Sequence: Synthetic coding sequence
atggagaagggcctgaccctgccccaggactgcagagacttcgtgcacagcctgaagatgagaagcaagtacgccctgttcctggtgttcgtggtgatcgtgttcgtgttcatcgagaaggagaacaagatcatcagcagagtgagcgacaagctgaagcagatcccccaggccctggccgacgccaacagcaccgaccccgccctgatcctggccgagaacgccagcctgctgagcctgagcgagctggacagcgccttcagccagctgcagagcagactgagaaacctgagcctgcagctgggcgtggagcccgccatggaggccgccggcgaggaggaggaggagcagagaaaggaggaggagccccccagacccgccgtggccggccccagaagacacgtgctgctgatggccaccaccagaaccggcagcagcttcgtgggcgagttcttcaaccagcagggcaacatcttctacctgttcgagcccctgtggcacatcgagagaaccgtgagcttcgagcccggcggcgccaacgccgccggcagcgccctggtgtacagagacgtgctgaagcagctgttcctgtgcgacctgtacgtgctggagcacttcatcacccccctgcccgaggaccacctgacccagttcatgttcagaagaggcagcagcagaagcctgtgcgaggaccccgtgtgcacccccttcgtgaagaaggtgttcgagaagtaccactgcaagaacagaagatgcggccccctgaacgtgaccctggccgccgaggcctgcagaagaaaggagcacatggccctgaaggccgtgagaatcagacagctggagttcctgcagcccctggccgaggaccccagactggacctgagagtgatccagctggtgagagaccccagagccgtgctggccagcagaatggtggccttcgccggcaagtacaagacctggaagaagtggctggacgacgagggccaggacggcctgagagaggaggaggtgcagagactgagaggcaactgcgagagcatcagactgagcgccgagctgggcctgagacagcccgcctggctgagaggcagatacatgctggtgagatacgaggacgtggccagaggccccctgcagaaggccagagagatgtacagattcgccggcatccccctgaccccccaggtggaggactggatccagaagaacacccaggccgcccacgacggcagcggcatctacagcacccagaagaacagcagcgagcagttcgagaagtggagattcagcatgcccttcaagctggcccaggtggtgcaggccgcctgcggccccgccatgagactgttcggctacaagctggccagagacgccgccgccctgaccaacagaagcgtgagcctgctggaggagagaggcaccttctgggtgacctag

SEQ ID NO: 75372 - DNA, 1236 bp, Artificial Sequence
  Description of Artificial Sequence: Synthetic coding sequence
atgcagtgcagctggaaggccgtgctgctgctggccctggccagcatcgccatccagtacaccgccatcagaaccttcaccgccaagagcttccacacctgccccggcctggccgaggccggcctggccgagagactgtgcgaggagagccccaccttcgcctacaacctgagcagaaagacccacatcctgatcctggccaccaccagaagcggcagcagcttcgtgggccagctgttcaaccagcacctggacgtgttctacctgttcgagcccctgtaccacgtgcagaacaccctgatccccagattcacccagggcaagagccccgccgacagaagagtgatgctgggcgccagcagagacctgctgagaagcctgtacgactgcgacctgtacttcctggagaactacatcaagcccccccccgtgaaccacaccaccgacagaatcttcagaagaggcgccagcagagtgctgtgcagcagacccgtgtgcgacccccccggccccgccgacctggtgctggaggagggcgactgcgtgagaaagtgcggcctgctgaacctgaccgtggccgccgaggcctgcagagagagaagccacgtggccatcaagaccgtgagagtgcccgaggtgaacgacctgagagccctggtggaggaccccagactgaacctgaaggtgatccagctggtgagagaccccagaggcatcctggccagcagaagcgagaccttcagagacacctacagactgtggagactgtggtacggcaccggcagaaagccctacaacctggacgtgacccagctgaccaccgtgtgcgaggacttcagcaacagcgtgagcaccggcctgatgagacccccctggctgaagggcaagtacatgctggtgagatacgaggacctggccagaaaccccatgaagaagaccgaggagatctacggcttcctgggcatccccctggacagccacgtggccagatggatccagaacaacaccagaggcgaccccaccctgggcaagcacaagtacggcaccgtgagaaacagcgccgccaccgccgagaagtggagattcagactgagctacgacatcgtggccttcgcccagaacgcctgccagcaggtgctggcccagctgggctacaagatcgccgccagcgaggaggagctgaagaaccccagcgtgagcctggtggaggagagagacttcagacccttcagctag

SEQ ID NO: 75373 - DNA, 1131 bp, Artificial Sequence
  Description of Artificial Sequence: Synthetic coding sequence
atgttccccagacccctgacccccctggccgcccccaacggcgccgagcccctgggcagagccctgagaagagcccccctgggcagagccagagccggcctgggcggcccccccctgctgctgcccagcatgctgatgttcgccgtgatcgtggccagcagcggcctgctgctgatgatcgagagaggcatcctggccgagatgaagcccctgcccctgcacccccccggcagagagggcaccgcctggagaggcaaggcccccaagcccggcggcctgagcctgagagccggcgacgccgacctgcaggtgagacaggacgtgagaaacagaaccctgagagccgtgtgcggccagcccggcatgcccagagacccctgggacctgcccgtgggccagagaagaaccctgctgagacacatcctggtgagcgacagatacagattcctgtactgctacgtgcccaaggtggcctgcagcaactggaagagagtgatgaaggtgctggccggcgtgctggacagcgtggacgtgagactgaagatggaccacagaagcgacctggtgttcctggccgacctgagacccgaggagatcagatacagactgcagcactacttcaagttcctgttcgtgagagagcccctggagagactgctgagcgcctacagaaacaagttcggcgagatcagagagtaccagcagagatacggcgccgagatcgtgagaagatacagagccggcgccggccccagccccgccggcgacgacgtgaccttccccgagttcctgagatacctggtggacgaggaccccgagagaatgaacgagcactggatgcccgtgtaccacctgtgccagccctgcgccgtgcactacgacttcgtgggcagctacgagagactggaggccgacgccaaccaggtgctggagtgggtgagagcccccccccacgtgagattccccgccagacaggcctggtacagacccgccagccccgagagcctgcactaccacctgtgcagcgcccccagagccctgctgcaggacgtgctgcccaagtacatcctggacttcagcctgttcgcctaccccctgcccaacgtgaccaaggaggcctgccagcagtag

SEQ ID NO: 75374 - DNA, 1275 bp, Artificial Sequence
  Description of Artificial Sequence: Synthetic coding sequence
atgaccctgagacccggcaccatgagactggcctgcatgttcagcagcatcctgctgttcggcgccgccggcctgctgctgttcatcagcctgcaggaccccaccgagctggccccccagcaggtgcccggcatcaagttcaacatcagacccagacagccccaccacgacctgccccccggcggcagccaggacggcgacctgaaggagcccaccgagagagtgaccagagacctgagcagcggcgcccccagaggcagaaacctgcccgcccccgaccagccccagccccccctgcagagaggcaccagactgagactgagacagagaagaagaagactgctgatcaagaagatgcccgccgccgccaccatccccgccaacagcagcgacgcccccttcatcagacccggccccggcaccctggacggcagatgggtgagcctgcacagaagccagcaggagagaaagagagtgatgcaggaggcctgcgccaagtacagagccagcagcagcagaagagccgtgacccccagacacgtgagcagaatcttcgtggaggacagacacagagtgctgtactgcgaggtgcccaaggccggctgcagcaactggaagagagtgctgatggtgctggccggcctggccagcagcaccgccgacatccagcacaacaccgtgcactacggcagcgccctgaagagactggacaccttcgacagacagggcatcctgcacagactgagcacctacaccaagatgctgttcgtgagagagcccttcgagagactggtgagcgccttcagagacaagttcgagcaccccaacagctactaccaccccgtgttcggcaaggccatcctggccagatacagagccaacgccagcagagaggccctgagaaccggcagcggcgtgagattccccgagttcgtgcagtacctgctggacgtgcacagacccgtgggcatggacatccactgggaccacgtgagcagactgtgcagcccctgcctgatcgactacgacttcgtgggcaagttcgagagcatggaggacgacgccaacttcttcctgagcctgatcagagcccccagaaacctgaccttccccagattcaaggacagacacagccaggaggccagaaccaccgccagaatcgcccaccagtacttcgcccagctgagcgccctgcagagacagagaacctacgacttctactacatggactacctgatgttcaactacagcaagcccttcgccgacctgtactag

SEQ ID NO: 75375 - DNA, 1275 bp, Artificial Sequence; identical to SEQ ID NO: 75374
  Description of Artificial Sequence: Synthetic coding sequence

SEQ ID NO: 75376 - DNA, 1275 bp, Artificial Sequence; identical to SEQ ID NO: 75374
  Description of Artificial Sequence: Synthetic coding sequence

SEQ ID NO: 75377 - DNA, 1686 bp, Artificial Sequence
  Description of Artificial Sequence: Synthetic coding sequence
atgagacactgcatcaactgctgcatccagctgctgcccgacggcgcccacaagcagcaggtgaactgccagggcggcccccaccacggccaccaggcctgccccacctgcaagggcgagaacaagatcctgttcagagtggacagcaagcagatgaacctgctggccgtgctggaggtgagaaccgagggcaacgagaactggggcggcttcctgagattcaagaagggcaagagatgcagcctggtgttcggcctgatcatcatgaccctggtgatggccagctacatcctgagcggcgcccaccaggagctgctgatcagcagccccttccactacggcggcttccccagcaaccccagcctgatggacagcgagaaccccagcgacaccaaggagcaccaccaccagagcagcgtgaacaacatcagctacatgaaggactaccccagcatcaagctgatcatcaacagcatcaccaccagaatcgagttcaccaccagacagctgcccgacctggaggacctgaagaagcaggagctgcacatgttcagcgtgatccccaacaagttcctgcccaacagcaagagcccctgctggtacgaggagttcagcggccagaacaccaccgacccctacctgaccaacagctacgtgctgtacagcaagagattcagaagcaccttcgacgccctgagaaaggccttctggggccacctggcccacgcccacggcaagcacttcagactgagatgcctgccccacttctacatcatcggccagcccaagtgcggcaccaccgacctgtacgacagactgagactgcaccccgaggtgaagttcagcgccatcaaggagccccactggtggaccagaaagagattcggcatcgtgagactgagagacggcctgagagacagataccccgtggaggactacctggacctgttcgacctggccgcccaccagatccaccagggcctgcaggccagcagcgccaaggagcagagcaagatgaacaccatcatcatcggcgaggccagcgccagcaccatgtgggacaacaacgcctggaccttcttctacgacaacagcaccgacggcgagccccccttcctgacccaggacttcatccacgccttccagcccaacgccagactgatcgtgatgctgagagaccccgtggagagactgtacagcgactacctgtacttcgccagcagcaacaagagcgccgacgacttccacgagaaggtgaccgaggccctgcagctgttcgagaactgcatgctggactacagcctgagagcctgcgtgtacaacaacaccctgaacaacgccatgcccgtgagactgcaggtgggcctgtacgccgtgtacctgctggactggctgagcgtgttcgacaagcagcagttcctgatcctgagactggaggaccacgccagcaacgtgaagtacaccatgcacaaggtgttccagttcctgaacctgggccccctgagcgagaagcaggaggccctgatgaccaagagccccgccagcaacgccagaagacccgaggacagaaacctgggccccatgtggcccatcacccagaagatcctgagagacttctacagacccttcaacgccagactggcccaggtgctggccgacgaggccttcgcctggaagaccacctag

SEQ ID NO: 75378 - DNA, 1521 bp, Artificial Sequence
  Description of Artificial Sequence: Synthetic coding sequence
atgagacactgcatcaactgctgcatccagctgctgcccgacggcgcccacaagcagcaggtgaactgccagggcggcccccaccacggccaccaggcctgccccacctgcaagggcgagaacaagatcctgttcagagtggacagcaagcagatgaacctgctggccgtgctggaggtgagaaccgagggcaacgagaactggggcggcttcctgagattcaagaagggcaagagatgcagcctggtgttcggcctgatcatcatgaccctggtgatggccagctacatcctgagcggcgcccaccaggagctgctgatcagcagccccttccactacggcggcttccccagcaaccccagcctgatggacagcgagaaccccagcgacaccaaggagcaccaccaccagagcagcgtgaacaacatcagctacatgaaggactaccccagcatcaagctgatcatcaacagcatcaccaccagaatcgagttcaccaccagacagctgcccgacctggaggacctgaagaagcaggagctgcacatgttcagcgtgatccccaacaagttcctgcccaacagcaagagcccctgctggtacgaggagttcagcggccagaacaccaccgacccctacctgaccaacagctacgtgctgtacagcaagagattcagaagcaccttcgacgccctgagaaaggccttctggggccacctggcccacgcccacggcaagcacttcagactgagatgcctgccccacttctacatcatcggccagcccaagtgcggcaccaccgacctgtacgacagactgagactgcaccccgaggtgaagttcagcgccatcaaggagccccactggtggaccagaaagagattcggcatcgtgagactgagagacggcctgagagacagataccccgtggaggactacctggacctgttcgacctggccgcccaccagatccaccagggcctgcaggccagcagcgccaaggagcagagcaagatgaacaccatcatcatcggcgaggccagcgccagcaccatgtgggacaacaacgcctggaccttcttctacgacaacagcaccgacggcgagccccccttcctgacccaggacttcatccacgccttccagcccaacgccagactgatcgtgatgctgagagaccccgtggagagactgtacagcgactacctgtacttcgccagcagcaacaagagcgccgacgacttccacgagaaggtgaccgaggccctgcagctgttcgagaactgcatgctggactacagcctgagagcctgcgtgtacaacaacaccctgaacaacgccatgcccgtgtgcacccccccccccagaacccccagagccggcccctggcagaaggagctggtgtgctgctactacgccagcggcatcgtgggcctgagattcagcatcggcaccgagagaagcgtgctgatgtgcaagtgctgcagccccctgttcatggacgtgaaggccgagaactag

SEQ ID NO: 75379 - DNA, 624 bp, Artificial Sequence
  Description of Artificial Sequence: Synthetic coding sequence
atgagacactgcatcaactgctgcatccagctgctgcccgacggcgcccacaagcagcaggtgaactgccagggcggcccccaccacggccaccaggcctgccccacctgcaagggcgagaacaagatcctgttcagagtggacagcaagcagatgaacctgctggccgtgctggaggtgagaaccgagggcaacgagaactggggcggcttcctgagattcaagaagggcaagagatgcagcctggtgttcggcctgatcatcatgaccctggtgatggccagctacatcctgagcggcgcccaccaggagctgctgatcagcagccccttccactacggcggcttccccagcaaccccagcctgatggacagcgagaaccccagcgacaccaaggagcaccaccaccagagcagcgtgaacaacatcagctacatgaaggactaccccagcatcaagctgatcatcaacagcatcaccaccagaatcgagttcaccaccagacagctgcccgacctggaggacctgaagaagcaggagctgcacatgttcagcgtgatccccaacaagttcctgcccaagcacaacgcccaggccgagctgggcctgaacgtggcctgctag

SEQ ID NO: 75380 - DNA, 1686 bp, Artificial Sequence; identical to SEQ ID NO: 75377
  Description of Artificial Sequence: Synthetic coding sequence

SEQ ID NO: 75381 - DNA, 1449 bp, Artificial Sequence
  Description of Artificial Sequence: Synthetic coding sequence
atgagacactgcatcaactgctgcatccagctgctgcccgacggcgcccacaagcagcaggtgaactgccagggcggcccccaccacggccaccaggcctgccccacctgcaagggcgagaacaagatcctgttcagagtggacagcaagcagatgaacctgctggccgtgctggaggtgagaaccgagggcaacgagaactggggcggcttcctgagattcaagaagggcaagagatgcagcctggtgttcggcctgatcatcatgaccctggtgatggccagctacatcctgagcggcgcccaccaggagctgctgatcagcagccccttccactacggcggcttccccagcaaccccagcctgatggacagcgagaaccccagcgacaccaaggagcaccaccaccagagcagcgtgaacaacatcagctacatgaaggactaccccagcatcaagctgatcatcaacagcatcaccaccagaatcgagttcaccaccagacagctgcccgacctggaggacctgaagaagcaggagctgcacatgttcagcgtgatccccaacaagttcctgcccaacagcaagagcccctgctggtacgaggagttcagcggccagaacaccaccgacccctacctgaccaacagctacgtgctgtacagcaagagattcagaagcaccttcgacgccctgagaaaggccttctggggccacctggcccacgcccacggcaagcacttcagactgagatgcctgccccacttctacatcatcggccagcccaagtgcggcaccaccgacctgtacgacagactgagactgcaccccgaggtgaagttcagcgccatcaaggagccccactggtggaccagaaagagattcggcatcgtgagactgagagacggcctgagagacagataccccgtggaggactacctggacctgttcgacctggccgcccaccagatccaccagggcctgcaggccagcagcgccaaggagcagagcaagatgaacaccatcatcatcggcgaggccagcgccagcaccatgtgggacaacaacgcctggaccttcttctacgacaacagcaccgacggcgagccccccttcctgacccaggacttcatccacgccttccagcccaacgccagactgatcgtgatgctgagagaccccgtggagagactgtacagcgactacctgtacttcgccagcagcaacaagagcgccgacgacttccacgagaaggtgaccgaggccctgcagctgttcgagaactgcatgctggactacagcctgagagcctgcgtgtacaacaacaccctgaacaacgccatgcccgtgtgcacccccccccccgtgccccccgagctggcccccggcagaagaagctggttcgtggtgatcatgcaggccgccctgtgggtgtgcgtgagcgcctag

SEQ ID NO: 75382 - DNA, 1236 bp, Artificial Sequence
  Description of Artificial Sequence: Synthetic coding sequence
atgggcatgagagccagagtgcccaaggtggcccacagcaccagaagaccccccgccgccagaatgtggctgcccagattcagcagcaagaccgtgaccgtgctgctgctggcccagaccacctgcctgctgctgttcatcatcagcagacccggccccagcagccccgccggcggcgaggacagagtgcacgtgctggtgctgagcagctggagaagcggcagcagcttcctgggccagctgttcagccagcaccccgacgtgttctacctgatggagcccgcctggcacgtgtggaccaccctgagccagggcagcgccgccaccctgcacatggccgtgagagacctgatgagaagcatcttcctgtgcgacatggacgtgttcgacgcctacatgccccagagcagaaacctgagcgccttcttcaactgggccaccagcagagccctgtgcagcccccccgcctgcagcgccttccccagaggcaccatcagcaagcaggacgtgtgcaagaccctgtgcaccagacagcccttcagcctggccagagaggcctgcagaagctacagccacgtggtgctgaaggaggtgagattcttcaacctgcaggtgctgtaccccctgctgagcgaccccgccctgaacctgagaatcgtgcacctggtgagagaccccagagccgtgctgagaagcagagaggccgccggccccatcctggccagagacaacggcatcgtgctgggcaccaacggcaagtgggtggaggccgacccccacctgagactgatcagagaggtgtgcagaagccacgtgagaatcgccgaggccgccaccctgaagcccccccccttcctgagaggcagatacagactggtgagattcgaggacctggccagagagcccctggccgagatcagagccctgtacgccttcaccggcctgaccctgaccccccagctggaggcctggatccacaacatcacccacggcagcggcatcggcaagcccatcgaggccttccacaccagcagcagaaacgccagaaacgtgagccaggcctggagacacgccctgcccttcaccaagatcctgagagtgcaggaggtgtgcgccggcgccctgcagctgctgggctacagacccgtgtacagcgccgaccagcagagagacctgaccctggacctggtgctgcccagaggccccgaccacttcagctgggccagccccgactag

SEQ ID NO: 75383 - DNA, 1254 bp, Artificial Sequence
  Description of Artificial Sequence: Synthetic coding sequence
atgagcagacacctgccctggatctgcgaccagagatgcagcagccccagcagccccggcagatggccccccgccgccagaatgtggctgcccagattcagcagcaagaccgtgaccgtgctgctgctggcccagaccacctgcctgctgctgttcatcatcagcagacccggccccagcagccccgccggcggcgaggacagagtgcacgtgctggtgctgagcagctggagaagcggcagcagcttcctgggccagctgttcagccagcaccccgacgtgttctacctgatggagcccgcctggcacgtgtggaccaccctgagccagggcagcgccgccaccctgcacatggccgtgagagacctgatgagaagcatcttcctgtgcgacatggacgtgttcgacgcctacatgccccagagcagaaacctgagcgccttcttcaactgggccaccagcagagccctgtgcagcccccccgcctgcagcgccttccccagaggcaccatcagcaagcaggacgtgtgcaagaccctgtgcaccagacagcccttcagcctggccagagaggcctgcagaagctacagccacgtggtgctgaaggaggtgagattcttcaacctgcaggtgctgtaccccctgctgagcgaccccgccctgaacctgagaatcgtgcacctggtgagagaccccagagccgtgctgagaagcagagaggccgccggccccatcctggccagagacaacggcatcgtgctgggcaccaacggcaagtgggtggaggccgacccccacctgagactgatcagagaggtgtgcagaagccacgtgagaatcgccgaggccgccaccctgaagcccccccccttcctgagaggcagatacagactggtgagattcgaggacctggccagagagcccctggccgagatcagagccctgtacgccttcaccggcctgaccctgaccccccagctggaggcctggatccacaacatcacccacggcagcggcatcggcaagcccatcgaggccttccacaccagcagcagaaacgccagaaacgtgagccaggcctggagacacgccctgcccttcaccaagatcctgagagtgcaggaggtgtgcgccggcgccctgcagctgctgggctacagacccgtgtacagcgccgaccagcagagagacctgaccctggacctggtgctgcccagaggccccgaccacttcagctgggccagccccgactag

SEQ ID NO: 75384 - DNA, 1188 bp, Artificial Sequence
  Description of Artificial Sequence: Synthetic coding sequence
atgtggctgcccagagtgagcagcaccgccgtgaccgccctgctgctggcccagaccttcctgctgctgttcctggtgagcagacccggccccagcagccccgccggcggcgaggccagagtgcacgtgctggtgctgagcagctggagaagcggcagcagcttcgtgggccagctgttcaaccagcaccccgacgtgttctacctgatggagcccgcctggcacgtgtggaccaccctgagccagggcagcgccgccaccctgcacatggccgtgagagacctggtgagaagcgtgttcctgtgcgacatggacgtgttcgacgcctacctgccctggagaagaaacctgagcgacctgttccagtgggccgtgagcagagccctgtgcagcccccccgcctgcagcgccttccccagaggcgccatcagcagcgaggccgtgtgcaagcccctgtgcgccagacagagcttcaccctggccagagaggcctgcagaagctacagccacgtggtgctgaaggaggtgagattcttcaacctgcaggtgctgtaccccctgctgagcgaccccgccctgaacctgagaatcgtgcacctggtgagagaccccagagccgtgctgagaagcagagagcagaccgccaaggccctggccagagacaacggcatcgtgctgggcaccaacggcacctgggtggaggccgaccccggcctgagagtggtgagagaggtgtgcagaagccacgtgagaatcgccgaggccgccaccctgaagcccccccccttcctgagaggcagatacagactggtgagattcgaggacctggccagagagcccctggccgagatcagagccctgtacgccttcaccggcctgagcctgaccccccagctggaggcctggatccacaacatcacccacggcagcggccccggcgccagaagagaggccttcaagaccagcagcagaaacgccctgaacgtgagccaggcctggagacacgccctgcccttcgccaagatcagaagagtgcaggagctgtgcgccggcgccctgcagctgctgggctacagacccgtgtacagcgaggacgagcagagaaacctggccctggacctggtgctgcccagaggcctgaacggcttcacctgggccagcagcaccgccagccaccccagaaactag

SEQ ID NO: 75385 - DNA, 1188 bp, Artificial Sequence; identical to SEQ ID NO: 75384
  Description of Artificial Sequence: Synthetic coding sequence

SEQ ID NO: 75386 - DNA, 1461 bp, Artificial Sequence
  Description of Artificial Sequence: Synthetic coding sequence
atgaagggcagaagaagaagaagaagagagtactgcaagttcgccctgctgctggtgctgtacaccctggtgctgctgctggtgcccagcgtgctggacggcggcagagacggcgacaagggcgccgagcactgccccggcctgcagagaagcctgggcgtgtggagcctggaggccgccgccgccggcgagagagagcagggcgccgaggccagagccgccgaggagggcggcgccaaccagagccccagattccccagcaacctgagcggcgccgtgggcgaggccgtgagcagagagaagcagcacatctacgtgcacgccacctggagaaccggcagcagcttcctgggcgagctgttcaaccagcaccccgacgtgttctacctgtacgagcccatgtggcacctgtggcaggccctgtaccccggcgacgccgagagcctgcagggcgccctgagagacatgctgagaagcctgttcagatgcgacttcagcgtgctgagactgtacgccccccccggcgaccccgccgccagagcccccgacaccgccaacctgaccaccgccgccctgttcagatggagaaccaacaaggtgatctgcagcccccccctgtgccccggcgcccccagagccagagccgaggtgggcctggtggaggacaccgcctgcgagagaagctgcccccccgtggccatcagagccctggaggccgagtgcagaaagtaccccgtggtggtgatcaaggacgtgagactgctggacctgggcgtgctggtgcccctgctgagagaccccggcctgaacctgaaggtggtgcagctgttcagagaccccagagccgtgcacaacagcagactgaagagcagacagggcctgctgagagagagcatccaggtgctgagaaccagacagagaggcgacagattccacagagtgctgctggcccacggcgtgggcgccagacccggcggccagagcagagccctgcccgccgcccccagagccgacttcttcctgaccggcgccctggaggtgatctgcgaggcctggctgagagacctgctgttcgccagaggcgcccccgcctggctgagaagaagatacctgagactgagatacgaggacctggtgagacagcccagagcccagctgagaagactgctgagattcagcggcctgagagccctggccgccctggacgccttcgccctgaacatgaccagaggcgccgcctacggcgccgacagacccttccacctgagcgccagagacgccagagaggccgtgcacgcctggagagagagactgagcagagagcaggtgagacaggtggaggccgcctgcgcccccgccatgagactgctggcctaccccagaagcggcgaggagggcgacgccgagcagcccagagagggcgagacccccctggagatggacgccgacggcgccacctag

SEQ ID NO: 75387 - DNA, 1593 bp, Artificial Sequence
  Description of Artificial Sequence: Synthetic coding sequence
atgagcagaagcccccagagagccctgccccccggcgccctgcccagactgctgcaggccgcccccgccgccgcccccagagccctgctgccccagtggcccagaagacccggcagaagatggcccgccagccccctgggcatgaaggtgttcagaagaaaggccctggtgctgtgcgccggctacgccctgctgctggtgctgaccatgctgaacctgctggactacaagtggcacaaggagcccctgcagcagtgcaaccccgacggccccctgggcgccgccgccggcgccgccggcggcagctggggcagacccggccccccccccgccggcccccccagagcccacgccagactggacctgagaaccccctacagaccccccgccgccgccgtgggcgccgcccccgccgccgccgccggcatggccggcgtggccgccccccccggcaacggcaccagaggcaccggcggcgtgggcgacaagagacagctggtgtacgtgttcaccacctggagaagcggcagcagcttcttcggcgagctgttcaaccagaaccccgaggtgttcttcctgtacgagcccgtgtggcacgtgtggcagaagctgtaccccggcgacgccgtgagcctgcagggcgccgccagagacatgctgagcgccctgtacagatgcgacctgagcgtgttccagctgtacagccccgccggcagcggcggcagaaacctgaccaccctgggcatcttcggcgccgccaccaacaaggtggtgtgcagcagccccctgtgccccgcctacagaaaggaggtggtgggcctggtggacgacagagtgtgcaagaagtgccccccccagagactggccagattcgaggaggagtgcagaaagtacagaaccctggtgatcaagggcgtgagagtgttcgacgtggccgtgctggcccccctgctgagagaccccgccctggacctgaaggtgatccacctggtgagagaccccagagccgtggccagcagcagaatcagaagcagacacggcctgatcagagagagcctgcaggtggtgagaagcagagaccccagagcccacagaatgcccttcctggaggccgccggccacaagctgggcgccaagaaggagggcgtgggcggccccgccgactaccacgccctgggcgccatggaggtgatctgcaacagcatggccaagaccctgcagaccgccctgcagccccccgactggctgcagggccactacctggtggtgagatacgaggacctggtgggcgaccccgtgaagaccctgagaagagtgtacgacttcgtgggcctgctggtgagccccgagatggagcagttcgccctgaacatgaccagcggcagcggcagcagcagcaagcccttcgtggtgagcgccagaaacgccacccaggccgccaacgcctggagaaccgccctgaccttccagcagatcaagcaggtggaggagttctgctaccagcccatggccgtgctgggctacgagagagtgaacagccccgaggaggtgaaggacctgagcaagaccctgctgagaaagcccagactgtag

SEQ ID NO: 75388 - DNA, 1071 bp, Artificial Sequence
  Description of Artificial Sequence: Synthetic coding sequence
atgcaccaccagtggctgctgctggccgcctgcttctgggtgatcttcatgttcatggtggccagcaagttcatcaccctgaccttcaaggaccccgacgtgtacagcgccaagcaggagttcctgttcctgaccaccatgcccgaggtgagaaagctgcccgaggagaagcacatccccgaggagctgaagcccaccggcaaggagctgcccgacagccagctggtgcagcccctggtgtacatggagagactggagctgatcagaaacgtgtgcagagacgacgccctgaagaacctgagccacacccccgtgagcaagttcgtgctggacagaatcttcgtgtgcgacaagcacaagatcctgttctgccagacccccaaggtgggcaacacccagtggaagaaggtgctgatcgtgctgaacggcgccttcagcagcatcgaggagatccccgagaacgtggtgcacgaccacgagaagaacggcctgcccagactgagcagcttcagcgacgccgagatccagaagagactgaagacctacttcaagttcttcatcgtgagagaccccttcgagagactgatcagcgccttcaaggacaagttcgtgcacaaccccagattcgagccctggtacagacacgagatcgcccccggcatcatcagaaagtacagaagaaacagaaccgagaccagaggcatccagttcgaggacttcgtgagatacctgggcgaccccaaccacagatggctggacctgcagttcggcgaccacatcatccactgggtgacctacgtggagctgtgcgccccctgcgagatcatgtacagcgtgatcggccaccacgagaccctggaggacgacgccccctacatcctgaaggaggccggcatcgaccacctggtgagctaccccaccatcccccccggcatcaccgtgtacaacagaaccaaggtggagcactacttcctgggcatcagcaagagagacatcagaagactgtacgccagattcgagggcgacttcaagctgttcggctaccagaagcccgacttcctgctgaactag

SEQ ID NO: 75389 - DNA, 426 bp, Artificial Sequence
  Description of Artificial Sequence: Synthetic coding sequence
atgcaccaccagtggctgctgctggccgcctgcttctgggtgatcttcatgttcatggtggccagcaagttcatcaccctgaccttcaaggaccccgacgtgtacagcgccaagcaggagttcctgttcctgaccaccatgcccgaggtgagaaagctgcccgaggagaagcacatccccgaggagctgaagcccaccggcaaggagctgcccgacagccagctggtgcagcccctggtgtacatggagagactggagctgatcagaaacgtgtgcagagacgacgccctgaagaacctgagccacacccccgtgagcaagttcgtgctggacagaatcttcgtgtgcgacaagcacaagatcctgttctgccagacccccaaggtgggcaacacccagtggaagaaggtgctgatcgtgctgtag

SEQ ID NO: 75390 - DNA, 1071 bp, Artificial Sequence; identical to SEQ ID NO: 75388
  Description of Artificial Sequence: Synthetic coding sequence

SEQ ID NO: 75391 - DNA, 195 bp, Artificial Sequence
  Description of Artificial Sequence: Synthetic coding sequence
atgcaccaccagtggctgctgctggccgcctgcttctgggtgatcttcatgttcatggtggccagcaagttcatcaccctgaccttcaaggaccccgacgtgtacagcgccaagcaggagttcctgttcctgaccaccatgcccgaggtgagaaagctgcccgaggagaagcacatccccgaggagctgaagtag

SEQ ID NO: 75392 - DNA, 402 bp, Artificial Sequence
  Description of Artificial Sequence: Synthetic coding sequence
atgcaccaccagtggctgctgctggccgcctgcttctgggtgatcttcatgttcatggtggccagcaagttcatcaccctgaccttcaaggaccccgacgtgtacagcgccaagcaggagttcctgttcctgaccaccatgcccgaggtgagaaagctgcccgaggagaagcacatccccgaggagctgaagcccaccggcaaggagctgcccgacagccagctggtgcagcccctggtgtacatggagagactggagctgatcagaaacgtgtgcagagacgacgccctgaagaacctgagccacacccccgtgagcaagttcgtgctggacagaatcttcgtgtgcgacaagcacaagatcctgttctgccagacccccaaggtgggcaacacccagtag

SEQ ID NO: 75393 - DNA, 258 bp, Artificial Sequence
  Description of Artificial Sequence: Synthetic coding sequence
atgcaccaccagtggctgctgctggccgcctgcttctgggtgatcttcatgttcatggtggccagcaagttcatcaccctgaccttcaaggaccccgacgtgtacagcgccaagcaggagttcctgttcctgaccaccatgcccgaggtgagaaagctgcccgaggagaagcacatccccgaggagctgaagcccaccggcaaggagctgcccgacagccagctggtgcagcccctggtgtacatggagagactgtag

SEQ ID NO: 75394 - DNA, 102 bp, Artificial Sequence
  Description of Artificial Sequence: Synthetic coding sequence
atgcaccaccagtggctgctgctggccgcctgcttctgggtgatcttcatgttcatggtggccagcaagttcatcaccctgaccttcaaggaccccgactag

SEQ ID NO: 75395 - DNA, 1215 bp, Artificial Sequence
  Description of Artificial Sequence: Synthetic coding sequence
atgcagagaaaggccggcaagaaggagcacgtgcagctgagagacaagagaaaccaggagccccagttcagaggcaacaccgccagaaagtgcgagccccaggccgccgagggcagagtgagcgagtggctgagatgcgacaacatgcaccaccagtggctgctgctggccgcctgcttctgggtgatcttcatgttcatggtggccagcaagttcatcaccctgaccttcaaggaccccgacgtgtacagcgccaagcaggagttcctgttcctgaccaccatgcccgaggtgagaaagctgcccgaggagaagcacatccccgaggagctgaagcccaccggcaaggagctgcccgacagccagctggtgcagcccctggtgtacatggagagactggagctgatcagaaacgtgtgcagagacgacgccctgaagaacctgagccacacccccgtgagcaagttcgtgctggacagaatcttcgtgtgcgacaagcacaagatcctgttctgccagacccccaaggtgggcaacacccagtggaagaaggtgctgatcgtgctgaacggcgccttcagcagcatcgaggagatccccgagaacgtggtgcacgaccacgagaagaacggcctgcccagactgagcagcttcagcgacgccgagatccagaagagactgaagacctacttcaagttcttcatcgtgagagaccccttcgagagactgatcagcgccttcaaggacaagttcgtgcacaaccccagattcgagccctggtacagacacgagatcgcccccggcatcatcagaaagtacagaagaaacagaaccgagaccagaggcatccagttcgaggacttcgtgagatacctgggcgaccccaaccacagatggctggacctgcagttcggcgaccacatcatccactgggtgacctacgtggagctgtgcgccccctgcgagatcatgtacagcgtgatcggccaccacgagaccctggaggacgacgccccctacatcctgaaggaggccggcatcgaccacctggtgagctaccccaccatcccccccggcatcaccgtgtacaacagaaccaaggtggagcactacttcctgggcatcagcaagagagacatcagaagactgtacgccagattcgagggcgacttcaagctgttcggctaccagaagcccgacttcctgctgaactag

SEQ ID NO: 75396 - DNA, 786 bp, Artificial Sequence
  Description of Artificial Sequence: Synthetic coding sequence
atggccagccccgactggggctacgacgacaagaacggccccgagcagtggagcaagctgtaccccatcgccaacggcaacaaccagagccccgtggacatcaagaccagcgagaccaagcacgacaccagcctgaagcccatcagcgtgagctacaaccccgccaccgccaaggagatcatcaacgtgggccacagcttccacgtgaacttcgaggacaacgacaacagaagcgtgctgaagggcggccccttcagcgacagctacagactgttccagttccacttccactggggcagcaccaacgagcacggcagcgagcacaccgtggacggcgtgaagtacagcgccgagctgcacgtggcccactggaacagcgccaagtacagcagcctggccgaggccgccagcaaggccgacggcctggccgtgatcggcgtgctgatgaaggtgggcgaggccaaccccaagctgcagaaggtgctggacgccctgcaggccatcaagaccaagggcaagagagcccccttcaccaacttcgaccccagcaccctgctgcccagcagcctggacttctggacctaccccggcagcctgacccacccccccctgtacgagagcgtgacctggatcatctgcaaggagagcatcagcgtgagcagcgagcagctggcccagttcagaagcctgctgagcaacgtggagggcgacaacgccgtgcccatgcagcacaacaacagacccacccagcccctgaagggcagaaccgtgagagccagcttctag

SEQ ID NO: 75397 - DNA, 786 bp, Artificial Sequence; identical to SEQ ID NO: 75396
  Description of Artificial Sequence: Synthetic coding sequence

SEQ ID NO: 75398 - DNA, 786 bp, Artificial Sequence; identical to SEQ ID NO: 75396
  Description of Artificial Sequence: Synthetic coding sequence

SEQ ID NO: 75399 - DNA, 531 bp, Artificial Sequence
  Description of Artificial Sequence: Synthetic coding sequence
atggccagccccgactggggctacgacgacaagaacggccccgagcagtggagcaagctgtaccccatcgccaacggcaacaaccagagccccgtggacatcaagaccagcgagaccaagcacgacaccagcctgaagcccatcagcgtgagctacaaccccgccaccgccaaggagatcatcaacgtgggccacagcttccacgtgaacttcgaggacaacgacaacagaagcgtgctgaagggcggccccttcagcgacagctacagactgttccagttccacttccactggggcagcaccaacgagcacggcagcgagcacaccgtggacggcgtgaagtacagcgccgagctgcacgtggcccactggaacagcgccaagtacagcagcctggccgaggccgccagcaaggccgacggcctggccgtgatcggcgtgctgatgaaggtgggcgaggccaaccccaagctgcagaaggtgctggacgccctgcaggccatcaagaccaagggcaagagagccccctag

SEQ ID NO: 75400 - DNA, 756 bp, Artificial Sequence
  Description of Artificial Sequence: Synthetic coding sequence
atggccagccccgactggggctacgacgacaagaacggccccgagcagtggagcaagctgtaccccatcgccaacggcaacaaccagagccccgtggacatcaagaccagcgagaccaagcacgacaccagcctgaagcccatcagcgtgagctacaaccccgccaccgccaaggagatcatcaacgtgggccacagcttccacgtgaacttcgaggacaacgacaacagaagcgtgctgaagggcggccccttcagcgacagctacagactgttccagttccacttccactggggcagcaccaacgagcacggcagcgagcacaccgtggacggcgtgaagtacagcgccgagctgcacgtggcccactggaacagcgccaagtacagcagcctggccgaggccgccagcaaggccgacggcctggccgtgatcggcgtgctgatgaaggtgggcgaggccaaccccaagctgcagaaggtgctggacgccctgcaggccatcaagaccaagggcaagagagcccccttcaccaacttcgaccccagcaccctgctgcccagcagcctggacttctggacctaccccggcagcctgacccacccccccctgtacgagagcgtgacctggatcatctgcaaggagagcatcagcgtgagcagcgagcagctggcccagttcagaagcctgctgagcaacgtggagggcgacaacgccgtgcccatgcagcacaacaacagacccacccagccctag

SEQ ID NO: 75401 - DNA, 69 bp, Artificial Sequence
  Description of Artificial Sequence: Synthetic coding sequence
atggccagccccgactggggctacgacgacaagaacggccccgagcagtggagcaagctgtacccctag

SEQ ID NO: 75402 - DNA, 450 bp, Artificial Sequence
  Description of Artificial Sequence: Synthetic coding sequence
atggccagccccgactggggctacgacgacaagaacggccccgagcagtggagcaagctgtaccccatcgccaacggcaacaaccagagccccgtggacatcaagaccagcgagaccaagcacgacaccagcctgaagcccatcagcgtgagctacaaccccgccaccgccaaggagatcatcaacgtgggccacagcttccacgtgaacttcgaggacaacgacaacagaagcgtgctgaagggcggccccttcagcgacagctacagactgttccagttccacttccactggggcagcaccaacgagcacggcagcgagcacaccgtggacggcgtgaagtacagcgccgagctgcacgtggcccactggaacagcgccaagtacagcagcctggccgaggccgccagcaaggccgacggcctggccgtgatcggcgtgctgatgtag

SEQ ID NO: 75403 - DNA, 450 bp, Artificial Sequence; identical to SEQ ID NO: 75402
  Description of Artificial Sequence: Synthetic coding sequence

SEQ ID NO: 75404 - DNA, 357 bp, Artificial Sequence
  Description of Artificial Sequence: Synthetic coding sequence
atggccagccccgactggggctacgacgacaagaacggccccgagcagtggagcaagctgtaccccatcgccaacggcaacaaccagagccccgtggacatcaagaccagcgagaccaagcacgacaccagcctgaagcccatcagcgtgagctacaaccccgccaccgccaaggagatcatcaacgtgggccacagcttccacgtgaacttcgaggacaacgacaacagaagcgtgctgaagggcggccccttcagcgacagctacagactgttccagttccacttccactggggcagcaccaacgagcacggcagcgagcacaccgtggacggcgtgaagtacagcgccgagtag

SEQ ID NO: 75405 - DNA, 447 bp, Artificial Sequence
  Description of Artificial Sequence: Synthetic coding sequence
atggccagccccgactggggctacgacgacaagaacggccccgagcagtggagcaagctgtaccccatcgccaacggcaacaaccagagccccgtggacatcaagaccagcgagaccaagcacgacaccagcctgaagcccatcagcgtgagctacaaccccgccaccgccaaggagatcatcaacgtgggccacagcttccacgtgaacttcgaggacaacgacaacagaagcgtgctgaagggcggccccttcagcgacagctacagactgttccagttccacttccactggggcagcaccaacgagcacggcagcgagcacaccgtggacggcgtgaagtacagcgccgagctgcacgtggcccactggaacagcgccaagtacagcagcctggccgaggccgccagcaaggccgacggcctggccgtgatcggcgtgctgtag

SEQ ID NO: 75406 - DNA, 786 bp, Artificial Sequence; identical to SEQ ID NO: 75396
  Description of Artificial Sequence: Synthetic coding sequence

SEQ ID NO: 75407 - DNA, 300 bp, Artificial Sequence
  Description of Artificial Sequence: Synthetic coding sequence
atggccagccccgactggggctacgacgacaagaacggccccgagcagtggagcaagctgtaccccatcgccaacggcaacaaccagagccccgtggacatcaagaccagcgagaccaagcacgacaccagcctgaagcccatcagcgtgagctacaaccccgccaccgccaaggagatcatcaacgtgggccacagcttccacgtgaacttcgaggacaacgacaacagaagcgtgctgaagggcggccccttcagcgacagctacagactgttccagttccacttccactggggctag

SEQ ID NO: 75408 - DNA, 786 bp, Artificial Sequence; identical to SEQ ID NO: 75396
  Description of Artificial Sequence: Synthetic coding sequence

SEQ ID NO: 75409 - DNA, 786 bp, Artificial Sequence; identical to SEQ ID NO: 75396
  Description of Artificial Sequence: Synthetic coding sequence

SEQ ID NO: 75410 - DNA, 783 bp, Artificial Sequence
  Description of Artificial Sequence: Synthetic coding sequence
atgagccaccactggggctacggcaagcacaacggccccgagcactggcacaaggacttccccatcgccaagggcgagagacagagccccgtggacatcgacacccacaccgccaagtacgaccccagcctgaagcccctgagcgtgagctacgaccaggccaccagcctgagaatcctgaacaacggccacgccttcaacgtggagttcgacgacagccaggacaaggccgtgctgaagggcggccccctggacggcacctacagactgatccagttccacttccactggggcagcctggacggccagggcagcgagcacaccgtggacaagaagaagtacgccgccgagctgcacctggtgcactggaacaccaagtacggcgacttcggcaaggccgtgcagcagcccgacggcctggccgtgctgggcatcttcctgaaggtgggcagcgccaagcccggcctgcagaaggtggtggacgtgctggacagcatcaagaccaagggcaagagcgccgacttcaccaacttcgaccccagaggcctgctgcccgagagcctggactactggacctaccccggcagcctgaccaccccccccctgctggagtgcgtgacctggatcgtgctgaaggagcccatcagcgtgagcagcgagcaggtgctgaagttcagaaagctgaacttcaacggcgagggcgagcccgaggagctgatggtggacaactggagacccgcccagcccctgaagaacagacagatcaaggccagcttcaagtag

SEQ ID NO: 75411 - DNA, 783 bp, Artificial Sequence
  Description of Artificial Sequence: Synthetic coding sequence
atggccaaggagtggggctacgccagccacaacggccccgaccactggcacgagctgttccccaacgccaagggcgagaaccagagccccgtggagctgcacaccaaggacatcagacacgaccccagcctgcagccctggagcgtgagctacgacggcggcagcgccaagaccatcctgaacaacggcaagacctgcagagtggtgttcgacgacacctacgacagaagcatgctgagaggcggccccctgcccggcccctacagactgagacagttccacctgcactggggcagcagcgacgaccacggcagcgagcacaccgtggacggcgtgaagtacgccgccgagctgcacctggtgcactggaaccccaagtacaacaccttcaaggaggccctgaagcagagagacggcatcgccgtgatcggcatcttcctgaagatcggccacgagaacggcgagttccagatcttcctggacgccctggacaagatcaagaccaagggcaaggaggcccccttcaccaagttcgaccccagctgcctgttccccgcctgcagagactactggacctaccagggcagcttcaccacccccccctgcgaggagtgcatcgtgtggctgctgctgaaggagcccatgaccgtgagcagcgaccagatggccaagctgagaagcctgctgagcagcgccgagaacgagccccccgtgcccctggtgagcaactggagacccccccagcccatcaacaacagagtggtgagagccagcttcaagtag

SEQ ID NO: 75412 - DNA, 735 bp, Artificial Sequence
  Description of Artificial Sequence: Synthetic coding sequence
atggccaaggagtggggctacgccagccacaacggccccgaccactggcacgagctgttccccaacgccaagggcgagaaccagagcccctggagcgtgagctacgacggcggcagcgccaagaccatcctgaacaacggcaagacctgcagagtggtgttcgacgacacctacgacagaagcatgctgagaggcggccccctgcccggcccctacagactgagacagttccacctgcactggggcagcagcgacgaccacggcagcgagcacaccgtggacggcgtgaagtacgccgccgagctgcacctggtgcactggaaccccaagtacaacaccttcaaggaggccctgaagcagagagacggcatcgccgtgatcggcatcttcctgaagatcggccacgagaacggcgagttccagatcttcctggacgccctggacaagatcaagaccaagggcaaggaggcccccttcaccaagttcgaccccagctgcctgttccccgcctgcagagactactggacctaccagggcagcttcaccacccccccctgcgaggagtgcatcgtgtggctgctgctgaaggagcccatgaccgtgagcagcgaccagatggccaagctgagaagcctgctgagcagcgccgagaacgagccccccgtgcccctggtgagcaactggagacccccccagcccatcaacaacagagtggtgagagccagcttcaagtag

SEQ ID NO: 75413 - DNA, 954 bp, Artificial Sequence
  Description of Artificial Sequence: Synthetic coding sequence
atggtggtgatgaacagcctgagagtgatcctgcaggccagccccggcaagctgctgtggagaaagttccagatccccagattcatgcccgccagaccctgcagcctgtacacctgcacctacaagaccagaaacagagccctgcaccccctgtgggagagcgtggacctggtgcccggcggcgacagacagagccccatcaacatcagatggagagacagcgtgtacgaccccggcctgaagcccctgaccatcagctacgaccccgccacctgcctgcacgtgtggaacaacggctacagcttcctggtggagttcgaggacagcaccgacaagagcgtgatcaagggcggccccctggagcacaactacagactgaagcagttccacttccactggggcgccatcgacgcctggggcagcgagcacaccgtggacagcaagtgcttccccgccgagctgcacctggtgcactggaacgccgtgagattcgagaacttcgaggacgccgccctggaggagaacggcctggccgtgatcggcgtgttcctgaagctgggcaagcaccacaaggagctgcagaagctggtggacaccctgcccagcatcaagcacaaggacgccctggtggagttcggcagcttcgaccccagctgcctgatgcccacctgccccgactactggacctacagcggcagcctgaccaccccccccctgagcgagagcgtgacctggatcatcaagaagcagcccgtggaggtggaccacgaccagctggagcagttcagaaccctgctgttcaccagcgagggcgagaaggagaagagaatggtggacaacttcagacccctgcagcccctgatgaacagaaccgtgagaagcagcttcagacacgactacgtgctgaacgtgcaggccaagcccaagcccgccaccagccaggccaccccctag

SEQ ID NO: 75414 - DNA, 954 bp, Artificial Sequence; identical to SEQ ID NO: 75413
  Description of Artificial Sequence: Synthetic coding sequence

SEQ ID NO: 75415 - DNA, 411 bp, Artificial Sequence
  Description of Artificial Sequence: Synthetic coding sequence
atggtggtgatgaacagcctgagagtgatcctgcaggccagccccggcaagctgctgtggagaaagttccagatccccagattcatgcccgccagaccctgcagcctgtacacctgcacctacaagaccagaaacagagccctgcaccccctgtgggagagcgtggacctggtgcccggcggcgacagacagagccccatcaacatcagatggagagacagcgtgtacgaccccggcctgaagcccctgaccatcagctacgaccccgccacctgcctgcacgtgtggaacaacggctacagcttcctggtggagttcgaggacagcaccgacaagagcgtgatcaagggcggccccctggagcacaactacagactgaagcagttccacttccactggggcgccatctag

SEQ ID NO: 75416 - DNA, 231 bp, Artificial Sequence
  Description of Artificial Sequence: Synthetic coding sequence
atggtggtgatgaacagcctgagagtgatcctgcaggccagccccggcaagctgctgtggagaaagttccagatccccagattcatgcccgccagaccctgcagcctgtacacctgcacctacaagaccagaaacagagccctgcaccccctgtgggagagcgtggacctggtgcccggcggcgacagacagagccccatcaacatcagatggagagacagcgtgtactag

SEQ ID NO: 75417 - DNA, 540 bp, Artificial Sequence
  Description of Artificial Sequence: Synthetic coding sequence
atgagagccctggtgctgctgctgagcctgttcctgctgggcggccaggcccagcacgtgagcgactggacctacagcgagggcgccctggacgaggcccactggccccagcactaccccgcctgcggcggccagagacagagccccatcaacctgcagagaaccaaggtgagatacaaccccagcctgaagggcctgaacatgaccggctacgagacccaggccggcgagttccccatggtgaacaacggccacaccgactggcaggccgagctgttcctgcccagcctgagcagcccctgcggcgagggcgccaagcacaagggccagagacagtggctgtgcagccccagcctggacagctggtgggaggccatcatcgacggcggcagcctgtgggccaccctggccgagtgcggcctgagagccgagggccccgaggagggcagacacatggaggagaagagccccgccagccagggcgcctgcagcggcagcagactgcccatcagcagaggcccctgcaccttcttcctgtag

SEQ ID NO: 75418 - DNA, 942 bp, Artificial Sequence
  Description of Artificial Sequence: Synthetic coding sequence
atgagagccctggtgctgctgctgagcctgttcctgctgggcggccaggcccagcacgtgagcgactggacctacagcgagggcgccctggacgaggcccactggccccagcactaccccgcctgcggcggccagagacagagccccatcaacctgcagagaaccaaggtgagatacaaccccagcctgaagggcctgaacatgaccggctacgagacccaggccggcgagttccccatggtgaacaacggccacaccgtgcagatcagcctgcccagcaccatgagaatgaccgtggccgacggcaccgtgtacatcgcccagcagatgcacttccactggggcggcgccagcagcgagatcagcggcagcgagcacaccgtggacggcatcagacacgtgatcgagatccacatcgtgcactacaacagcaagtacaagagctacgacatcgcccaggacgcccccgacggcctggccgtgctggccgccttcgtggaggtgaagaactaccccgagaacacctactacagcaacttcatcagccacctggccaacatcaagtaccccggccagagaaccaccctgaccggcctggacgtgcaggacatgctgcccagaaacctgcagcactactacacctaccacggcagcctgaccacccccccctgcaccgagaacgtgcactggttcgtgctggccgacttcgtgaagctgagcagaacccaggtgtggaagctggagaacagcctgctggaccacagaaacaagaccatccacaacgactacagaagaacccagcccctgaaccacagagtggtggagagcaacttccccaaccagggcaagggccacggcggccacagaggcagaagccagaaccccagagtgcagcccaccagcaccagacaccccctggccctgggcagcctggaggcctag

SEQ ID NO: 75419 - DNA, 927 bp, Artificial Sequence
  Description of Artificial Sequence: Synthetic coding sequence
atgagagccctggtgctgctgctgagcctgttcctgctgggcggccaggcccagcacgtgagcgactggacctacagcgagggcgccctggacgaggcccactggccccagcactaccccgcctgcggcggccagagacagagccccatcaacctgcagagaaccaaggtgagatacaaccccagcctgaagggcctgaacatgaccggctacgagacccaggccggcgagttccccatggtgaacaacggccacaccgtgcagatcagcctgcccagcaccatgagaatgaccgtggccgacggcaccgtgtacatcgcccagcagatgcacttccactggggcggcgccagcagcgagatcagcggcagcgagcacaccgtggacggcatcagacacgtgatcgagatccacatcgtgcactacaacagcaagtacaagagctacgacatcgcccaggacgcccccgacggcctggccgtgctggccgccttcgtggaggtgaagaactaccccgagaacacctactacagcaacttcatcagccacctggccaacatcaagtaccccggccagagaaccaccctgaccggcctggacgtgcaggacatgctgcccagaaacctgcagcactactacacctaccacggcagcctgaccacccccccctgcaccgagaacgtgcactggttcgtgctggccgacttcgtgaagctgagcagaacccaggtgtggaagctggagaacagcctgctggaccacagaaacaagaccatccacaacgactacagaagaacccagcccctgaaccacagagtggtggagagcaacttccccaaccaggagtacaccctgggcagcgagttccagttctacctgcacaagatcgaggagatcctggactacctgagaagagccctgaactag

SEQ ID NO: 75420 - DNA, 795 bp, Artificial Sequence
  Description of Artificial Sequence: Synthetic coding sequence
atgaccggccaccacggctggggctacggccaggacgacggccccagccactggcacaagctgtaccccatcgcccagggcgacagacagagccccatcaacatcatcagcagccaggccgtgtacagccccagcctgcagcccctggagctgagctacgaggcctgcatgagcctgagcatcaccaacaacggccacagcgtgcaggtggacttcaacgacagcgacgacagaaccgtggtgaccggcggccccctggagggcccctacagactgaagcagttccacttccactggggcaagaagcacgacgtgggcagcgagcacaccgtggacggcaagagcttccccagcgagctgcacctggtgcactggaacgccaagaagtacagcaccttcggcgaggccgccagcgcccccgacggcctggccgtggtgggcgtgttcctggagaccggcgacgagcaccccagcatgaacagactgaccgacgccctgtacatggtgagattcaagggcaccaaggcccagttcagctgcttcaaccccaagtgcctgctgcccgccagcagacactactggacctaccccggcagcctgaccaccccccccctgagcgagagcgtgacctggatcgtgctgagagagcccatctgcatcagcgagagacagatgggcaagttcagaagcctgctgttcaccagcgaggacgacgagagaatccacatggtgaacaacttcagacccccccagcccctgaagggcagagtggtgaaggccagcttcagagcctag

SEQ ID NO: 75421 - DNA, 627 bp, Artificial Sequence
  Description of Artificial Sequence: Synthetic coding sequence
atgagcctgagcatcaccaacaacggccacagcgtgcaggtggacttcaacgacagcgacgacagaaccgtggtgaccggcggccccctggagggcccctacagactgaagcagttccacttccactggggcaagaagcacgacgtgggcagcgagcacaccgtggacggcaagagcttccccagcgagctgcacctggtgcactggaacgccaagaagtacagcaccttcggcgaggccgccagcgcccccgacggcctggccgtggtgggcgtgttcctggagaccggcgacgagcaccccagcatgaacagactgaccgacgccctgtacatggtgagattcaagggcaccaaggcccagttcagctgcttcaaccccaagtgcctgctgcccgccagcagacactactggacctaccccggcagcctgaccaccccccccctgagcgagagcgtgacctggatcgtgctgagagagcccatctgcatcagcgagagacagatgggcaagttcagaagcctgctgttcaccagcgaggacgacgagagaatccacatggtgaacaacttcagacccccccagcccctgaagggcagagtggtgaaggccagcttcagagcctag

SEQ ID NO: 75422 - DNA, 873 bp, Artificial Sequence
  Description of Artificial Sequence: Synthetic coding sequence
atggccgacctgagcttcatcgaggacaccgtggccttccccgagaaggaggaggacgaggaggaggaggaggagggcgtggagtggggctacgaggagggcgtggagtggggcctggtgttccccgacgccaacggcgagtaccagagccccatcaacctgaacagcagagaggccagatacgaccccagcctgctggacgtgagactgagccccaactacgtggtgtgcagagactgcgaggtgaccaacgacggccacaccatccaggtgatcctgaagagcaagagcgtgctgagcggcggccccctgccccagggccacgagttcgagctgtacgaggtgagattccactggggcagagagaaccagagaggcagcgagcacaccgtgaacttcaaggccttccccatggagctgcacctgatccactggaacagcaccctgttcggcagcatcgacgaggccgtgggcaagccccacggcatcgccatcatcgccctgttcgtgcagatcggcaaggagcacgtgggcctgaaggccgtgaccgagatcctgcaggacatccagtacaagggcaagagcaagaccatcccctgcttcaaccccaacaccctgctgcccgaccccctgctgagagactactgggtgtacgagggcagcctgaccatccccccctgcagcgagggcgtgacctggatcctgttcagataccccctgaccatcagccagctgcagatcgaggagttcagaagactgagaacccacgtgaagggcgccgagctggtggagggctgcgacggcatcctgggcgacaacttcagacccacccagcccctgagcgacagagtgatcagagccgccttccagtag

SEQ ID NO: 75423 - DNA, 987 bp, Artificial Sequence
  Description of Artificial Sequence: Synthetic coding sequence
atggagatcgtgtgggaggtgctgttcctgctgcaggccaacttcatcgtgtgcatcagcgcccagcagaacagccccaagatccacgagggctggtgggcctacaaggaggtggtgcagggcagcttcgtgcccgtgcccagcttctggggcctggtgaacagcgcctggaacctgtgcagcgtgggcaagagacagagccccgtgaacatcgagaccagccacatgatcttcgaccccttcctgacccccctgagaatcaacaccggcggcagaaaggtgagcggcaccatgtacaacaccggcagacacgtgagcctgagactggacaaggagcacctggtgaacatcagcggcggccccatgacctacagccacagactggaggagatcagactgcacttcggcagcgaggacagccagggcagcgagcacctgctgaacggccaggccttcagcggcgaggtgcagctgatccactacaaccacgagctgtacaccaacgtgaccgaggccgccaagagccccaacggcctggtggtggtgagcatcttcatcaaggtgagcgacagcagcaaccccttcctgaacagaatgctgaacagagacaccatcaccagaatcacctacaagaacgacgcctacctgctgcagggcctgaacatcgaggagctgtaccccgagaccagcagcttcatcacctacgacggcagcatgaccatccccccctgctacgagaccgccagctggatcatcatgaacaagcccgtgtacatcaccagaatgcagatgcacagcctgagactgctgagccagaaccagcccagccagatcttcctgagcatgagcgacaacttcagacccgtgcagcccctgaacaacagatgcatcagaaccaacatcaacttcagcctgcagggcaaggactgccccaacaacagagcccagaagctgcagtacagagtgaacgagtggctgctgaagtag

SEQ ID NO: 75424 - DNA, 1005 bp, Artificial Sequence
  Description of Artificial Sequence: Synthetic coding sequence
atggccagcatcagaagcagaagcggctgcggcttcaccgagcccgacgagctgtgcatggtgggcgtgagagagaacgcccagcagaacagccccaagatccacgagggctggtgggcctacaaggaggtggtgcagggcagcttcgtgcccgtgcccagcttctggggcctggtgaacagcgcctggaacctgtgcagcgtgggcaagagacagagccccgtgaacatcgagaccagccacatgatcttcgaccccttcctgacccccctgagaatcaacaccggcggcagaaaggtgagcggcaccatgtacaacaccggcagacacgtgagcctgagactggacaaggagcacctggtgaacatcagcggcggccccatgacctacagccacagactggaggagatcagactgcacttcggcagcgaggacagccagggcagcgagcacctgctgaacggccaggccttcagcggcgaggtgcagctgatccactacaaccacgagctgtacaccaacgtgaccgaggccgccaagagccccaacggcctggtggtggtgagcatcttcatcaaggtgagcgacagcagcaaccccttcctgaacagaatgctgaacagagacaccatcaccagaatcacctacaagaacgacgcctacctgctgcagggcctgaacatcgaggagctgtaccccgagaccagcagcttcatcacctacgacggcagcatgaccatccccccctgctacgagaccgccagctggatcatcatgaacaagcccgtgtacatcaccagaatgcagatgcacagcctgagactgctgagccagaaccagcccagccagatcttcctgagcatgagcgacaacttcagacccgtgcagcccctgaacaacagatgcatcagaaccaacatcaacttcagcctgcagggcaaggactgccccaacaacagagcccagaagctgcagtacagagtgaacgagtggctgctgaagtag

SEQ ID NO: 75425 - DNA, 987 bp, Artificial Sequence; identical to SEQ ID NO: 75423
  Description of Artificial Sequence: Synthetic coding sequence

SEQ ID NO: 75426 - DNA, 987 bp, Artificial Sequence; identical to SEQ ID NO: 75423
  Description of Artificial Sequence: Synthetic coding sequence

SEQ ID NO: 75427 - DNA, 987 bp, Artificial Sequence
  Description of Artificial Sequence: Synthetic coding sequence
atgggcgccgccgccagactgagcgcccccagagccctggtgctgtgggccgccctgggcgccgccgcccacatcggccccgcccccgaccccgaggactggtggagctacaaggacaacctgcagggcaacttcgtgcccggcccccccttctggggcctggtgaacgccgcctggagcctgtgcgccgtgggcaagagacagagccccgtggacgtggagctgaagagagtgctgtacgaccccttcctgccccccctgagactgagcaccggcggcgagaagctgagaggcaccctgtacaacaccggcagacacgtgagcttcctgcccgcccccagacccgtggtgaacgtgagcggcggccccctgctgtacagccacagactgagcgagctgagactgctgttcggcgccagagacggcgccggcagcgagcaccagatcaaccaccagggcttcagcgccgaggtgcagctgatccacttcaaccaggagctgtacggcaacttcagcgccgccagcagaggccccaacggcctggccatcctgagcctgttcgtgaacgtggccagcaccagcaaccccttcctgagcagactgctgaacagagacaccatcaccagaatcagctacaagaacgacgcctacttcctgcaggacctgagcctggagctgctgttccccgagagcttcggcttcatcacctaccagggcagcctgagcacccccccctgcagcgagaccgtgacctggatcctgatcgacagagccctgaacatcaccagcctgcagatgcacagcctgagactgctgagccagaacccccccagccagatcttccagagcctgagcggcaacagcagacccctgcagcccctggcccacagagccctgagaggcaacagagaccccagacaccccgagagaagatgcagaggccccaactacagactgcacgtggacggcgtgccccacggcagatag

SEQ ID NO: 75428 - DNA, 1065 bp, Artificial Sequence
  Description of Artificial Sequence: Synthetic coding sequence
atgcccagaagaagcctgcacgccgccgccgtgctgctgctggtgatcctgaaggagcagcccagcagccccgcccccgtgaacggcagcaagtggacctacttcggccccgacggcgagaacagctggagcaagaagtaccccagctgcggcggcctgctgcagagccccatcgacctgcacagcgacatcctgcagtacgacgccagcctgacccccctggagttccagggctacaacctgagcgccaacaagcagttcctgctgaccaacaacggccacagcgtgaagctgaacctgcccagcgacatgcacatccagggcctgcagagcagatacagcgccacccagctgcacctgcactggggcaaccccaacgacccccacggcagcgagcacaccgtgagcggccagcacttcgccgccgagctgcacatcgtgcactacaacagcgacctgtaccccgacgccagcaccgccagcaacaagagcgagggcctggccgtgctggccgtgctgatcgagatgggcagcttcaaccccagctacgacaagatcttcagccacctgcagcacgtgaagtacaagggccaggaggccttcgtgcccggcttcaacatcgaggagctgctgcccgagagaaccgccgagtactacagatacagaggcagcctgaccacccccccctgcaaccccaccgtgctgtggaccgtgttcagaaaccccgtgcagatcagccaggagcagctgctggccctggagaccgccctgtactgcacccacatggacgaccccagccccagagagatgatcaacaacttcagacaggtgcagaagttcgacgagagactggtgtacaccagcttcagccaggtgcaggtgtgcaccgccgccggcctgagcctgggcatcatcctgagcctggccctggccggcatcctgggcatctgcatcgtggtggtggtgagcatctggctgttcagaagaaagagcatcaagaagggcgacaacaagggcgtgatctacaagcccgccaccaagatggagaccgaggcccacgcctag

SEQ ID NO: 75429 - DNA, 1032 bp, Artificial Sequence
  Description of Artificial Sequence: Synthetic coding sequence
atgcccagaagaagcctgcacgccgccgccgtgctgctgctggtgatcctgaaggagcagcccagcagccccgcccccgtgaacggcagcaagtggacctacttcggccccgacggcgagaacagctggagcaagaagtaccccagctgcggcggcctgctgcagagccccatcgacctgcacagcgacatcctgcagtacgacgccagcctgacccccctggagttccagggctacaacctgagcgccaacaagcagttcctgctgaccaacaacggccacagcgtgaagctgaacctgcccagcgacatgcacatccagggcctgcagagcagatacagcgccacccagctgcacctgcactggggcaaccccaacgacccccacggcagcgagcacaccgtgagcggccagcacttcgccgccgagctgcacatcgtgcactacaacagcgacctgtaccccgacgccagcaccgccagcaacaagagcgagggcctggccgtgctggccgtgctgatcgagatgggcagcttcaaccccagctacgacaagatcttcagccacctgcagcacgtgaagtacaagggccaggaggccttcgtgcccggcttcaacatcgaggagctgctgcccgagagaaccgccgagtactacagatacagaggcagcctgaccacccccccctgcaaccccaccgtgctgtggaccgtgttcagaaaccccgtgcagatcagccaggagcagctgctggccctggagaccgccctgtactgcacccacatggacgaccccagccccagagagatgatcaacaacttcagacaggtgcagaagttcgacgagagactggtgtacaccagcttcagccagggcatcatcctgagcctggccctggccggcatcctgggcatctgcatcgtggtggtggtgagcatctggctgttcagaagaaagagcatcaagaagggcgacaacaagggcgtgatctacaagcccgccaccaagatggagaccgaggcccacgcctag

SEQ ID NO: 75430 - DNA, 852 bp, Artificial Sequence
  Description of Artificial Sequence: Synthetic coding sequence
atgcccagaagaagcctgcacgccgccgccgtgctgctgctggtgatcctgaaggagcagcccagcagccccgcccccgtgaacggcagcaagtggacctacttcgtgaagctgaacctgcccagcgacatgcacatccagggcctgcagagcagatacagcgccacccagctgcacctgcactggggcaaccccaacgacccccacggcagcgagcacaccgtgagcggccagcacttcgccgccgagctgcacatcgtgcactacaacagcgacctgtaccccgacgccagcaccgccagcaacaagagcgagggcctggccgtgctggccgtgctgatcgagatgggcagcttcaaccccagctacgacaagatcttcagccacctgcagcacgtgaagtacaagggccaggaggccttcgtgcccggcttcaacatcgaggagctgctgcccgagagaaccgccgagtactacagatacagaggcagcctgaccacccccccctgcaaccccaccgtgctgtggaccgtgttcagaaaccccgtgcagatcagccaggagcagctgctggccctggagaccgccctgtactgcacccacatggacgaccccagccccagagagatgatcaacaacttcagacaggtgcagaagttcgacgagagactggtgtacaccagcttcagccagggcatcatcctgagcctggccctggccggcatcctgggcatctgcatcgtggtggtggtgagcatctggctgttcagaagaaagagcatcaagaagggcgacaacaagggcgtgatctacaagcccgccaccaagatggagaccgaggcccacgcctag

SEQ ID NO: 75431 - DNA, 1014 bp, Artificial Sequence
  Description of Artificial Sequence: Synthetic coding sequence
atgctgttcagcgccctgctgctggaggtgatctggatcctggccgccgacggcggccagcactggacctacgagggcccccacggccaggaccactggcccgccagctaccccgagtgcggcaacaacgcccagagccccatcgacatccagaccgacagcgtgaccttcgaccccgacctgcccgccctgcagccccacggctacgaccagcccggcaccgagcccctggacctgcacaacaacggccacaccgtgcagctgagcctgcccagcaccctgtacctgggcggcctgcccagaaagtacgtggccgcccagctgcacctgcactggggccagaagggcagccccggcggcagcgagcaccagatcaacagcgaggccaccttcgccgagctgcacatcgtgcactacgacagcgacagctacgacagcctgagcgaggccgccgagagaccccagggcctggccgtgctgggcatcctgatcgaggtgggcgagaccaagaacatcgcctacgagcacatcctgagccacctgcacgaggtgagacacaaggaccagaagaccagcgtgccccccttcaacctgagagagctgctgcccaagcagctgggccagtacttcagatacaacggcagcctgaccacccccccctgctaccagagcgtgctgtggaccgtgttctacagaagaagccagatcagcatggagcagctggagaagctgcagggcaccctgttcagcaccgaggaggagcccagcaagctgctggtgcagaactacagagccctgcagcccctgaaccagagaatggtgttcgccagcttcatccaggccggcagcagctacaccaccggcgagatgctgagcctgggcgtgggcatcctggtgggctgcctgtgcctgctgctggccgtgtacttcatcgccagaaagatcagaaagaagagactggagaacagaaagagcgtggtgttcaccagcgcccaggccaccaccgaggcctag

SEQ ID NO: 75432 - DNA, 834 bp, Artificial Sequence
  Description of Artificial Sequence: Synthetic coding sequence
atgagcagcggcatccacgtggccctggtgaccggcggcaacaagggcatcggcctggccatcgtgagagacctgtgcagactgttcagcggcgacgtggtgctgaccgccagagacgtgaccagaggccaggccgccgtgcagcagctgcaggccgagggcctgagccccagattccaccagctggacatcgacgacctgcagagcatcagagccctgagagacttcctgagaaaggagtacggcggcctggacgtgctggtgaacaacgccggcatcgccttcaaggtggccgaccccacccccttccacatccaggccgaggtgaccatgaagaccaacttcttcggcaccagagacgtgtgcaccgagctgctgcccctgatcaagccccagggcagagtggtgaacgtgagcagcatcatgagcgtgagagccctgaagagctgcagccccgagctgcagcagaagttcagaagcgagaccatcaccgaggaggagctggtgggcctgatgaacaagttcgtggaggacaccaagaagggcgtgcaccagaaggagggctggcccagcagcgcctacggcgtgaccaagatcggcgtgaccgtgctgagcagaatccacgccagaaagctgagcgagcagagaaagggcgacaagatcctgctgaacgcctgctgccccggctgggtgagaaccgacatggccggccccaaggccaccaagagccccgaggagggcgccgagacccccgtgtacctggccctgctgccccccgacgccgagggcccccacggccagttcgtgagcgagaagagagtggagcagtggtag

SEQ ID NO: 75433 - DNA, 834 bp, Artificial Sequence
  Description of Artificial Sequence: Synthetic coding sequence
atgagcagctgcagcagagtggccctggtgaccggcgccaacagaggcatcggcctggccatcgccagagagctgtgcagacagttcagcggcgacgtggtgctgaccgccagagacgtggccagaggccaggccgccgtgcagcagctgcaggccgagggcctgagccccagattccaccagctggacatcgacgacctgcagagcatcagagccctgagagacttcctgagaaaggagtacggcggcctgaacgtgctggtgaacaacgccgccgtggccttcaagagcgacgaccccatgcccttcgacatcaaggccgagatgaccctgaagaccaacttcttcgccaccagaaacatgtgcaacgagctgctgcccatcatgaagccccacggcagagtggtgaacatcagcagcctgcagtgcctgagagccttcgagaactgcagcgaggacctgcaggagagattccacagcgagaccctgaccgagggcgacctggtggacctgatgaagaagttcgtggaggacaccaagaacgaggtgcacgagagagagggctggcccaacagcccctacggcgtgagcaagctgggcgtgaccgtgctgagcagaatcctggccagaagactggacgagaagagaaaggccgacagaatcctggtgaacgcctgctgccccggccccgtgaagaccgacatggacggcaaggacagcatcagaaccgtggaggagggcgccgagacccccgtgtacctggccctgctgccccccgacgccaccgagccccagggccagctggtgcacgacaaggtggtgcagaactggtag

SEQ ID NO: 75434 - DNA, 2169 bp, Artificial Sequence
  Description of Artificial Sequence: Synthetic coding sequence
atgctgaccatgggcagactgcagctggtggtgctgggcctgacctgctgctgggccgtggccagcgccgccaagctgggcgccgtgtacaccgagggcggcttcgtggagggcgtgaacaagaagctgggcctgctgggcgacagcgtggacatcttcaagggcatccccttcgccgcccccaccaaggccctggagaacccccagccccaccccggctggcagggcaccctgaaggccaagaacttcaagaagagatgcctgcaggccaccatcacccaggacagcacctacggcgacgaggactgcctgtacctgaacatctgggtgccccagggcagaaagcaggtgagcagagacctgcccgtgatgatctggatctacggcggcgccttcctgatgggcagcggccacggcgccaacttcctgaacaactacctgtacgacggcgaggagatcgccaccagaggcaacgtgatcgtggtgaccttcaactacagagtgggccccctgggcttcctgagcaccggcgacgccaacctgcccggcaactacggcctgagagaccagcacatggccatcgcctgggtgaagagaaacatcgccgccttcggcggcgaccccaacaacatcaccctgttcggcgagagcgccggcggcgccagcgtgagcctgcagaccctgagcccctacaacaagggcctgatcagaagagccatcagccagagcggcgtggccctgagcccctgggtgatccagaagaaccccctgttctgggccaagaaggtggccgagaaggtgggctgccccgtgggcgacgccgccagaatggcccagtgcctgaaggtgaccgaccccagagccctgaccctggcctacaaggtgcccctggccggcctggagtaccccatgctgcactacgtgggcttcgtgcccgtgatcgacggcgacttcatccccgccgaccccatcaacctgtacgccaacgccgccgacatcgactacatcgccggcaccaacaacatggacggccacatcttcgccagcatcgacatgcccgccatcaacaagggcaacaagaaggtgaccgaggacttctacaagctggtgagcgagttcaccatcaccaagggcctgagaggcgccaagaccaccttcgacgtgtacaccgagagctgggcccaggaccccagccaggagaacaagaagaagaccgtggtggacttcgagaccgacgtgctgttcctggtgcccaccgagatcgccctggcccagcacagagccaacgccaagagcgccaagacctacgcctacctgttcagccaccccagcagaatgcccgtgtaccccaagtgggtgggcgccgaccacgccgacgacatccagtacgtgttcggcaagcccttcgccacccccaccggctacagaccccaggacagaaccgtgagcaaggccatgatcgcctactggaccaacttcgccaagaccggcgaccccaacatgggcgacagcgccgtgcccacccactgggagccctacaccaccgagaacagcggctacctggagatcaccaagaagatgggcagcagcagcatgaagagaagcctgagaaccaacttcctgagatactggaccctgacctacctggccctgcccaccgtgaccgaccaggaggccacccccgtgccccccaccggcgacagcgaggccacccccgtgccccccaccggcgacagcgagaccgcccccgtgccccccaccggcgacagcggcgccccccccgtgccccccaccggcgacagcggcgccccccccgtgccccccaccggcgacagcggcgccccccccgtgccccccaccggcgacagcggcgccccccccgtgccccccaccggcgacagcggcgccccccccgtgccccccaccggcgacgccggccccccccccgtgccccccaccggcgacagcggcgccccccccgtgccccccaccggcgacagcggcgccccccccgtgacccccaccggcgacagcgagaccgcccccgtgccccccaccggcgacagcggcgccccccccgtgccccccaccggcgacagcgaggccgcccccgtgccccccaccgacgacagcaaggaggcccagatgcccgccgtgatcagattctag

SEQ ID NO: 75435 - DNA, 2064 bp, Artificial Sequence
  Description of Artificial Sequence: Synthetic coding sequence
atgggcagactgcagctggtggtgctgggcctgacctgctgctgggccgtggccagcgccgccaagctgggcgccgtgtacaccgagggcggcttcgtggagggcgtgaacaagaagctgggcctgctgggcgacagcgtggacatcttcaagggcatccccttcgccgcccccaccaaggccctggagaacccccagccccaccccggctggcagggcaccctgaaggccaagaacttcaagaagagatgcctgcaggccaccatcacccaggacagcacctacggcgacgaggactgcctgtacctgaacatctgggtgccccagggcagaaagcaggtgagcagagacctgcccgtgatgatctggatctacggcggcgccttcctgatgggcagcggccacggcgccaacttcctgaacaactacctgtacgacggcgaggagatcgccaccagaggcaacgtgatcgtggtgaccttcaactacagagtgggccccctgggcttcctgagcaccggcgacgccaacctgcccggcaactacggcctgagagaccagcacatggccatcgcctgggtgaagagaaacatcgccgccttcggcggcgaccccaacaacatcaccctgttcggcgagagcgccggcggcgccagcgtgagcctgcagaccctgagcccctacaacaagggcctgatcagaagagccatcagccagagcggcgtggccctgagcccctgggtgatccagaagaaccccctgttctgggccaagaaggtggccgagaaggtgggctgccccgtgggcgacgccgccagaatggcccagtgcctgaaggtgaccgaccccagagccctgaccctggcctacaaggtgcccctggccggcctggagtaccccatgctgcactacgtgggcttcgtgcccgtgatcgacggcgacttcatccccgccgaccccatcaacctgtacgccaacgccgccgacatcgactacatcgccggcaccaacaacatggacggccacatcttcgccagcatcgacatgcccgccatcaacaagggcaacaagaaggtgaccgaggaggacttctacaagctggtgagcgagttcaccatcaccaagggcctgagaggcgccaagaccaccttcgacgtgtacaccgagagctgggcccaggaccccagccaggagaacaagaagaagaccgtggtggacttcgagaccgacgtgctgttcctggtgcccaccgagatcgccctggcccagcacagagccaacgccaaggaccccaacatgggcgacagcgccgtgcccacccactgggagccctacaccaccgagaacagcggctacctggagatcaccaagaagatgggcagcagcagcatgaagagaagcctgagaaccaacttcctgagatactggaccctgacctacctggccctgcccaccgtgaccgaccaggaggccacccccgtgccccccaccggcgacagcgaggccacccccgtgccccccaccggcgacagcgagaccgcccccgtgccccccaccggcgacagcggcgccccccccgtgccccccaccggcgacagcggcgccccccccgtgccccccaccggcgacagcggcgccccccccgtgccccccaccggcgacagcggcgccccccccgtgccccccaccggcgacagcggcgccccccccgtgccccccaccggcgacagcggcgccccccccgtgccccccaccggcgacagcggcgccccccccgtgccccccaccggcgacagcggcgccccccccgtgccccccaccggcgacgccggccccccccccgtgccccccaccggcgacagcggcgccccccccgtgccccccaccggcgacagcggcgccccccccgtgacccccaccggcgacagcgagaccgcccccgtgccccccaccggcgacagcggcgccccccccgtgccccccaccggcgacagcgaggccgcccccgtgccccccaccgacgacagcaaggaggcccagatgcccgccgtgatcagattctag

SEQ ID NO: 75436 - DNA, 2271 bp, Artificial Sequence
  Description of Artificial Sequence: Synthetic coding sequence
atgctgaccatgggcagactgcagctggtggtgctgggcctgacctgctgctgggccgtggccagcgccgccaagctgggcgccgtgtacaccgagggcggcttcgtggagggcgtgaacaagaagctgggcctgctgggcgacagcgtggacatcttcaagggcatccccttcgccgcccccaccaaggccctggagaacccccagccccaccccggctggcagggcaccctgaaggccaagaacttcaagaagagatgcctgcaggccaccatcacccaggacagcacctacggcgacgaggactgcctgtacctgaacatctgggtgccccagggcagaaagcaggtgagcagagacctgcccgtgatgatctggatctacggcggcgccttcctgatgggcagcggccacggcgccaacttcctgaacaactacctgtacgacggcgaggagatcgccaccagaggcaacgtgatcgtggtgaccttcaactacagagtgggccccctgggcttcctgagcaccggcgacgccaacctgcccggcaactacggcctgagagaccagcacatggccatcgcctgggtgaagagaaacatcgccgccttcggcggcgaccccaacaacatcaccctgttcggcgagagcgccggcggcgccagcgtgagcctgcagaccctgagcccctacaacaagggcctgatcagaagagccatcagccagagcggcgtggccctgagcccctgggtgatccagaagaaccccctgttctgggccaagaaggtggccgagaaggtgggctgccccgtgggcgacgccgccagaatggcccagtgcctgaaggtgaccgaccccagagccctgaccctggcctacaaggtgcccctggccggcctggagtaccccatgctgcactacgtgggcttcgtgcccgtgatcgacggcgacttcatccccgccgaccccatcaacctgtacgccaacgccgccgacatcgactacatcgccggcaccaacaacatggacggccacatcttcgccagcatcgacatgcccgccatcaacaagggcaacaagaaggtgaccgaggaggacttctacaagctggtgagcgagttcaccatcaccaagggcctgagaggcgccaagaccaccttcgacgtgtacaccgagagctgggcccaggaccccagccaggagaacaagaagaagaccgtggtggacttcgagaccgacgtgctgttcctggtgcccaccgagatcgccctggcccagcacagagccaacgccaagagcgccaagacctacgcctacctgttcagccaccccagcagaatgcccgtgtaccccaagtgggtgggcgccgaccacgccgacgacatccagtacgtgttcggcaagcccttcgccacccccaccggctacagaccccaggacagaaccgtgagcaaggccatgatcgcctactggaccaacttcgccaagaccggcgaccccaacatgggcgacagcgccgtgcccacccactgggagccctacaccaccgagaacagcggctacctggagatcaccaagaagatgggcagcagcagcatgaagagaagcctgagaaccaacttcctgagatactggaccctgacctacctggccctgcccaccgtgaccgaccaggaggccacccccgtgccccccaccggcgacagcgaggccacccccgtgccccccaccggcgacagcgagaccgcccccgtgccccccaccggcgacagcggcgccccccccgtgccccccaccggcgacagcggcgccccccccgtgccccccaccggcgacagcggcgccccccccgtgccccccaccggcgacagcggcgccccccccgtgccccccaccggcgacagcggcgccccccccgtgccccccaccggcgacagcggcgccccccccgtgccccccaccggcgacagcggcgccccccccgtgccccccaccggcgacagcggcgccccccccgtgccccccaccggcgacgccggccccccccccgtgccccccaccggcgacagcggcgccccccccgtgccccccaccggcgacagcggcgccccccccgtgacccccaccggcgacagcgagaccgcccccgtgccccccaccggcgacagcggcgccccccccgtgccccccaccggcgacagcgaggccgcccccgtgccccccaccgacgacagcaaggaggcccagatgcccgccgtgatcagattctag

SEQ ID NO: 75437 - DNA, 1707 bp, Artificial Sequence
  Description of Artificial Sequence: Synthetic coding sequence
atgtggctgagagccttcatcctggccaccctgagcgccagcgccgcctgggccggccaccccagcagcccccccgtggtggacaccgtgcacggcaaggtgctgggcaagttcgtgagcctggagggcttcgcccagcccgtggccatcttcctgggcatccccttcgccaagccccccctgggccccctgagattcacccccccccagcccgccgagccctggagcttcgtgaagaacgccaccagctacccccccatgtgcacccaggaccccaaggccggccagctgctgagcgagctgttcaccaacagaaaggagaacatccccctgaagctgagcgaggactgcctgtacctgaacatctacacccccgccgacctgaccaagaagaacagactgcccgtgatggtgtggatccacggcggcggcctgatggtgggcgccgccagcacctacgacggcctggccctggccgcccacgagaacgtggtggtggtgaccatccagtacagactgggcatctggggcttcttcagcaccggcgacgagcacagcagaggcaactggggccacctggaccaggtggccgccctgagatgggtgcaggacaacatcgccagcttcggcggcaaccccggcagcgtgaccatcttcggcgagagcgccggcggcgagagcgtgagcgtgctggtgctgagccccctggccaagaacctgttccacagagccatcagcgagagcggcgtggccctgaccagcgtgctggtgaagaagggcgacgtgaagcccctggccgagcagatcgccatcaccgccggctgcaagaccaccaccagcgccgtgatggtgcactgcctgagacagaagaccgaggaggagctgctggagaccaccctgaagatgaagttcctgagcctggacctgcagggcgaccccagagagagccagcccctgctgggcaccgtgatcgacggcatgctgctgctgaagacccccgaggagctgcaggccgagagaaacttccacaccgtgccctacatggtgggcatcaacaagcaggagttcggctggctgatccccatgcagctgatgagctaccccctgagcgagggccagctggaccagaagaccgccatgagcctgctgtggaagagctaccccctggtgtgcatcgccaaggagctgatccccgaggccaccgagaagtacctgggcggcaccgacgacaccgtgaagaagaaggacctgttcctggacctgatcgccgacgtgatgttcggcgtgcccagcgtgatcgtggccagaaaccacagagacgccggcgcccccacctacatgtacgagttccagtacagacccagcttcagcagcgacatgaagcccaagaccgtgatcggcgaccacggcgacgagctgttcagcgtgttcggcgcccccttcctgaaggagggcgccagcgaggaggagatcagactgagcaagatggtgatgaagttctgggccaacttcgccagaaacggcaaccccaacggcgagggcctgccccactggcccgagtacaaccagaaggagggctacctgcagatcggcgccaacacccaggccgcccagaagctgaaggacaaggaggtggccttctggaccaacctgttcgccaagaaggccgtggagaagcccccccagaccgagcacatcgagctgtag

SEQ ID NO: 75438 - DNA, 1704 bp, Artificial Sequence
  Description of Artificial Sequence: Synthetic coding sequence
atgtggctgagagccttcatcctggccaccctgagcgccagcgccgcctggggccaccccagcagcccccccgtggtggacaccgtgcacggcaaggtgctgggcaagttcgtgagcctggagggcttcgcccagcccgtggccatcttcctgggcatccccttcgccaagccccccctgggccccctgagattcacccccccccagcccgccgagccctggagcttcgtgaagaacgccaccagctacccccccatgtgcacccaggaccccaaggccggccagctgctgagcgagctgttcaccaacagaaaggagaacatccccctgaagctgagcgaggactgcctgtacctgaacatctacacccccgccgacctgaccaagaagaacagactgcccgtgatggtgtggatccacggcggcggcctgatggtgggcgccgccagcacctacgacggcctggccctggccgcccacgagaacgtggtggtggtgaccatccagtacagactgggcatctggggcttcttcagcaccggcgacgagcacagcagaggcaactggggccacctggaccaggtggccgccctgagatgggtgcaggacaacatcgccagcttcggcggcaaccccggcagcgtgaccatcttcggcgagagcgccggcggcgagagcgtgagcgtgctggtgctgagccccctggccaagaacctgttccacagagccatcagcgagagcggcgtggccctgaccagcgtgctggtgaagaagggcgacgtgaagcccctggccgagcagatcgccatcaccgccggctgcaagaccaccaccagcgccgtgatggtgcactgcctgagacagaagaccgaggaggagctgctggagaccaccctgaagatgaagttcctgagcctggacctgcagggcgaccccagagagagccagcccctgctgggcaccgtgatcgacggcatgctgctgctgaagacccccgaggagctgcaggccgagagaaacttccacaccgtgccctacatggtgggcatcaacaagcaggagttcggctggctgatccccatgcagctgatgagctaccccctgagcgagggccagctggaccagaagaccgccatgagcctgctgtggaagagctaccccctggtgtgcatcgccaaggagctgatccccgaggccaccgagaagtacctgggcggcaccgacgacaccgtgaagaagaaggacctgttcctggacctgatcgccgacgtgatgttcggcgtgcccagcgtgatcgtggccagaaaccacagagacgccggcgcccccacctacatgtacgagttccagtacagacccagcttcagcagcgacatgaagcccaagaccgtgatcggcgaccacggcgacgagctgttcagcgtgttcggcgcccccttcctgaaggagggcgccagcgaggaggagatcagactgagcaagatggtgatgaagttctgggccaacttcgccagaaacggcaaccccaacggcgagggcctgccccactggcccgagtacaaccagaaggagggctacctgcagatcggcgccaacacccaggccgcccagaagctgaaggacaaggaggtggccttctggaccaacctgttcgccaagaaggccgtggagaagcccccccagaccgagcacatcgagctgtag

SEQ ID NO: 75439 - DNA, 1701 bp, Artificial Sequence
  Description of Artificial Sequence: Synthetic coding sequence
atgtggctgagagccttcatcctggccaccctgagcgccagcgccgcctggggccaccccagcagcccccccgtggtggacaccgtgcacggcaaggtgctgggcaagttcgtgagcctggagggcttcgcccagcccgtggccatcttcctgggcatccccttcgccaagccccccctgggccccctgagattcacccccccccagcccgccgagccctggagcttcgtgaagaacgccaccagctacccccccatgtgcacccaggaccccaaggccggccagctgctgagcgagctgttcaccaacagaaaggagaacatccccctgaagctgagcgaggactgcctgtacctgaacatctacacccccgccgacctgaccaagaagaacagactgcccgtgatggtgtggatccacggcggcggcctgatggtgggcgccgccagcacctacgacggcctggccctggccgcccacgagaacgtggtggtggtgaccatccagtacagactgggcatctggggcttcttcagcaccggcgacgagcacagcagaggcaactggggccacctggaccaggtggccgccctgagatgggtgcaggacaacatcgccagcttcggcggcaaccccggcagcgtgaccatcttcggcgagagcgccggcggcgagagcgtgagcgtgctggtgctgagccccctggccaagaacctgttccacagagccatcagcgagagcggcgtggccctgaccagcgtgctggtgaagaagggcgacgtgaagcccctggccgagcagatcgccatcaccgccggctgcaagaccaccaccagcgccgtgatggtgcactgcctgagacagaagaccgaggaggagctgctggagaccaccctgaagatgaagttcctgagcctggacctgcagggcgaccccagagagagccagcccctgctgggcaccgtgatcgacggcatgctgctgctgaagacccccgaggagctgcaggccgagagaaacttccacaccgtgccctacatggtgggcatcaacaagcaggagttcggctggctgatccccatgctgatgagctaccccctgagcgagggccagctggaccagaagaccgccatgagcctgctgtggaagagctaccccctggtgtgcatcgccaaggagctgatccccgaggccaccgagaagtacctgggcggcaccgacgacaccgtgaagaagaaggacctgttcctggacctgatcgccgacgtgatgttcggcgtgcccagcgtgatcgtggccagaaaccacagagacgccggcgcccccacctacatgtacgagttccagtacagacccagcttcagcagcgacatgaagcccaagaccgtgatcggcgaccacggcgacgagctgttcagcgtgttcggcgcccccttcctgaaggagggcgccagcgaggaggagatcagactgagcaagatggtgatgaagttctgggccaacttcgccagaaacggcaaccccaacggcgagggcctgccccactggcccgagtacaaccagaaggagggctacctgcagatcggcgccaacacccaggccgcccagaagctgaaggacaaggaggtggccttctggaccaacctgttcgccaagaaggccgtggagaagcccccccagaccgagcacatcgagctgtag

SEQ ID NO: 75440 - DNA, 1299 bp, Artificial Sequence
  Description of Artificial Sequence: Synthetic coding sequence
atggtgtggatccacggcggcggcctgatggtgggcgccgccagcacctacgacggcctggccctggccgcccacgagaacgtggtggtggtgaccatccagtacagactgggcatctggggcttcttcagcaccggcgacgagcacagcagaggcaactggggccacctggaccaggtggccgccctgagatgggtgcaggacaacatcgccagcttcggcggcaaccccggcagcgtgaccatcttcggcgagagcgccggcggcgagagcgtgagcgtgctggtgctgagccccctggccaagaacctgttccacagagccatcagcgagagcggcgtggccctgaccagcgtgctggtgaagaagggcgacgtgaagcccctggccgagcagatcgccatcaccgccggctgcaagaccaccaccagcgccgtgatggtgcactgcctgagacagaagaccgaggaggagctgctggagaccaccctgaagatgaagttcctgagcctggacctgcagggcgaccccagagagagccagcccctgctgggcaccgtgatcgacggcatgctgctgctgaagacccccgaggagctgcaggccgagagaaacttccacaccgtgccctacatggtgggcatcaacaagcaggagttcggctggctgatccccatgcagctgatgagctaccccctgagcgagggccagctggaccagaagaccgccatgagcctgctgtggaagagctaccccctggtgtgcatcgccaaggagctgatccccgaggccaccgagaagtacctgggcggcaccgacgacaccgtgaagaagaaggacctgttcctggacctgatcgccgacgtgatgttcggcgtgcccagcgtgatcgtggccagaaaccacagagacgccggcgcccccacctacatgtacgagttccagtacagacccagcttcagcagcgacatgaagcccaagaccgtgatcggcgaccacggcgacgagctgttcagcgtgttcggcgcccccttcctgaaggagggcgccagcgaggaggagatcagactgagcaagatggtgatgaagttctgggccaacttcgccagaaacggcaaccccaacggcgagggcctgccccactggcccgagtacaaccagaaggagggctacctgcagatcggcgccaacacccaggccgcccagaagctgaaggacaaggaggtggccttctggaccaacctgttcgccaagaaggccgtggagaagcccccccagaccgagcacatcgagctgtag

SEQ ID NO: 75441 - DNA, 1716 bp, Artificial Sequence
  Description of Artificial Sequence: Synthetic coding sequence
atggagagagccgtgagagtggagagcggcgtgctggtgggcgtggtgtgcctgctgctggcctgccccgccaccgccaccggccccgaggtggcccagcccgaggtggacaccaccctgggcagagtgagaggcagacaggtgggcgtgaagggcaccgacagactggtgaacgtgttcctgggcatccccttcgcccagccccccctgggccccgacagattcagcgccccccaccccgcccagccctgggagggcgtgagagacgccagcaccgccccccccatgtgcctgcaggacgtggagagcatgaacagcagcagattcgtgctgaacggcaagcagcagatcttcagcgtgagcgaggactgcctggtgctgaacgtgtacagccccgccgaggtgcccgccggcagcggcagacccgtgatggtgtgggtgcacggcggcgccctgatcaccggcgccgccaccagctacgacggcagcgccctggccgcctacggcgacgtggtggtggtgaccgtgcagtacagactgggcgtgctgggcttcttcagcaccggcgacgagcacgcccccggcaaccagggcttcctggacgtggtggccgccctgagatgggtgcaggagaacatcgcccccttcggcggcgacctgaactgcgtgaccgtgttcggcggcagcgccggcggcagcatcatcagcggcctggtgctgagccccgtggccgccggcctgttccacagagccatcacccagagcggcgtgatcaccacccccggcatcatcgacagccacccctggcccctggcccagaagatcgccaacaccctggcctgcagcagcagcagccccgccgagatggtgcagtgcctgcagcagaaggagggcgaggagctggtgctgagcaagaagctgaagaacaccatctaccccctgaccgtggacggcaccgtgttccccaagagccccaaggagctgctgaaggagaagcccttccacagcgtgcccttcctgatgggcgtgaacaaccacgagttcagctggctgatccccagaggctggggcctgctggacaccatggagcagatgagcagagaggacatgctggccatcagcacccccgtgctgaccagcctggacgtgccccccgagatgatgcccaccgtgatcgacgagtacctgggcagcaacagcgacgcccaggccaagtgccaggccttccaggagttcatgggcgacgtgttcatcaacgtgcccaccgtgagcttcagcagatacctgagagacagcggcagccccgtgttcttctacgagttccagcacagacccagcagcttcgccaagatcaagcccgcctgggtgaaggccgaccacggcgccgagggcgccttcgtgttcggcggccccttcctgatggacgagagcagcagactggccttccccgaggccaccgaggaggagaagcagctgagcctgaccatgatggcccagtggacccacttcgccagaaccggcgaccccaacagcaaggccctgcccccctggccccagttcaaccaggccgagcagtacctggagatcaaccccgtgcccagagccggccagaagttcagagaggcctggatgcagttctggagcgagaccctgcccagcaagatccagcagtggcaccagaagcagaagaacagaaaggcccaggaggacctgtag

SEQ ID NO: 75442 - DNA, 633 bp, Artificial Sequence
  Description of Artificial Sequence: Synthetic coding sequence
atggagcagatgagcagagaggacatgctggccatcagcacccccgtgctgaccagcctggacgtgccccccgagatgatgcccaccgtgatcgacgagtacctgggcagcaacagcgacgcccaggccaagtgccaggccttccaggagttcatgggcgacgtgttcatcaacgtgcccaccgtgagcttcagcagatacctgagagacagcggcagccccgtgttcttctacgagttccagcacagacccagcagcttcgccaagatcaagcccgcctgggtgaaggccgaccacggcgccgagggcgccttcgtgttcggcggccccttcctgatggacgagagcagcagactggccttccccgaggccaccgaggaggagaagcagctgagcctgaccatgatggcccagtggacccacttcgccagaaccggcgaccccaacagcaaggccctgcccccctggccccagttcaaccaggccgagcagtacctggagatcaaccccgtgcccagagccggccagaagttcagagaggcctggatgcagttctggagcgagaccctgcccagcaagatccagcagtggcaccagaagcagaagaacagaaaggcccaggaggacctgtag

SEQ ID NO: 75443 - DNA, 1707 bp, Artificial Sequence
  Description of Artificial Sequence: Synthetic coding sequence
atggagagagccgtgagagtggagagcggcgtgctggtgggcgtggtgtgcctgctgctggcctgccccgccaccgccaccggccccgaggtggcccagcccgaggtggacaccaccctgggcagagtgagaggcagacaggtgggcgtgaagggcaccgacagactggtgaacgtgttcctgggcatccccttcgcccagccccccctgggccccgacagattcagcgccccccaccccgcccagccctgggagggcgtgagagacgccagcaccgccccccccatgtgcctgcaggacgtggagagcatgaacagcagcagattcgtgctgaacggcaagcagcagatcttcagcgtgagcgaggactgcctggtgctgaacgtgtacagccccgccgaggtgcccgccggcagcggcagacccgtgatggtgtgggtgcacggcggcgccctgatcaccggcgccgccaccagctacgacggcagcgccctggccgcctacggcgacgtggtggtggtgaccgtgcagtacagactgggcgtgctgggcttcttcagcaccggcgacgagcacgcccccggcaaccagggcttcctggacgtggtggccgccctgagatgggtgcaggagaacatcgcccccttcggcggcgacctgaactgcgtgaccgtgttcggcggcagcgccggcggcagcatcatcagcggcctggtgctgagccccgtggccgccggcctgttccacagagccatcacccagagcggcgtgatcaccacccccggcatcatcgacagccacccctggcccctggcccagaagatcgccaacaccctggcctgcagcagcagcagccccgccgagatggtgcagtgcctgcagcagaaggagggcgaggagctggtgctgagcaagaagctgaagaacaccatctaccccctgaccgtggacggcaccgtgttccccaagagccccaaggagctgctgaaggagaagcccttccacagcgtgcccttcctgatgggcgtgaacaaccacgagttcagctggctgatccccagaggctggggcctgctggacaccatggagcagatgagcagagaggacatgctggccatcagcacccccgtgctgaccagcctggacgtgccccccgagatgatgcccaccgtgatcgacgagtacctgggcagcaacagcgacgcccaggccaagtgccaggccttccaggagttcatgggcgacgtgttcatcaacgtgcccaccgtgagcttcagcagatacctgagagacagcggcagccccgtgttcttctacgagttccagcacagacccagcagcttcgccaagatcaagcccgcctgggtgaaggccgaccacggcgccgagggcgccttcgtgttcggcggccccttcctgatggacgagagcagcagactggaggccaccgaggaggagaagcagctgagcctgaccatgatggcccagtggacccacttcgccagaaccggcgaccccaacagcaaggccctgcccccctggccccagttcaaccaggccgagcagtacctggagatcaaccccgtgcccagagccggccagaagttcagagaggcctggatgcagttctggagcgagaccctgcccagcaagatccagcagtggcaccagaagcagaagaacagaaaggcccaggaggacctgtag

SEQ ID NO: 75444 - DNA, 738 bp, Artificial Sequence
  Description of Artificial Sequence: Synthetic coding sequence
atggccaacgaggcctacccctgcccctgcgacatcggccacagactggagtacggcggcctgggcagagaggtgcaggtggagcacatcaaggcctacgtgaccaagagccccgtggacgccggcaaggccgtgatcgtgatccaggacatcttcggctggcagctgcccaacaccagatacatcgccgacatgatcagcggcaacggctacaccaccatcgtgcccgacttcttcgtgggccaggagccctgggaccccagcggcgactggagcatcttccccgagtggctgaagaccagaaacgcccagaagatcgacagagagatcagcgccatcctgaagtacctgaagcagcagtgccacgcccagaagatcggcatcgtgggcttctgctggggcggcaccgccgtgcaccacctgatgatgaagtacagcgagttcagagccggcgtgagcgtgtacggcatcgtgaaggacagcgaggacatctacaacctgaagaaccccaccctgttcatcttcgccgagaacgacgtggtgatccccctgaaggacgtgagcctgctgacccagaagctgaaggagcactgcaaggtggagtaccagatcaagaccttcagcggccagacccacggcttcgtgcacagaaagagagaggactgcagccccgccgacaagccctacatcgacgaggccagaagaaacctgatcgagtggctgaacaagtacatgtag

SEQ ID NO: 75445 - DNA, 1260 bp, Artificial Sequence
  Description of Artificial Sequence: Synthetic coding sequence
atgagaggcctgctggtgctgagcgtgctgctgggcgccgtgttcggcaaggaggacttcgtgggccaccaggtgctgagaatcagcgtggccgacgaggcccaggtgcagaaggtgaaggagctggaggacctggagcacctgcagctggacttctggagaggccccgcccaccccggcagccccatcgacgtgagagtgcccttccccagcatccaggccgtgaagatcttcctggagagccacggcatcagctacgagaccatgatcgaggacgtgcagagcctgctggacgaggagcaggagcagatgttcgccttcagaagcagagccagaagcaccgacaccttcaactacgccacctaccacaccctggaggagatctacgacttcctggacctgctggtggccgagaacccccacctggtgagcaagatccagatcggcaacacctacgagggcagacccatctacgtgctgaagttcagcaccggcggcagcaagagacccgccatctggatcgacaccggcatccacagcagagagtgggtgacccaggccagcggcgtgtggttcgccaagaagatcacccaggactacggccaggacgccgccttcaccgccatcctggacaccctggacatcttcctggagatcgtgaccaaccccgacggcttcgccttcacccacagcaccaacagaatgtggagaaagaccagaagccacaccgccggcagcctgtgcatcggcgtggaccccaacagaaactgggacgccggcttcggcctgagcggcgccagcagcaacccctgcagcgagacctaccacggcaagttcgccaacagcgaggtggaggtgaagagcatcgtggacttcgtgaaggaccacggcaacatcaaggccttcatcagcatccacagctacagccagctgctgatgtacccctacggctacaagaccgagcccgtgcccgaccaggacgagctggaccagctgagcaaggccgccgtgaccgccctggccagcctgtacggcaccaagttcaactacggcagcatcatcaaggccatctaccaggccagcggcagcaccatcgactggacctacagccagggcatcaagtacagcttcaccttcgagctgagagacaccggcagatacggcttcctgctgcccgccagccagatcatccccaccgccaaggagacctggctggccctgctgaccatcatggagcacaccctgaaccacccctactag

SEQ ID NO: 75446 - DNA, 1098 bp, Artificial Sequence
  Description of Artificial Sequence: Synthetic coding sequence
atggacagagccgccctgctgggcctggccagactgtgcgccctgtgggccgccctgctggtgctgttcccctacggcgcccagggcaactggatgtggctgggcatcgccagcttcggcgtgcccgagaagctgggctgcgccaacctgcccctgaacagcagacagaaggagctgtgcaagagaaagccctacctgctgcccagcatcagagagggcgccagactgggcatccaggagtgcggcagccagttcagacacgagagatggaactgcatgatcaccgccgccgccaccaccgcccccatgggcgccagccccctgttcggctacgagctgagcagcggcaccaaggagaccgccttcatctacgccgtgatggccgccggcctggtgcacagcgtgaccagaagctgcagcgccggcaacatgaccgagtgcagctgcgacaccaccctgcagaacggcggcagcgccagcgagggctggcactggggcggctgcagcgacgacgtgcagtacggcatgtggttcagcagaaagttcctggacttccccatcggcaacaccaccggcaaggagaacaaggtgctgctggccatgaacctgcacaacaacgaggccggcagacaggccgtggccaagctgatgagcgtggactgcagatgccacggcgtgagcggcagctgcgccgtgaagacctgctggaagaccatgagcagcttcgagaagatcggccacctgctgaaggacaagtacgagaacagcatccagatcagcgacaagaccaagagaaagatgagaagaagagagaaggaccagagaaagatccccatccacaaggacgacctgctgtacgtgaacaagagccccaactactgcgtggaggacaagaagctgggcatccccggcacccagggcagagagtgcaacagaaccagcgagggcgccgacggctgcaacctgctgtgctgcggcagaggctacaacacccacgtggtgagacacgtggagagatgcgagtgcaagttcatctggtgctgctacgtgagatgcagaagatgcgagagcatgaccgacgtgcacacctgcaagtag

SEQ ID NO: 75447 - DNA, 1254 bp, Artificial Sequence
  Description of Artificial Sequence: Synthetic coding sequence
atgagactgatcctgcccgtgggcctgatcgccaccaccctggccatcgcccccgtgagattcgacagagagaaggtgttcagagtgaagccccaggacgagaagcaggccgacatcatcaaggacctggccaagaccaacgagctggacttctggtaccccggcgccacccaccacgtggccgccaacatgatggtggacttcagagtgagcgagaaggagagccaggccatccagagcgccctggaccagaacaagatgcactacgagatcctgatccacgacctgcaggaggagatcgagaagcagttcgacgtgaaggaggacatccccggcagacacagctacgccaagtacaacaactgggagaagatcgtggcctggaccgagaagatgatggacaagtaccccgagatggtgagcagaatcaagatcggcagcaccgtggaggacaaccccctgtacgtgctgaagatcggcgagaagaacgagagaagaaaggccatcttcaccgactgcggcatccacgccagagagtgggtgagccccgccttctgccagtggttcgtgtaccaggccaccaagacctacggcagaaacaagatcatgaccaagctgctggacagaatgaacttctacatcctgcccgtgttcaacgtggacggctacatctggagctggaccaagaacagaatgtggagaaagaacagaagcaagaaccagaacagcaagtgcatcggcaccgacctgaacagaaacttcaacgccagctggaacagcatccccaacaccaacgacccctgcgccgacaactacagaggcagcgcccccgagagcgagaaggagaccaaggccgtgaccaacttcatcagaagccacctgaacgagatcaaggtgtacatcaccttccacagctacagccagatgctgctgttcccctacggctacaccagcaagctgccccccaaccacgaggacctggccaaggtggccaagatcggcaccgacgtgctgagcaccagatacgagaccagatacatctacggccccatcgagagcaccatctaccccatcagcggcagcagcctggactgggcctacgacctgggcatcaagcacaccttcgccttcgagctgagagacaagggcaagttcggcttcctgctgcccgagagcagaatcaagcccacctgcagagagaccatgctggccgtgaagttcatcgccaagtacatcctgaagcacaccagctag

SEQ ID NO: 75448 - DNA, 1260 bp, Artificial Sequence
  Description of Artificial Sequence: Synthetic coding sequence
atggccatgagactgatcctgttcttcggcgccctgttcggccacatctactgcctggagaccttcgtgggcgaccaggtgctggagatcgtgcccagcaacgaggagcagatcaagaacctgctgcagctggaggcccaggagcacctgcagctggacttctggaagagccccaccacccccggcgagaccgcccacgtgagagtgcccttcgtgaacgtgcaggccgtgaaggtgttcctggagagccagggcatcgcctacagcatcatgatcgaggacgtgcaggtgctgctggacaaggagaacgaggagatgctgttcaacagaagaagagagagaagcggcaacttcaacttcggcgcctaccacaccctggaggagatcagccaggagatggacaacctggtggccgagcaccccggcctggtgagcaaggtgaacatcggcagcagcttcgagaacagacccatgaacgtgctgaagttcagcaccggcggcgacaagcccgccatctggctggacgccggcatccacgccagagagtgggtgacccaggccaccgccctgtggaccgccaacaagatcgtgagcgactacggcaaggaccccagcatcaccagcatcctggacgccctggacatcttcctgctgcccgtgaccaaccccgacggctacgtgttcagccagaccaagaacagaatgtggagaaagaccagaagcaaggtgagcggcagcctgtgcgtgggcgtggaccccaacagaaactgggacgccggcttcggcggccccggcgccagcagcaacccctgcagcgacagctaccacggccccagcgccaacagcgaggtggaggtgaagagcatcgtggacttcatcaagagccacggcaaggtgaaggccttcatcaccctgcacagctacagccagctgctgatgttcccctacggctacaagtgcaccaagctggacgacttcgacgagctgagcgaggtggcccagaaggccgcccagagcctgagaagcctgcacggcaccaagtacaaggtgggccccatctgcagcgtgatctaccaggccagcggcggcagcatcgactggagctacgactacggcatcaagtacagcttcgccttcgagctgagagacaccggcagatacggcttcctgctgcccgccagacagatcctgcccaccgccgaggagacctggctgggcctgaaggccatcatggagcacgtgagagaccacccctactag

SEQ ID NO: 75449 - DNA, 1167 bp, Artificial Sequence
  Description of Artificial Sequence: Synthetic coding sequence
atgagatggatcctgttcatcggcgccctgatcggcagcagcatctgcggccaggagaagttcttcggcgaccaggtgctgagaatcaacgtgagaaacggcgacgagatcagcaagctgagccagctggtgaacagcaacaacctgaagctgaacttctggaagagccccagcagcttcaacagacccgtggacgtgctggtgcccagcgtgagcctgcaggccttcaagagcttcctgagaagccagggcctggagtacgccgtgaccatcgaggacctgcagatctaccacgagatggacaacatcgccgccgacttccccgacctggccagaagagtgaagatcggccacagcttcgagaacagacccatgtacgtgctgaagttcagcaccggcaagggcgtgagaagacccgccgtgtggctgaacgccggcatccacagcagagagtggatcagccaggccaccgccatctggaccgccagaaagatcgtgagcgactaccagagagaccccgccatcaccagcatcctggagaagatggacatcttcctgctgcccgtggccaaccccgacggctacgtgtacacccagacccagaacagactgtggagaaagaccagaagcagaaaccccggcagcagctgcatcggcgccgaccccaacagaaactggaacgccagcttcgccggcaagggcgccagcgacaacccctgcagcgaggtgtaccacggcccccacgccaacagcgaggtggaggtgaagagcgtggtggacttcatccagaagcacggcaacttcaagggcttcatcgacctgcacagctacagccagctgctgatgtacccctacggctacagcgtgaagaaggcccccgacgccgaggagctggacaaggtggccagactggccgccaaggccctggccagcgtgagcggcaccgagtaccaggtgggccccacctgcaccaccgtgtaccccgccagcggcagcagcatcgactgggcctacgacaacggcatcaagttcgccttcaccttcgagctgagagacaccggcacctacggcttcctgctgcccgccaaccagatcatccccaccgccgaggagacctggctgggcctgaagaccatcatggagcacgtgagagacaacctgtactag

SEQ ID NO: 75450 - DNA, 681 bp, Artificial Sequence
  Description of Artificial Sequence: Synthetic coding sequence
atgaagatcgtgagcgactaccagagagaccccgccatcaccagcatcctggagaagatggacatcttcctgctgcccgtggccaaccccgacggctacgtgtacacccagacccagaacagactgtggagaaagaccagaagcagaaaccccggcagcagctgcatcggcgccgaccccaacagaaactggaacgccagcttcgccggcaagggcgccagcgacaacccctgcagcgaggtgtaccacggcccccacgccaacagcgaggtggaggtgaagagcgtggtggacttcatccagaagcacggcaacttcaagggcttcatcgacctgcacagctacagccagctgctgatgtacccctacggctacagcgtgaagaaggcccccgacgccgaggagctggacaaggtggccagactggccgccaaggccctggccagcgtgagcggcaccgagtaccaggtgggccccacctgcaccaccgtgtaccccgccagcggcagcagcatcgactgggcctacgacaacggcatcaagttcgccttcaccttcgagctgagagacaccggcacctacggcttcctgctgcccgccaaccagatcatccccaccgccgaggagacctggctgggcctgaagaccatcatggagcacgtgagagacaacctgtactag

SEQ ID NO: 75451 - DNA, 582 bp, Artificial Sequence
  Description of Artificial Sequence: Synthetic coding sequence
atgcaccacctgaacaagacccacagcggcctgatccacatgttcagcatcggcagaagctacgagggcagaagcctgttcatcctgaagctgggcagaagaagcagactgaagagagccgtgtggatcgactgcggcatccacgccagagagtggatcggccccgccttctgccagtggttcgtgaaggaggccctgctgacctacaagagcgaccccgccatgagaaagatgctgaaccacctgtacttctacatcatgcccgtgttcaacgtggacggctaccacttcagctggaccaacgacagattctggagaaagaccagaagcagaaacagcagattcagatgcagaggcgtggacgccaacagaaactggaaggtgaagtggtgcgacgtgagcagcggcagcagcatggactgggcctacaagaacggcatcccctacgccttcgccttcgagctgagagacaccggctacttcggcttcctgctgcccgagatgctgatcaagcccacctgcaccgagaccatgctggccgtgaagaacatcaccatgcacctgctgaagaagtgcccctag

SEQ ID NO: 75452 - DNA, 1314 bp, Artificial Sequence
  Description of Artificial Sequence: Synthetic coding sequence
atgaagtgcctgggcaagagaagaggccaggccgccgccttcctgcccctgtgctggctgttcctgaagatcctgcagcccggccacagccacctgtacaacaacagatacgccggcgacaaggtgatcagattcatccccaagaccgaggaggaggcctacgccctgaagaagatcagctaccagctgaaggtggacctgtggcagcccagcagcatcagctacgtgagcgagggcaccgtgaccgacgtgcacatcccccagaacggcagcagagccctgctggccttcctgcaggaggccaacatccagtacaaggtgctgatcgaggacctgcagaagaccctggagaagggcagcagcctgcacacccagagaaacagaagaagcctgagcggctacaactacgaggtgtaccacagcctggaggagatccagaactggatgcaccacctgaacaagacccacagcggcctgatccacatgttcagcatcggcagaagctacgagggcagaagcctgttcatcctgaagctgggcagaagaagcagactgaagagagccgtgtggatcgactgcggcatccacgccagagagtggatcggccccgccttctgccagtggttcgtgaaggaggccctgctgacctacaagagcgaccccgccatgagaaagatgctgaaccacctgtacttctacatcatgcccgtgttcaacgtggacggctaccacttcagctggaccaacgacagattctggagaaagaccagaagcagaaacagcagattcagatgcagaggcgtggacgccaacagaaactggaaggtgaagtggtgcgacgagggcgccagcatgcacccctgcgacgacacctactgcggccccttccccgagagcgagcccgaggtgaaggccgtggccaacttcctgagaaagcacagaaagcacatcagagcctacctgagcttccacgcctacgcccagatgctgctgtacccctacagctacaagtacgccaccatccccaacttcagatgcgtggagagcgccgcctacaaggccgtgaacgccctgcagagcgtgtacggcgtgagatacagatacggccccgccagcaccaccctgtacgtgagcagcggcagcagcatggactgggcctacaagaacggcatcccctacgccttcgccttcgagctgagagacaccggctacttcggcttcctgctgcccgagatgctgatcaagcccacctgcaccgagaccatgctggccgtgaagaacatcaccatgcacctgctgaagaagtgcccctag

SEQ ID NO: 75453 - DNA, 948 bp, Artificial Sequence
  Description of Artificial Sequence: Synthetic coding sequence
atgaagtgcctgggcaagagaagaggccaggccgccgccttcctgcccctgtgctggctgttcctgaagatcctgcagcccggccacagccacctgtacaacaacagatacgccggcgacaaggtgatcagattcatccccaagaccgaggaggaggcctacgccctgaagaagatcagctaccagctgaaggtggacctgtggcagcccagcagcatcagctacgtgagcgagggcaccgtgaccgacgtgcacatcccccagaacggcagcagagccctgctggccttcctgcaggaggccaacatccagtacaaggtgctgatcgaggacctgcagaagaccctggagaagggcagcagcctgcacacccagagaaacagaagaagcctgagcggctacaactacgaggtgtaccacagcctggaggagatccagaactggatgcaccacctgaacaagacccacagcggcctgatccacatgttcagcatcggcagaagctacgagggcagaagcctgttcatcctgaagctgggcagaagaagcagactgaagagagccgtgtggatcgactgcggcatccacgccagagagtggatcggccccgccttctgccagtggttcgtgaaggaggccctgctgacctacaagagcgaccccgccatgagaaagatgctgaaccacctgtacttctacatcatgcccgtgttcaacgtggacggctaccacttcagctggaccaacgacagattctggagaaagaccagaagcagaaacagcagattcagatgcagaggcgtggacgccaacagaaactggaaggtgaagtggtgcggcaagttcggcaccaactgggaccccgaccccaaggtgagcgccggcttcaccctgcagaacatgagccccgaggacagccacggcagactgatgttcttctgcatgtag

SEQ ID NO: 75454 - DNA, 1272 bp, Artificial Sequence
  Description of Artificial Sequence: Synthetic coding sequence
atgaagctgtgcagcctggccgtgctggtgcccatcgtgctgttctgcgagcagcacgtgttcgccttccagagcggccaggtgctggccgccctgcccagaaccagcagacaggtgcaggtgctgcagaacctgaccaccacctacgagatcgtgctgtggcagcccgtgaccgccgacctgatcgtgaagaagaagcaggtgcacttcttcgtgaacgccagcgacgtggacaacgtgaaggcccacctgaacgtgagcggcatcccctgcagcgtgctgctggccgacgtggaggacctgatccagcagcagatcagcaacgacaccgtgagccccagagccagcgccagctactacgagcagtaccacagcctgaacgagatctacagctggatcgagttcatcaccgagagacaccccgacatgctgaccaagatccacatcggcagcagcttcgagaagtaccccctgtacgtgctgaaggtgagcggcaaggagcaggccgccaagaacgccatctggatcgactgcggcatccacgccagagagtggatcagccccgccttctgcctgtggttcatcggccacatcacccagttctacggcatcatcggccagtacaccaacctgctgagactggtggacttctacgtgatgcccgtggtgaacgtggacggctacgactacagctggaagaagaacagaatgtggagaaagaacagaagcttctacgccaacaaccactgcatcggcaccgacctgaacagaaacttcgccagcaagcactggtgcgaggagggcgccagcagcagcagctgcagcgagacctactgcggcctgtaccccgagagcgagcccgaggtgaaggccgtggccagcttcctgagaagaaacatcaaccagatcaaggcctacatcagcatgcacagctacagccagcacatcgtgttcccctacagctacaccagaagcaagagcaaggaccacgaggagctgagcctggtggccagcgaggccgtgagagccatcgagaagatcagcaagaacaccagatacacccacggccacggcagcgagaccctgtacctggcccccggcggcggcgacgactggatctacgacctgggcatcaagtacagcttcaccatcgagctgagagacaccggcacctacggcttcctgctgcccgagagatacatcaagcccacctgcagagaggccttcgccgccgtgagcaagatcgcctggcacgtgatcagaaacgtgtag

SEQ ID NO: 75455 - DNA, 1083 bp, Artificial Sequence
  Description of Artificial Sequence: Synthetic coding sequence
atgaagctgtgcagcctggccgtgctggtgcccatcgtgctgttctgcgagcagcacgtgttcgccttccagagcggccaggtgctggccgccctgcccagaaccagcagacaggtgcaggtgctgcagaacctgaccaccacctacgagatcgtgctgtggcagcccgtgaccgccgacctgatcgtgaagaagaagcaggtgcacttcttcgtgaacgccagcgacgtggacaacgtgaaggcccacctgaacgtgagcggcatcccctgcagcgtgctgctggccgacgtggaggacctgatccagcagcagatcagcaacgacaccgtgagccccagagccagcgccagctactacgagcagtaccacagcctgaacgagatctacagctggatcgagttcatcaccgagagacaccccgacatgctgaccaagatccacatcggcagcagcttcgagaagtaccccctgtacgtgctgaaggtgagcggcaaggagcaggccgccaagaacgccatctggatcgactgcggcatccacgccagagagtggatcagccccgccttctgcctgtggttcatcggccacaacagaatgtggagaaagaacagaagcttctacgccaacaaccactgcatcggcaccgacctgaacagaaacttcgccagcaagcactggtgcgaggagggcgccagcagcagcagctgcagcgagacctactgcggcctgtaccccgagagcgagcccgaggtgaaggccgtggccagcttcctgagaagaaacatcaaccagatcaaggcctacatcagcatgcacagctacagccagcacatcgtgttcccctacagctacaccagaagcaagagcaaggaccacgaggagctgagcctggtggccagcgaggccgtgagagccatcgagaagatcagcaagaacaccagatacacccacggccacggcagcgagaccctgtacctggcccccggcggcggcgacgactggatctacgacctgggcatcaagtacagcgtgaccagcaacccccccgtggagaagctgctgcccctgagcctgaagtag

SEQ ID NO: 75456 - DNA, 849 bp, Artificial Sequence
  Description of Artificial Sequence: Synthetic coding sequence
atgctgcccctgctgagatgcgtgcccagagtgctgggcagcagcgtggccggcctgagagccgccgcccccgccagccccttcagacagctgctgcagcccgcccccagactgtgcaccagacccttcggcctgctgagcgtgagagccggcagcgagagaagacccggcctgctgagacccagaggcccctgcgcctgcggctgcggctgcggcagcctgcacaccgacggcgacaaggccttcgtggacttcctgagcgacgagatcaaggaggagagaaagatccagaagcacaagaccctgcccaagatgagcggcggctgggagctggagctgaacggcaccgaggccaagctggtgagaaaggtggccggcgagaagatcaccgtgaccttcaacatcaacaacagcatcccccccaccttcgacggcgaggaggagcccagccagggccagaaggtggaggagcaggagcccgagctgaccagcacccccaacttcgtggtggaggtgatcaagaacgacgacggcaagaaggccctggtgctggactgccactaccccgaggacgaggtgggccaggaggacgaggccgagagcgacatcttcagcatcagagaggtgagcttccagagcaccggcgagagcgagtggaaggacaccaactacaccctgaacaccgacagcctggactgggccctgtacgaccacctgatggacttcctggccgacagaggcgtggacaacaccttcgccgacgagctggtggagctgagcaccgccctggagcaccaggagtacatcaccttcctggaggacctgaagagcttcgtgaagagccagtag

SEQ ID NO: 75457 - DNA, 3402 bp, Artificial Sequence
  Description of Artificial Sequence: Synthetic coding sequence
atgagattcgtgctgagcggcaacctgcacggcggcagcgtggtggccagctaccccttcgacgacagccccgagcacaaggccaccggcatctacagcaagaccagcgacgacgaggtgttcaagtacctggccaaggcctacgccagcaaccaccccatcatgaagaccggcgagccccactgccccggcgacgaggacgagaccttcaaggacggcatcaccaacggcgcccactggtacgacgtggagggcggcatgcaggactacaactacgtgtgggccaactgcttcgagatcaccctggagctgagctgctgcaagtacccccccgccagccagctgagacaggagtgggagaacaacagagagagcctgatcaccctgatcgagaaggtgcacatcggcgtgaagggcttcgtgaaggacagcatcaccggcagcggcctggagaacgccaccatcagcgtggccggcatcaaccacaacatcaccaccggcagattcggcgacttctacagactgctggtgcccggcacctacaacctgaccgtggtgctgaccggctacatgcccctgaccgtgaccaacgtggtggtgaaggagggccccgccaccgaggtggacttcagcctgagacccaccgtgaccagcgtgatccccgacaccaccgaggccgtgagcaccgccagcaccgtggccatccccaacatcctgagcggcaccagcagcagctaccagcccatccagcccaaggacttccaccaccaccacttccccgacatggagatcttcctgagaagattcgccaacgagtaccccaacatcaccagactgtacagcctgggcaagagcgtggagagcagagagctgtacgtgatggagatcagcgacaaccccggcgtgcacgagcccggcgagcccgagttcaagtacatcggcaacatgcacggcaacgaggtggtgggcagagagctgctgctgaacctgatcgagtacctgtgcaagaacttcggcaccgaccccgaggtgaccgacctggtgcacaacaccagaatccacctgatgcccagcatgaaccccgacggctacgagaagagccaggagggcgacagcatcagcgtgatcggcagaaacaacagcaacaacttcgacctgaacagaaacttccccgaccagttcgtgcagatcaccgaccccacccagcccgagaccatcgccgtgatgagctggatgaagagctaccccttcgtgctgagcgccaacctgcacggcggcagcctggtggtgaactaccccttcgacgacgacgagcagggcctggccacctacagcaagagccccgacgacgccgtgttccagcagatcgccctgagctacagcaaggagaacagccagatgttccagggcagaccctgcaagaacatgtaccccaacgagtacttcccccacggcatcaccaacggcgccagctggtacaacgtgcccggcggcatgcaggactggaactacctgcagaccaactgcttcgaggtgaccatcgagctgggctgcgtgaagtaccccctggagaaggagctgcccaacttctgggagcagaacagaagaagcctgatccagttcatgaagcaggtgcaccagggcgtgagaggcttcgtgctggacgccaccgacggcagaggcatcctgaacgccaccatcagcgtggccgagatcaaccaccccgtgaccacctacaagaccggcgactactggagactgctggtgcccggcacctacaagatcaccgccagcgccagaggctacaaccccgtgaccaagaacgtgaccgtgaagagcgagggcgccatccaggtgaacttcaccctggtgagaagcagcaccgacagcaacaacgagagcaagaagggcaagggcgccagcagcagcaccaacgacgccagcgaccccaccaccaaggagttcgagaccctgatcaaggacctgagcgccgagaacggcctggagagcctgatgctgagaagcagcagcaacctggccctggccctgtacagataccacagctacaaggacctgagcgagttcctgagaggcctggtgatgaactacccccacatcaccaacctgaccaacctgggccagagcaccgagtacagacacatctggagcctggagatcagcaacaagcccaacgtgagcgagcccgaggagcccaagatcagattcgtggccggcatccacggcaacgcccccgtgggcaccgagctgctgctggccctggccgagttcctgtgcctgaactacaagaagaaccccgccgtgacccagctggtggacagaaccagaatcgtgatcgtgcccagcctgaaccccgacggcagagagagagcccaggagaaggactgcaccagcaagatcggccagaccaacgccagaggcaaggacctggacaccgacttcaccaacaacgccagccagcccgagaccaaggccatcatcgagaacctgatccagaagcaggacttcagcctgagcgtggccctggacggcggcagcatgctggtgacctacccctacgacaagcccgtgcagaccgtggagaacaaggagaccctgaagcacctggccagcctgtacgccaacaaccaccccagcatgcacatgggccagcccagctgccccaacaagagcgacgagaacatccccggcggcgtgatgagaggcgccgagtggcacagccacctgggcagcatgaaggactacagcgtgacctacggccactgccccgagatcaccgtgtacaccagctgctgctacttccccagcgccgccagactgcccagcctgtgggccgacaacaagagaagcctgctgagcatgctggtggaggtgcacaagggcgtgcacggcttcgtgaaggacaagaccggcaagcccatcagcaaggccgtgatcgtgctgaacgagggcatcaaggtgcagaccaaggagggcggctacttccacgtgctgctggcccccggcgtgcacaacatcatcgccatcgccgacggctaccagcagcagcacagccaggtgttcgtgcaccacgacgccgccagcagcgtggtgatcgtgttcgacaccgacaacagaatcttcggcctgcccagagagctggtggtgaccgtgagcggcgccaccatgagcgccctgatcctgaccgcctgcatcatctggtgcatctgcagcatcaagagcaacagacacaaggacggcttccacagactgagacagcaccacgacgagtacgaggacgagatcagaatgatgagcaccggcagcaagaagagcctgctgagccacgagttccaggacgagaccgacaccgaggaggagaccctgtacagcagcaagcactag

SEQ ID NO: 75458 - DNA, 1149 bp, Artificial Sequence
  Description of Artificial Sequence: Synthetic coding sequence
atgagaagaagaagaagactgcagcaggaggacggcatcagcttcgagtaccacagataccccgagctgagagaggccctggtgagcgtgtggctgcagtgcaccgccatcagcagaatctacaccgtgggcagaagcttcgagggcagagagctgctggtgatcgagctgagcgacaaccccggcgtgcacgagcccggcgagcccgagttcaagtacatcggcaacatgcacggcaacgaggccgtgggcagagagctgctgatcttcctggcccagtacctgtgcaacgagtaccagaagggcaacgagaccatcgtgaacctgatccacagcaccagaatccacatcatgcccagcctgaaccccgacggcttcgagaaggccgccagccagcccggcgagctgaaggactggttcgtgggcagaagcaacgcccagggcatcgacctgaacagaaacttccccgacctggacagaatcgtgtacgtgaacgagaaggagggcggccccaacaaccacctgctgaagaacatgaagaagatcgtggaccagaacaccaagctggcccccgagaccaaggccgtgatccactggatcatggacatccccttcgtgctgagcgccaacctgcacggcggcgacctggtggccaactacccctacgacgagaccagaagcggcagcgcccacgagtacagcagcagccccgacgacgccatcttccagagcctggccagagcctacagcagcttcaaccccgccatgagcgaccccaacagacccccctgcagaaagaacgacgacgacagcagcttcgtggacggcaccaccaacggcggcgcctggtacagcgtgcccggcggcatgcaggacttcaactacctgagcagcaactgcttcgagatcaccgtggagctgagctgcgagaagttcccccccgaggagaccctgaagacctactgggaggacaacaagaacagcctgatcagctacctggagcagatccacagaggcgtgaagggcttcgtgagagacctgcagggcaaccccatcgccaacgccaccatcagcgtggagggcatcgaccacgacgtgaccagcgccaaggacggcgactactggagactgctgacctggaagctgtag

SEQ ID NO: 75459 - DNA, 1431 bp, Artificial Sequence
  Description of Artificial Sequence: Synthetic coding sequence
atggccggcagaggcggcagcgccctgctggccctgtgcggcgccctggccgcctgcggctggctgctgggcgccgaggcccaggagcccggcgcccccgccgccggcatgagaagaagaagaagactgcagcaggaggacggcatcagcttcgagtaccacagataccccgagctgagagaggccctggtgagcgtgtggctgcagtgcaccgccatcagcagaatctacaccgtgggcagaagcttcgagggcagagagctgctggtgatcgagctgagcgacaaccccggcgtgcacgagcccggcgagcccgagttcaagtacatcggcaacatgcacggcaacgaggccgtgggcagagagctgctgatcttcctggcccagtacctgtgcaacgagtaccagaagggcaacgagaccatcgtgaacctgatccacagcaccagaatccacatcatgcccagcctgaaccccgacggcttcgagaaggccgccagccagcccggcgagctgaaggactggttcgtgggcagaagcaacgcccagggcatcgacctgaacagaaacttccccgacctggacagaatcgtgtacgtgaacgagaaggagggcggccccaacaaccacctgctgaagaacatgaagaagatcgtggaccagaacaccaagctggcccccgagaccaaggccgtgatccactggatcatggacatccccttcgtgctgagcgccaacctgcacggcggcgacctggtggccaactacccctacgacgagaccagaagcggcagcgcccacgagtacagcagcagccccgacgacgccatcttccagagcctggccagagcctacagcagcttcaaccccgccatgagcgaccccaacagacccccctgcagaaagaacgacgacgacagcagcttcgtggacggcaccaccaacggcggcgcctggtacagcgtgcccggcggcatgcaggacttcaactacctgagcagcaactgcttcgagatcaccgtggagctgagctgcgagaagttcccccccgaggagaccctgaagacctactgggaggacaacaagaacagcctgatcagctacctggagcagatccacagaggcgtgaagggcttcgtgagagacctgcagggcaaccccatcgccaacgccaccatcagcgtggagggcatcgaccacgacgtgaccagcgccaaggacggcgactactggagactgctgatccccggcaactacaagctgaccgccagcgcccccggctacctggccatcaccaagaaggtggccgtgccctacagccccgccgccggcgtggacttcgagctggagagcttcagcgagagaaaggaggaggagaaggaggagctgatggagtggtggaagatgatgagcgagaccctgaacttctag

SEQ ID NO: 75460 - DNA, 1332 bp, Artificial Sequence
  Description of Artificial Sequence: Synthetic coding sequence
atggacttcccctgcctgtggctgggcctgctgctgcccctggtggccgccctggacttcaactaccacagacaggagggcatggaggccttcctgaagaccgtggcccagaactacagcagcgtgacccacctgcacagcatcggcaagagcgtgaagggcagaaacctgtgggtgctggtggtgggcagattccccaaggagcacagaatcggcatccccgagttcaagtacgtggccaacatgcacggcgacgagaccgtgggcagagagctgctgctgcacctgatcgactacctggtgaccagcgacggcaaggaccccgagatcaccaacctgatcaacagcaccagaatccacatcatgcccagcatgaaccccgacggcttcgaggccgtgaagaagcccgactgctactacagcatcggcagagagaactacaaccagtacgacctgaacagaaacttccccgacgccttcgagtacaacaacgtgagcagacagcccgagaccgtggccgtgatgaagtggctgaagaccgagaccttcgtgctgagcgccaacctgcacggcggcgccctggtggccagctaccccttcgacaacggcgtgcaggccaccggcgccctgtacagcagaagcctgacccccgacgacgacgtgttccagtacctggcccacacctacgccagcagaaaccccaacatgaagaagggcgacgagtgcaagaacaagatgaacttccccaacggcgtgaccaacggctacagctggtaccccctgcagggcggcatgcaggactacaactacatctgggcccagtgcttcgagatcaccctggagctgagctgctgcaagtaccccagagaggagaagctgcccagcttctggaacaacaacaaggccagcctgatcgagtacatcaagcaggtgcacctgggcgtgaagggccaggtgttcgaccagaacggcaaccccctgcccaacgtgatcgtggaggtgcaggacagaaagcacatctgcccctacagaaccaacaagtacggcgagtactacctgctgctgctgcccggcagctacatcatcaacgtgaccgtgcccggccacgacccccacatcaccaaggtgatcatccccgagaagagccagaacttcagcgccctgaagaaggacatcctgctgcccttccagggccagctggacagcatccccgtgagcaaccccagctgccccatgatccccctgtacagaaacctgcccgaccacagcgccgccaccaagcccagcctgttcctgttcctggtgagcctgctgcacatcttcttcaagtag

SEQ ID NO: 75461 - DNA, 1332 bp, Artificial Sequence; identical to SEQ ID NO: 75460
  Description of Artificial Sequence: Synthetic coding sequence

SEQ ID NO: 75462 - DNA, 1332 bp, Artificial Sequence; identical to SEQ ID NO: 75460
  Description of Artificial Sequence: Synthetic coding sequence

SEQ ID NO: 75463 - DNA, 411 bp, Artificial Sequence
  Description of Artificial Sequence: Synthetic coding sequence
atggacttcccctgcctgtggctgggcctgctgctgcccctggtggccgccctggacttcaactaccacagacaggagggcatggaggccttcctgaagaccgtggcccagaactacagcagcgtgacccacctgcacagcatcggcaagagcgtgaagggcagaaacctgtgggtgctggtggtgggcagattccccaaggagcacagaatcggcatccccgagttcaagtacgtggccaacatgcacggcgacgagaccgtgggcagagagctgctgctgcacctgatcgactacctggtgaccagcgacggcaaggaccccgagatcaccaacctgatcaacagcaccagaatccacatcatgcccagcatgaaccccgacggcttcgaggccgtgaagaagccctag

SEQ ID NO: 75464 - DNA, 750 bp, Artificial Sequence
  Description of Artificial Sequence: Synthetic coding sequence
atggacttcccctgcctgtggctgggcctgctgctgcccctggtggccgccctggacttcaactaccacagacaggagggcatggaggccttcctgaagaccgtggcccagaactacagcagcgtgacccacctgcacagcatcggcaagagcgtgaagggcagaaacctgtgggtgctggtggtgggcagattccccaaggagcacagaatcggcatccccgagttcaagtacgtggccaacatgcacggcgacgagaccgtgggcagagagctgctgctgcacctgatcgactacctggtgaccagcgacggcaaggaccccgagatcaccaacctgatcaacagcaccagaatccacatcatgcccagcatgaaccccgacggcttcgaggccgtgaagaagcccgactgctactacagcatcggcagagagaactacaaccagtacgacctgaacagaaacttccccgacgccttcgagtacaacaacgtgagcagacagcccgagaccgtggccgtgatgaagtggctgaagaccgagaccttcgtgctgagcgccaacctgcacggcggcgccctggtggccagctaccccttcgacaacggcgtgcaggccaccggcgccctgtacagcagaagcctgacccccgacgacgacgtgttccagtacctggcccacacctacgccagcagaaaccccaacatgaagaagggcgacgagtgcaagaacaagatgaacttcccctag

SEQ ID NO: 75465 - DNA, 1332 bp, Artificial Sequence; identical to SEQ ID NO: 75460
  Description of Artificial Sequence: Synthetic coding sequence

SEQ ID NO: 75466 - DNA, 1377 bp, Artificial Sequence
  Description of Artificial Sequence: Synthetic coding sequence
atgagcgacctgctgagcgtgttcctgcacctgctgctgctgttcaagctggtggcccccgtgaccttcagacaccacagatacgacgacctggtgagaaccctgtacaaggtgcagaacgagtgccccggcatcaccagagtgtacagcatcggcagaagcgtggagggcagacacctgtacgtgctggagttcagcgaccaccccggcatccacgagcccctggagcccgaggtgaagtacgtgggcaacatgcacggcaacgaggccctgggcagagagctgatgctgcagctgagcgagttcctgtgcgaggagttcagaaacagaaaccagagaatcgtgcagctgatccaggacaccagaatccacatcctgcccagcatgaaccccgacggctacgaggtggccgccgcccagggccccaacaagcccggctacctggtgggcagaaacaacgccaacggcgtggacctgaacagaaacttccccgacctgaacacctacatctactacaacgagaagtacggcggccccaaccaccacctgcccctgcccgacaactggaagagccaggtggagcccgagaccagagccgtgatcagatggatgcacagcttcaacttcgtgctgagcgccaacctgcacggcggcgccgtggtggccaactacccctacgacaagagcttcgagcacagagtgagaggcgtgagaagaaccgccagcacccccacccccgacgacaagctgttccagaagctggccaaggtgtacagctacgcccacggctggatgttccagggctggaactgcggcgactacttccccgacggcatcaccaacggcgccagctggtacagcctgagcaagggcatgcaggacttcaactacctgcacaccaactgcttcgagatcaccctggagctgagctgcgacaagttcccccccgaggaggagctgcagagagagtggctgggcaacagagaggccctgatccagttcctggagcaggtgcaccagggcatcaagggcatggtgctggacgagaactacaacaacctggccaacgccgtgatcagcgtgagcggcatcaaccacgacgtgaccagcggcgaccacggcgactacttcagactgctgctgcccggcatctacaccgtgagcgccaccgcccccggctacgaccccgagaccgtgaccgtgaccgtgggccccgccgagcccaccctggtgaacttccacctgaagagaagcatcccccaggtgagccccgtgagaagagcccccagcagaagacacggcgtgagagccaaggtgcagccccaggccagaaagaaggagatggagatgagacagctgcagagaggccccgcctag

SEQ ID NO: 75467 - DNA, 615 bp, Artificial Sequence
  Description of Artificial Sequence: Synthetic coding sequence
atgcacagcttcaacttcgtgctgagcgccaacctgcacggcggcgccgtggtggccaactacccctacgacaagagcttcgagcacagagtgagaggcgtgagaagaaccgccagcacccccacccccgacgacaagctgttccagaagctggccaaggtgtacagctacgcccacggctggatgttccagggctggaactgcggcgactacttccccgacggcatcaccaacggcgccagctggtacagcctgagcaagggcatgcaggacttcaactacctgcacaccaactgcttcgagatcaccctggagctgagctgcgacaagttcccccccgaggaggagctgcagagagagtggctgggcaacagagaggccctgatccagttcctggagcaggtgcaccagggcatcaagggcatggtgctggacgagaactacaacaacctggccaacgccgtgatcagcgtgagcggcatcaaccacgacgtgaccagcggcgaccacggcgactacttcagactgctgctgcccggcatctacaccgtgagcgccaccgcccccggctacgaccccgagaccgtgaccgtgaccgtgggccccgccgagtag

SEQ ID NO: 75468 - DNA, 1638 bp, Artificial Sequence
  Description of Artificial Sequence: Synthetic coding sequence
atgctgcccggcgcctggctgctgtggaccagcctgctgctgctggccagacccgcccagccctgccccatgggctgcgactgcttcgtgcaggaggtgttctgcagcgacgaggagctggccaccgtgcccctggacatccccccctacaccaagaacatcatcttcgtggagaccagcttcaccaccctggagaccagagccttcggcagcaaccccaacctgaccaaggtggtgttcctgaacacccagctgtgccagttcagacccgacgccttcggcggcctgcccagactggaggacctggaggtgaccggcagcagcttcctgaacctgagcaccaacatcttcagcaacctgaccagcctgggcaagctgaccctgaacttcaacatgctggaggccctgcccgagggcctgttccagcacctggccgccctggagagcctgcacctgcagggcaaccagctgcaggccctgcccagaagactgttccagcccctgacccacctgaagaccctgaacctggcccagaacctgctggcccagctgcccgaggagctgttccaccccctgaccagcctgcagaccctgaagctgagcaacaacgccctgagcggcctgccccagggcgtgttcggcaagctgggcagcctgcaggagctgttcctggacagcaacaacatcagcgagctgcccccccaggtgttcagccagctgttctgcctggagagactgtggctgcagagaaacgccatcacccacctgcccctgagcatcttcgccagcctgggcaacctgaccttcctgagcctgcagtggaacatgctgagagtgctgcccgccggcctgttcgcccacaccccctgcctggtgggcctgagcctgacccacaaccagctggagaccgtggccgagggcaccttcgcccacctgagcaacctgagaagcctgatgctgagctacaacgccatcacccacctgcccgccggcatcttcagagacctggaggagctggtgaagctgtacctgggcagcaacaacctgaccgccctgcaccccgccctgttccagaacctgagcaagctggagctgctgagcctgagcaagaaccagctgaccaccctgcccgagggcatcttcgacaccaactacaacctgttcaacctggccctgcacggcaacccctggcagtgcgactgccacctggcctacctgttcaactggctgcagcagtacaccgacagactgctgaacatccagacctactgcgccggccccgcctacctgaagggccaggtggtgcccgccctgaacgagaagcagctggtgtgccccgtgaccagagaccacctgggcttccaggtgacctggcccgacgagagcaaggccggcggcagctgggacctggccgtgcaggagagagccgccagaagccagtgcacctacagcaaccccgagggcaccgtggtgctggcctgcgaccaggcccagtgcagatggctgaacgtgcagctgagcccccagcagggcagcctgggcctgcagtacaacgccagccaggagtgggacctgagaagcagctgcggcagcctgagactgaccgtgagcatcgaggccagagccgccggcccctag

SEQ ID NO: 75469 - DNA, 1638 bp, Artificial Sequence; identical to SEQ ID NO: 75468
  Description of Artificial Sequence: Synthetic coding sequence

SEQ ID NO: 75470 - DNA, 1431 bp, Artificial Sequence
  Description of Artificial Sequence: Synthetic coding sequence
atggtgggcgccatgtggaaggtgatcgtgagcctggtgctgctgatgcccggcccctgcgacggcctgttcagaagcctgtacagaagcgtgagcatgccccccaagggcgacagcggccagcccctgttcctgaccccctacatcgaggccggcaagatccagaagggcagagagctgagcctggtgggccccttccccggcctgaacatgaagagctacgccggcttcctgaccgtgaacaagacctacaacagcaacctgttcttctggttcttccccgcccagatccagcccgaggacgcccccgtggtgctgtggctgcagggcggccccggcggcagcagcatgttcggcctgttcgtggagcacggcccctacgtggtgaccagcaacatgaccctgagagacagagacttcccctggaccaccaccctgagcatgctgtacatcgacaaccccgtgggcaccggcttcagcttcaccgacgacacccacggctacgccgtgaacgaggacgacgtggccagagacctgtacagcgccctgatccagttcttccagatcttccccgagtacaagaacaacgacttctacgtgaccggcgagagctacgccggcaagtacgtgcccgccatcgcccacctgatccacagcctgaaccccgtgagagaggtgaagatcaacctgaacggcatcgccatcggcgacggctacagcgaccccgagagcatcatcggcggctacgccgagttcctgtaccagatcggcctgctggacgagaagcagaagaagtacttccagaagcagtgccacgagtgcatcgagcacatcagaaagcagaactggttcgaggccttcgagatcctggacaagctgctggacggcgacctgaccagcgaccccagctacttccagaacgtgaccggctgcagcaactactacaacttcctgagatgcaccgagcccgaggaccagctgtactacgtgaagttcctgagcctgcccgaggtgagacaggccatccacgtgggcaaccagaccttcaacgacggcaccatcgtggagaagtacctgagagaggacaccgtgcagagcgtgaagccctggctgaccgagatcatgaacaactacaaggtgctgatctacaacggccagctggacatcatcgtggccgccgccctgaccgagagaagcctgatgggcatggactggaagggcagccaggagtacaagaaggccgagaagaaggtgtggaagatcttcaagagcgacagcgaggtggccggctacatcagacaggccggcgacttccaccaggtgatcatcagaggcggcggccacatcctgccctacgaccagcccctgagagccttcgacatgatcaacagattcatctacggcaagggctgggacccctacgtgggctag

SEQ ID NO: 75471 - DNA, 1431 bp, Artificial Sequence; identical to SEQ ID NO: 75470
  Description of Artificial Sequence: Synthetic coding sequence

SEQ ID NO: 75472 - DNA, 1431 bp, Artificial Sequence; identical to SEQ ID NO: 75470
  Description of Artificial Sequence: Synthetic coding sequence

SEQ ID NO: 75473 - DNA, 21 bp, Artificial Sequence
  Description of Artificial Sequence: Synthetic coding sequence
atggtgggcgccatgtggtag

SEQ ID NO: 75474 - DNA, 159 bp, Artificial Sequence
  Description of Artificial Sequence: Synthetic coding sequence
atggtgggcgccatgtggaaggtgatcgtgagcctggtgctgctgatgcccggcccctgcgacggcctgttcagaagcctgtacagaagcgtgagcatgccccccaagggcgacagcggccagcccctgttcctgaccccctacatcgaggccggctag

SEQ ID NO: 75475 - DNA, 132 bp, Artificial Sequence
  Description of Artificial Sequence: Synthetic coding sequence
atggtgggcgccatgtggaaggtgatcgtgagcctggtgctgctgatgcccggcccctgcgacggcctgttcagaagcctgtacagaagcgtgagcatgccccccaagggcgacagcggccagcccctgtag

SEQ ID NO: 75476 - DNA, 699 bp, Artificial Sequence
  Description of Artificial Sequence: Synthetic coding sequence
atgttcggcctgttcgtggagcacggcccctacgtggtgaccagcaacatgaccctgagagacagagacttcccctggaccaccaccctgagcatgctgtacatcgacaaccccgtgggcaccggcttcagcttcaccgacgacacccacggctacgccgtgaacgaggacgacgtggccagagacctgtacagcgccctgatccagttcttccagatcttccccgagtacaagaacaacgacttctacgtgaccggcgagagctacgccggcaagtacgtgcccgccatcgcccacctgatccacagcctgaaccccgtgagagaggtgaagatcaacctgaacggcatcgccatcggcgacggctacagcgaccccgagagcatcatcggcggctacgccgagttcctgtaccagatcggcctgctggacgagaagcagaagaagtacttccagaagcagtgccacgagtgcatcgagcacatcagaaagcagaactggttcgaggccttcgagatcctggacaagctgctggacggcgacctgaccagcgaccccagctacttccagaacgtgaccggctgcagcaactactacaacttcctgagatgcaccgagcccgaggaccagctgtactacgtgaagttcctgagcctgcccgaggtgagacaggcccccagaggcgagagcgacttctag

SEQ ID NO: 75477 - DNA, 1581 bp, Artificial Sequence
  Description of Artificial Sequence: Synthetic coding sequence
atgggccacctgagcgcccccctgcacagagtgagagtgccctggcagggcctgctgctgaccgccagcctgctgaccttctggaacccccccaccaccgcccagctgaccaccgagagcatgcccttcaacgtggccgagggcaaggaggtgctgctgctggtgcacaacctgccccagcagctgttcggctacagctggtacaagggcgagagagtggacggcaacagacagatcgtgggctacgccatcggcacccagcaggccacccccggccccgccaacagcggcagagagaccatctaccccaacgccagcctgctgatccagaacgtgacccagaacgacaccggcttctacaccctgcaggtgatcaagagcgacctggtgaacgaggaggccaccggccagttccacgtgtaccccgagctgcccaagcccagcatcagcagcaacaacagcaaccccgtggaggacaaggacgccgtggccttcacctgcgagcccgagacccaggacaccacctacctgtggtggatcaacaaccagagcctgcccgtgagccccagactgcagctgagcaacggcaacagaaccctgaccctgctgagcgtgaccagaaacgacaccggcccctacgagtgcgagatccagaaccccgtgagcgccaacagaagcgaccccgtgaccctgaacgtgacctacggccccgacacccccaccatcagccccagcgacacctactacagacccggcgccaacctgagcctgagctgctacgccgccagcaacccccccgcccagtacagctggctgatcaacggcaccttccagcagagcacccaggagctgttcatccccaacatcaccgtgaacaacagcggcagctacacctgccacgccaacaacagcgtgaccggctgcaacagaaccaccgtgaagaccatcatcgtgaccgagctgagccccgtggtggccaagccccagatcaaggccagcaagaccaccgtgaccggcgacaaggacagcgtgaacctgacctgcagcaccaacgacaccggcatcagcatcagatggttcttcaagaaccagagcctgcccagcagcgagagaatgaagctgagccagggcaacaccaccctgagcatcaaccccgtgaagagagaggacgccggcacctactggtgcgaggtgttcaaccccatcagcaagaaccagagcgaccccatcatgctgaacgtgaactacaacgccctgccccaggagaacggcctgagccccggcgccatcgccggcatcgtgatcggcgtggtggccctggtggccctgatcgccgtggccctggcctgcttcctgcacttcggcaagaccggcagagccagcgaccagagagacctgaccgagcacaagcccagcgtgagcaaccacacccaggaccacagcaacgacccccccaacaagatgaacgaggtgacctacagcaccctgaacttcgaggcccagcagcccacccagcccaccagcgccagccccagcctgaccgccaccgagatcatctacagcgaggtgaagaagcagtag

SEQ ID NO: 75478 - DNA, 1080 bp, Artificial Sequence
  Description of Artificial Sequence: Synthetic coding sequence
atgcccttcaacgtggccgagggcaaggaggtgctgctgctggtgcacaacctgccccagcagctgttcggctacagctggtacaagggcgagagagtggacggcaacagacagatcgtgggctacgccatcggcacccagcaggccacccccggccccgccaacagcggcagagagaccatctaccccaacgccagcctgctgatccagaacgtgacccagaacgacaccggcttctacaccctgcaggtgatcaagagcgacctggtgaacgaggaggccaccggccagttccacgtgtaccccgagctgcccaagcccagcatcagcagcaacaacagcaaccccgtggaggacaaggacgccgtggccttcacctgcgagcccgagacccaggacaccacctacctgtggtggatcaacaaccagagcctgcccgtgagccccagactgcagctgagcaacggcaacagaaccctgaccctgctgagcgtgaccagaaacgacaccggcccctacgagtgcgagatccagaaccccgtgagcgccaacagaagcgaccccgtgaccctgaacgtgacctacggccccgacacccccaccatcagccccagcgacacctactacagacccggcgccaacctgagcctgagctgctacgccgccagcaacccccccgcccagtacagctggctgatcaacggcaccttccagcagagcacccaggagctgttcatccccaacatcaccgtgaacaacagcggcagctacacctgccacgccaacaacagcgtgaccggctgcaacagaaccaccgtgaagaccatcatcgtgaccgagatggccttccaccacgtggccaaggccggcctgaagctgctgagcagcagcaacccccccgccagcaccagccagagcgccaagatcaccgacaacgccctgccccaggagaacggcctgagccccggcgccatcgccggcatcgtgatcggcgtggtggccctggtggccctgatcgccgtggccctggcctgcttcctgcacttcggcaagaccggcagcagcggccccctgcagtag

SEQ ID NO: 75479 - DNA, 1056 bp, Artificial Sequence
  Description of Artificial Sequence: Synthetic coding sequence
atgggccacctgagcgcccccctgcacagagtgagagtgccctggcagggcctgctgctgaccgccagcctgctgaccttctggaacccccccaccaccgcccagctgaccaccgagagcatgcccttcaacgtggccgagggcaaggaggtgctgctgctggtgcacaacctgccccagcagctgttcggctacagctggtacaagggcgagagagtggacggcaacagacagatcgtgggctacgccatcggcacccagcaggccacccccggccccgccaacagcggcagagagaccatctaccccaacgccagcctgctgatccagaacgtgacccagaacgacaccggcttctacaccctgcaggtgatcaagagcgacctggtgaacgaggaggccaccggccagttccacgtgtaccccgagctgcccaagcccagcatcagcagcaacaacagcaaccccgtggaggacaaggacgccgtggccttcacctgcgagcccgagacccaggacaccacctacctgtggtggatcaacaaccagagcctgcccgtgagccccagactgcagctgagcaacggcaacagaaccctgaccctgctgagcgtgaccagaaacgacaccggcccctacgagtgcgagatccagaaccccgtgagcgccaacagaagcgaccccgtgaccctgaacgtgacctacggccccgacacccccaccatcagccccagcgacacctactacagacccggcgccaacctgagcctgagctgctacgccgccagcaacccccccgcccagtacagctggctgatcaacggcaccttccagcagagcacccaggagctgttcatccccaacatcaccgtgaacaacagcggcagctacacctgccacgccaacaacagcgtgaccggctgcaacagaaccaccgtgaagaccatcatcgtgaccgagagccccgtgctgggcgaggacgaggccgtgcccggccagcaccacccccagcacaagccctgccaggagggcggctgctgggacgtgctggtgtag

SEQ ID NO: 75480 - DNA, 759 bp, Artificial Sequence
  Description of Artificial Sequence: Synthetic coding sequence
atgggccacctgagcgcccccctgcacagagtgagagtgccctggcagggcctgctgctgaccgccagcctgctgaccttctggaacccccccaccaccgcccagctgaccaccgagagcatgcccttcaacgtggccgagggcaaggaggtgctgctgctggtgcacaacctgccccagcagctgttcggctacagctggtacaagggcgagagagtggacggcaacagacagatcgtgggctacgccatcggcacccagcaggccacccccggccccgccaacagcggcagagagaccatctaccccaacgccagcctgctgatccagaacgtgacccagaacgacaccggcttctacaccctgcaggtgatcaagagcgacctggtgaacgaggaggccaccggccagttccacgtgtaccacaacgccctgccccaggagaacggcctgagccccggcgccatcgccggcatcgtgatcggcgtggtggccctggtggccctgatcgccgtggccctggcctgcttcctgcacttcggcaagaccggcagagccagcgaccagagagacctgaccgagcacaagcccagcgtgagcaaccacacccaggaccacagcaacgacccccccaacaagatgaacgaggtgacctacagcaccctgaacttcgaggcccagcagcccacccagcccaccagcgccagccccagcctgaccgccaccgagatcatctacagcgaggtgaagaagcagtag

SEQ ID NO: 75481 - DNA, 1293 bp, Artificial Sequence
  Description of Artificial Sequence: Synthetic coding sequence
atgggccacctgagcgcccccctgcacagagtgagagtgccctggcagggcctgctgctgaccgccagcctgctgaccttctggaacccccccaccaccgcccagctgaccaccgagagcatgcccttcaacgtggccgagggcaaggaggtgctgctgctggtgcacaacctgccccagcagctgttcggctacagctggtacaagggcgagagagtggacggcaacagacagatcgtgggctacgccatcggcacccagcaggccacccccggccccgccaacagcggcagagagaccatctaccccaacgccagcctgctgatccagaacgtgacccagaacgacaccggcttctacaccctgcaggtgatcaagagcgacctggtgaacgaggaggccaccggccagttccacgtgtaccccgagctgcccaagcccagcatcagcagcaacaacagcaaccccgtggaggacaaggacgccgtggccttcacctgcgagcccgagacccaggacaccacctacctgtggtggatcaacaaccagagcctgcccgtgagccccagactgcagctgagcaacggcaacagaaccctgaccctgctgagcgtgaccagaaacgacaccggcccctacgagtgcgagatccagaaccccgtgagcgccaacagaagcgaccccgtgaccctgaacgtgacctacggccccgacacccccaccatcagccccagcgacacctactacagacccggcgccaacctgagcctgagctgctacgccgccagcaacccccccgcccagtacagctggctgatcaacggcaccttccagcagagcacccaggagctgttcatccccaacatcaccgtgaacaacagcggcagctacacctgccacgccaacaacagcgtgaccggctgcaacagaaccaccgtgaagaccatcatcgtgaccgacaacgccctgccccaggagaacggcctgagccccggcgccatcgccggcatcgtgatcggcgtggtggccctggtggccctgatcgccgtggccctggcctgcttcctgcacttcggcaagaccggcagagccagcgaccagagagacctgaccgagcacaagcccagcgtgagcaaccacacccaggaccacagcaacgacccccccaacaagatgaacgaggtgacctacagcaccctgaacttcgaggcccagcagcccacccagcccaccagcgccagccccagcctgaccgccaccgagatcatctacagcgaggtgaagaagcagtag

SEQ ID NO: 75482 - DNA, 1386 bp, Artificial Sequence
  Description of Artificial Sequence: Synthetic coding sequence
atgggccacctgagcgcccccctgcacagagtgagagtgccctggcagggcctgctgctgaccgccagcctgctgaccttctggaacccccccaccaccgcccagctgaccaccgagagcatgcccttcaacgtggccgagggcaaggaggtgctgctgctggtgcacaacctgccccagcagctgttcggctacagctggtacaagggcgagagagtggacggcaacagacagatcgtgggctacgccatcggcacccagcaggccacccccggccccgccaacagcggcagagagaccatctaccccaacgccagcctgctgatccagaacgtgacccagaacgacaccggcttctacaccctgcaggtgatcaagagcgacctggtgaacgaggaggccaccggccagttccacgtgtaccccgagctgcccaagcccagcatcagcagcaacaacagcaaccccgtggaggacaaggacgccgtggccttcacctgcgagcccgagacccaggacaccacctacctgtggtggatcaacaaccagagcctgcccgtgagccccagactgcagctgagcaacggcaacagaaccctgaccctgctgagcgtgaccagaaacgacaccggcccctacgagtgcgagatccagaaccccgtgagcgccaacagaagcgaccccgtgaccctgaacgtgacctacggccccgacacccccaccatcagccccagcgacacctactacagacccggcgccaacctgagcctgagctgctacgccgccagcaacccccccgcccagtacagctggctgatcaacggcaccttccagcagagcacccaggagctgttcatccccaacatcaccgtgaacaacagcggcagctacacctgccacgccaacaacagcgtgaccggctgcaacagaaccaccgtgaagaccatcatcgtgaccgagagacagaacctgaccatgctgcccagactggacagcaacagctgggcccaggccatcctgcccagcgtgagccagagcgccgagatcaccgacaacgccctgccccaggagaacggcctgagccccggcgccatcgccggcatcgtgatcggcgtggtggccctggtggccctgatcgccgtggccctggcctgcttcctgcacttcggcaagaccggcagagccagcgaccagagagacctgaccgagcacaagcccagcgtgagcaaccacacccaggaccacagcaacgacccccccaacaagatgaacgaggtgacctacagcaccctgaacttcgaggcccagcagcccacccagcccaccagcgccagccccagcctgaccgccaccgagatcatctacagcgaggtgaagaagcagtag

SEQ ID NO: 75483 - DNA, 1254 bp, Artificial Sequence
  Description of Artificial Sequence: Synthetic coding sequence
atgggccacctgagcgcccccctgcacagagtgagagtgccctggcagggcctgctgctgaccgccagcctgctgaccttctggaacccccccaccaccgcccagctgaccaccgagagcatgcccttcaacgtggccgagggcaaggaggtgctgctgctggtgcacaacctgccccagcagctgttcggctacagctggtacaagggcgagagagtggacggcaacagacagatcgtgggctacgccatcggcacccagcaggccacccccggccccgccaacagcggcagagagaccatctaccccaacgccagcctgctgatccagaacgtgacccagaacgacaccggcttctacaccctgcaggtgatcaagagcgacctggtgaacgaggaggccaccggccagttccacgtgtaccccgagctgcccaagcccagcatcagcagcaacaacagcaaccccgtggaggacaaggacgccgtggccttcacctgcgagcccgagacccaggacaccacctacctgtggtggatcaacaaccagagcctgcccgtgagccccagactgcagctgagcaacggcaacagaaccctgaccctgctgagcgtgaccagaaacgacaccggcccctacgagtgcgagatccagaaccccgtgagcgccaacagaagcgaccccgtgaccctgaacgtgacctacggccccgacacccccaccatcagccccagcgacacctactacagacccggcgccaacctgagcctgagctgctacgccgccagcaacccccccgcccagtacagctggctgatcaacggcaccttccagcagagcacccaggagctgttcatccccaacatcaccgtgaacaacagcggcagctacacctgccacgccaacaacagcgtgaccggctgcaacagaaccaccgtgaagaccatcatcgtgaccgagctgagccccgtggtggccaagccccagatcaaggccagcaagaccaccgtgaccggcgacaaggacagcgtgaacctgacctgcagcaccaacgacaccggcatcagcatcagatggttcttcaagaaccagagcctgcccagcagcgagagaatgaagctgagccagggcaacaccaccctgagcatcaaccccgtgaagagagaggacgccggcacctactggtgcgaggtgttcaaccccatcagcaagaaccagagcgaccccatcatgctgaacgtgaactgcaagtag

SEQ ID NO: 75484 - DNA, 1437 bp, Artificial Sequence
  Description of Artificial Sequence: Synthetic coding sequence
atgcccttcaacgtggccgagggcaaggaggtgctgctgctggtgcacaacctgccccagcagctgttcggctacagctggtacaagggcgagagagtggacggcaacagacagatcgtgggctacgccatcggcacccagcaggccacccccggccccgccaacagcggcagagagaccatctaccccaacgccagcctgctgatccagaacgtgacccagaacgacaccggcttctacaccctgcaggtgatcaagagcgacctggtgaacgaggaggccaccggccagttccacgtgtaccccgagctgcccaagcccagcatcagcagcaacaacagcaaccccgtggaggacaaggacgccgtggccttcacctgcgagcccgagacccaggacaccacctacctgtggtggatcaacaaccagagcctgcccgtgagccccagactgcagctgagcaacggcaacagaaccctgaccctgctgagcgtgaccagaaacgacaccggcccctacgagtgcgagatccagaaccccgtgagcgccaacagaagcgaccccgtgaccctgaacgtgacctacggccccgacacccccaccatcagccccagcgacacctactacagacccggcgccaacctgagcctgagctgctacgccgccagcaacccccccgcccagtacagctggctgatcaacggcaccttccagcagagcacccaggagctgttcatccccaacatcaccgtgaacaacagcggcagctacacctgccacgccaacaacagcgtgaccggctgcaacagaaccaccgtgaagaccatcatcgtgaccgagctgagccccgtggtggccaagccccagatcaaggccagcaagaccaccgtgaccggcgacaaggacagcgtgaacctgacctgcagcaccaacgacaccggcatcagcatcagatggttcttcaagaaccagagcctgcccagcagcgagagaatgaagctgagccagggcaacaccaccctgagcatcaaccccgtgaagagagaggacgccggcacctactggtgcgaggtgttcaaccccatcagcaagaaccagagcgaccccatcatgctgaacgagatggccttccaccacgtggccaaggccggcctgaagctgctgagcagcagcaacccccccgccagcaccagccagagcgccaagatcaccgagagacagaacctgaccatgctgcccagactggacagcaacagctgggcccaggccatcctgcccagcgtgagccagagcgccgagatcaccgacaacgccctgccccaggagaacggcctgagccccggcgccatcgccggcatcgtgatcggcgtggtggccctggtggccctgatcgccgtggccctggcctgcttcctgcacttcggcaagaccggctag

SEQ ID NO: 75485 - DNA, 966 bp, Artificial Sequence
  Description of Artificial Sequence: Synthetic coding sequence
atgggccacctgagcgcccccctgcacagagtgagagtgccctggcagggcctgctgctgaccgccagcctgctgaccttctggaacccccccaccaccgcccagctgaccaccgagagcatgcccttcaacgtggccgagggcaaggaggtgctgctgctggtgcacaacctgccccagcagctgttcggctacagctggtacaagggcgagagagtggacggcaacagacagatcgtgggctacgccatcggcacccagcaggccacccccggccccgccaacagcggcagagagaccatctaccccaacgccagcctgctgatccagaacgtgacccagaacgacaccggcttctacaccctgcaggtgatcaagagcgacctggtgaacgaggaggccaccggccagttccacgtgtaccccgagctgcccaagcccagcatcagcagcaacaacagcaaccccgtggaggacaaggacgccgtggccttcacctgcgagcccgagacccaggacaccacctacctgtggtggatcaacaaccagagcctgcccgtgagccccagactgcagctgagcaacggcaacagaaccctgaccctgctgagcgtgaccagaaacgacaccggcccctacgagtgcgagatccagaaccccgtgagcgccaacagaagcgaccccgtgaccctgaacgtgacctacggccccgacacccccaccatcagccccagcgacacctactacagacccggcgccaacctgagcctgagctgctacgccgccagcaacccccccgcccagtacagctggctgatcaacggcaccttccagcagagcacccaggagctgttcatccccaacatcaccgtgaacaacagcggcagctacacctgccacgccaacaacagcgtgaccggctgcaacagaaccaccgtgaagaccatcatcgtgaccggcaagtag

SEQ ID NO: 75486 - DNA, 1458 bp, Artificial Sequence
  Description of Artificial Sequence: Synthetic coding sequence
agaggcgacagagccgccgtgctggaggccttcctggagcccaagctgagcagcaccggcgaggacagagccagcagaagacaccacggcgcccccctgagccccaccagccagagcgcctgcaccctgggcctgctgctgaccgccagcctgctgaccttctggaacccccccaccaccgcccagctgaccaccgagagcatgcccttcaacgtggccgagggcaaggaggtgctgctgctggtgcacaacctgccccagcagctgttcggctacagctggtacaagggcgagagagtggacggcaacagacagatcgtgggctacgccatcggcacccagcaggccacccccggccccgccaacagcggcagagagaccatctaccccaacgccagcctgctgatccagaacgtgacccagaacgacaccggcttctacaccctgcaggtgatcaagagcgacctggtgaacgaggaggccaccggccagttccacgtgtaccccgagctgcccaagcccagcatcagcagcaacaacagcaaccccgtggaggacaaggacgccgtggccttcacctgcgagcccgagacccaggacaccacctacctgtggtggatcaacaaccagagcctgcccgtgagccccagactgcagctgagcaacggcaacagaaccctgaccctgctgagcgtgaccagaaacgacaccggcccctacgagtgcgagatccagaaccccgtgagcgccaacagaagcgaccccgtgaccctgaacgtgacctacggccccgacacccccaccatcagccccagcgacacctactacagacccggcgccaacctgagcctgagctgctacgccgccagcaacccccccgcccagtacagctggctgatcaacggcaccttccagcagagcacccaggagctgttcatccccaacatcaccgtgaacaacagcggcagctacacctgccacgccaacaacagcgtgaccggctgcaacagaaccaccgtgaagaccatcatcgtgaccgagctgagccccgtggtggccaagccccagatcaaggccagcaagaccaccgtgaccggcgacaaggacagcgtgaacctgacctgcagcaccaacgacaccggcatcagcatcagatggttcttcaagaaccagagcctgcccagcagcgagagaatgaagctgagccagggcaacaccaccctgagcatcaaccccgtgaagagagaggacgccggcacctactggtgcgaggtgttcaaccccatcagcaagaaccagagcgaccccatcatgctgaacgtgaactacaacgccctgccccaggagaacggcctgagccccggcgccatcgccggcatcgtgatcggcgtggtggccctggtggccctgatcgccgtggccctggcctgcttcctgcacttcggcaagaccggctag

SEQ ID NO: 75487 - DNA, 1395 bp, Artificial Sequence
  Description of Artificial Sequence: Synthetic coding sequence
atgggccacctgagcgcccccctgcacagagtgagagtgccctggcagggcctgctgctgaccgccagcctgctgaccttctggaacccccccaccaccgcccagctgaccaccgagagcatgcccttcaacgtggccgagggcaaggaggtgctgctgctggtgcacaacctgccccagcagctgttcggctacagctggtacaagggcgagagagtggacggcaacagacagatcgtgggctacgccatcggcacccagcaggccacccccggccccgccaacagcggcagagagaccatctaccccaacgccagcctgctgatccagaacgtgacccagaacgacaccggcttctacaccctgcaggtgatcaagagcgacctggtgaacgaggaggccaccggccagttccacgtgtaccccgagctgcccaagcccagcatcagcagcaacaacagcaaccccgtggaggacaaggacgccgtggccttcacctgcgagcccgagacccaggacaccacctacctgtggtggatcaacaaccagagcctgcccgtgagccccagactgcagctgagcaacggcaacagaaccctgaccctgctgagcgtgaccagaaacgacaccggcccctacgagtgcgagatccagaaccccgtgagcgccaacagaagcgaccccgtgaccctgaacgtgacctacggccccgacacccccaccatcagccccagcgacacctactacagacccggcgccaacctgagcctgagctgctacgccgccagcaacccccccgcccagtacagctggctgatcaacggcaccttccagcagagcacccaggagctgttcatccccaacatcaccgtgaacaacagcggcagctacacctgccacgccaacaacagcgtgaccggctgcaacagaaccaccgtgaagaccatcatcgtgaccgagctgagccccgtggtggccaagccccagatcaaggccagcaagaccaccgtgaccggcgacaaggacagcgtgaacctgacctgcagcaccaacgacaccggcatcagcatcagatggttcttcaagaaccagagcctgcccagcagcgagagaatgaagctgagccagggcaacaccaccctgagcatcaaccccgtgaagagagaggacgccggcacctactggtgcgaggtgttcaaccccatcagcaagaaccagagcgaccccatcatgctgaacgtgaactacaacgccctgccccaggagaacggcctgagccccggcgccatcgccggcatcgtgatcggcgtggtggccctggtggccctgatcgccgtggccctggcctgcttcctgcacttcggcaagaccggcagcagcggccccctgcagtag

SEQ ID NO: 75488 - DNA, 1107 bp, Artificial Sequence
  Description of Artificial Sequence: Synthetic coding sequence
atgggccacctgagcgcccccctgcacagagtgagagtgccctggcagggcctgctgctgaccgccagcctgctgaccttctggaacccccccaccaccgcccagctgaccaccgagagcatgcccttcaacgtggccgagggcaaggaggtgctgctgctggtgcacaacctgccccagcagctgttcggctacagctggtacaagggcgagagagtggacggcaacagacagatcgtgggctacgccatcggcacccagcaggccacccccggccccgccaacagcggcagagagaccatctaccccaacgccagcctgctgatccagaacgtgacccagaacgacaccggcttctacaccctgcaggtgatcaagagcgacctggtgaacgaggaggccaccggccagttccacgtgtaccccgagctgcccaagcccagcatcagcagcaacaacagcaaccccgtggaggacaaggacgccgtggccttcacctgcgagcccgagacccaggacaccacctacctgtggtggatcaacaaccagagcctgcccgtgagccccagactgcagctgagcaacggcaacagaaccctgaccctgctgagcgtgaccagaaacgacaccggcccctacgagtgcgagatccagaaccccgtgagcgccaacagaagcgaccccgtgaccctgaacgtgacctacggccccgacacccccaccatcagccccagcgacacctactacagacccggcgccaacctgagcctgagctgctacgccgccagcaacccccccgcccagtacagctggctgatcaacggcaccttccagcagagcacccaggagctgttcatccccaacatcaccgtgaacaacagcggcagctacacctgccacgccaacaacagcgtgaccggctgcaacagaaccaccgtgaagaccatcatcgtgaccgacaacgccctgccccaggagaacggcctgagccccggcgccatcgccggcatcgtgatcggcgtggtggccctggtggccctgatcgccgtggccctggcctgcttcctgcacttcggcaagaccggcagcagcggccccctgcagtag

SEQ ID NO: 75489 - DNA, 906 bp, Artificial Sequence
  Description of Artificial Sequence: Synthetic coding sequence
atgctggccctgagagtggccagaggcagctggggcgccctgagaggcgccgcctgggcccccggcaccagacccagcaagagaagagcctgctgggccctgctgccccccgtgccctgctgcctgggctgcctggccgagagatggagactgagacccgccgccctgggcctgagactgcccggcatcggccagagaaaccactgcagcggcgccggcaaggccgcccccagacccgccgccggcgccggcgccgccgccgaggcccccggcggccagtggggccccgccagcacccccagcctgtacgagaacccctggaccatccccaacatgctgagcatgaccagaatcggcctggcccccgtgctgggctacctgatcatcgaggaggacttcaacatcgccctgggcgtgttcgccctggccggcctgaccgacctgctggacggcttcatcgccagaaactgggccaaccagagaagcgccctgggcagcgccctggaccccctggccgacaagatcctgatcagcatcctgtacgtgagcctgacctacgccgacctgatccccgtgcccctgacctacatgatcatcagcagagacgtgatgctgatcgccgccgtgttctacgtgagatacagaaccctgcccacccccagaaccctggccaagtacttcaacccctgctacgccaccgccagactgaagcccaccttcatcagcaaggtgaacaccgccgtgcagctgatcctggtggccgccagcctggccgcccccgtgttcaactacgccgacagcatctacctgcagatcctgtggtgcttcaccgccttcaccaccgccgccagcgcctacagctactaccactacggcagaaagaccgtgcaggtgatcaaggactag

SEQ ID NO: 75490 - DNA, 609 bp, Artificial Sequence
  Description of Artificial Sequence: Synthetic coding sequence
atgccccagtacgagaacccctggaccatccccaacatgctgagcatgaccagaatcggcctggcccccgtgctgggctacctgatcatcgaggaggacttcaacatcgccctgggcgtgttcgccctggccggcctgaccgacctgctggacggcttcatcgccagaaactgggccaaccagagaagcgccctgggcagcgccctggaccccctggccgacaagatcctgatcagcatcctgtacgtgagcctgacctacgccgacctgatccccgtgcccctgacctacatgatcatcagcagagacgtgatgctgatcgccgccgtgttctacgtgagatacagaaccctgcccacccccagaaccctggccaagtacttcaacccctgctacgccaccgccagactgaagcccaccttcatcagcaaggtgaacaccgccgtgcagctgatcctggtggccgccagcctggccgcccccgtgttcaactacgccgacagcatctacctgcagatcctgtggtgcttcaccgccttcaccaccgccgccagcgcctacagctactaccactacggcagaaagaccgtgcaggtgatcaaggactag

SEQ ID NO: 75491 - DNA, 618 bp, Artificial Sequence
  Description of Artificial Sequence: Synthetic coding sequence
atgctggccctgagagtggccagaggcagctggggcgccctgagaggcgccgcctgggcccccggcaccagacccagcaagagaagagcctgctgggccctgctgccccccgtgccctgctgcctgggctgcctggccgagagatggagactgagacccgccgccctgggcctgagactgcccggcatcggccagagaaaccactgcagcggcgccggcaaggccgcccccagacccgccgccggcgccggcgccgccgccgaggcccccggcggccagtggggccccgccagcacccccagcctgtacgagaacccctggaccatccccaacatgctgagcatgaccagaatcggcctggcccccgtgctgggctacctgatcatcgaggaggacttcaacatcgccctgggcgtgttcgccctggccggcctgaccgacctgctggacggcttcatcgccagaaactgggccaaccagagaagcgccctgggcagcgccctggaccccctggccgacaagatcctgatcagcatcctgtacgtgagcctgacctacgccgacctgatccccgccaacacctgccaggtgttccagagcctgctgtgccactgctag

SEQ ID NO: 75492 - DNA, 12210 bp, Artificial Sequence
  Description of Artificial Sequence: Synthetic coding sequence
atggccagcagagacagcaaccacgccggcgagagcttcctgggcagcgacggcgacgaggaggccaccagagagctggagaccgaggaggagagcgagggcgaggaggacgagaccgccgccgagagcgaggaggagcccgacagcagactgagcgaccaggacgaggagggcaagatcaagcaggagtacatcatcagcgaccccagcttcagcatggtgaccgtgcagagagaggacagcggcatcacctgggagaccaacagcagcagaagcagcaccccctgggccagcgaggagagccagaccagcggcgtgtgcagcagagagggcagcaccgtgaacagcccccccggcaacgtgagcttcatcgtggacgaggtgaagaaggtgagaaagagaacccacaagagcaagcacggcagccccagcctgagaagaaagggcaacagaaagagaaacagcttcgagagccaggacgtgcccaccaacaagaagggcagccccctgaccagcgccagccaggtgctgaccaccgagaaggagaagagctacaccggcatctacgacaaggccagaaagaagaagaccaccagcaacaccccccccatcaccggcgccatctacaaggagcacaagcccctggtgctgagacccgtgtacatcggcaccgtgcagtacaagatcaagatgttcaacagcgtgaaggaggagctgatccccctgcagttctacggcaccctgcccaagggctacgtgatcaaggagatccactacagaaagggcaaggacgccagcatcagcctggagcccgacctggacaacagcggcagcaacaccgtgagcaagaccagaaagctggtggcccagagcatcgaggacaaggtgaaggaggtgttccccccctggagaggcgccctgagcaagggcagcgagagcctgaccctgatgttcagccacgaggaccagaagaagatctacgccgacagccccctgaacgccaccagcgccctggagcacaccgtgcccagctacagcagcagcggcagagccgagcagggcatccagctgagacacagccagagcgtgccccagcagcccgaggacgaggccaagccccacgaggtggagccccccagcgtgacccccgacacccccgccaccatgttcctgagaaccaccaaggaggagtgcgagctggccagccccggcaccgccgccagcgagaacgacagcagcgtgagccccagcttcgccaacgaggtgaagaaggaggacgtgtacagcgcccaccacagcatcagcctggaggccgccagccccggcctggccgccagcacccaggacggcctggaccccgaccaggagcagcccgacctgaccagcatcgagagagccgagcccgtgagcgccaagctgacccccacccaccccagcgtgaagggcgagaaggaggagaacatgctggagcccagcatcagcctgagcgagcccctgatgctggaggagcccgagaaggaggagatcgagaccagcctgcccatcgccatcacccccgagcccgaggacagcaacctggtggaggaggagatcgtggagctggactaccccgagagccccctggtgagcgagaagcccttccccccccacatgagccccgaggtggagcacaaggaggaggagctgatcctgcccctgctggccgccagcagccccgagcacgtggccctgagcgaggaggagagagaggagatcgccagcgtgagcaccggcagcgccttcgtgagcgagtacagcgtgccccaggacctgaaccacgagctgcaggagcaggagggcgagcccgtgccccccagcaacgtggaggccatcgccgagcacgccgtgctgagcgaggaggagaacgaggagttcgaggcctacagccccgccgccgcccccaccagcgagagcagcctgagccccagcaccaccgagaagaccagcgagaaccagagccccctgttcagcaccgtgacccccgagtacatggtgctgagcggcgacgaggccagcgagagcggctgctacacccccgacagcaccagcgccagcgagtacagcgtgcccagcctggccaccaaggagagcctgaagaagaccatcgacagaaagagccccctgatcctgaagggcgtgagcgagtacatgatccccagcgaggagaaggaggacaccggcagcttcacccccgccgtggcccccgccagcgagcccagcctgagccccagcaccaccgagaagaccagcgagtgccagagccccctgcccagcaccgccaccagcgagcacgtggtgcccagcgagggcgaggacctgggcagcgagagattcacccccgacagcaagctgatcagcaagtacgccgcccccctgaacgccacccaggagagccagaagaagatcatcaacgaggccagccagttcaagcccaagggcatcagcgagcacaccgtgctgagcgtggacggcaaggaggtgatcggccccagcagccccgacctggtggtggccagcgagcacagcttccccccccacaccaccgagatgaccagcgagtgccaggccccccccctgagcgccacccccagcgagtacgtggtgctgagcgacgaggaggccgtggagctggagagatacacccccagcagcaccagcgccagcgagttcagcgtgcccccctacgccacccccgaggcccaggaggaggagatcgtgcacagaagcctgaacctgaagggcgccagcagccccatgaacctgagcgaggaggaccaggaggacatcggccccttcagccccgacagcgccttcgtgagcgagttcagcttccccccctacgccacccaggaggccgagaagagagagttcgagtgcgacagccccatctgcctgaccagccccagcgagcacaccatcctgagcgacgaggacaccgaggaggccgagctgttcagccccgacagcgccagccaggtgagcatcccccccttcagaatcagcgagaccgagaagaacgagctggagcccgacagcctgctgaccgccgtgagcgccagcggctacagctgcttcagcgaggccgacgaggaggacatcggcagcaccgccgccacccccgtgagcgagcagttcagcagcagccagaagcagaaggccgagaccttccccctgatgagccccctggaggacctgagcctgccccccagcaccgacaagagcgagaaggccgagatcaagcccgagatccccaccaccagcaccagcgtgagcgagtacctgatcctggcccagaagcagaagacccaggcctacctggagcccgagagcgaggacctgatccccagccacctgaccagcgaggtggagaagggcgagagagaggccagcagcagcgtggccgccatccccgccgccctgcccgcccagagcagcatcgtgaaggaggagaccaagcccgccagcccccacagcgtgctgcccgacagcgtgcccgccatcaagaaggagcaggagcccaccgccgccctgaccctgaaggccgccgacgagcagatggccctgagcaaggtgagaaaggaggagatcgtgcccgacagccaggaggccaccgcccacgtgagccaggaccagaagatggagccccagccccccaacgtgcccgagagcgagatgaagtacagcgtgctgcccgacatggtggacgagcccaagaagggcgtgaagcccaagctggtgctgaacgtgaccagcgagctggagcagagaaagctgagcaagaacgagcccgaggtgatcaagccctacagccccctgaaggagaccagcctgagcggccccgaggccctgagcgccgtgaagatggagatgaagcacgacagcaagatcaccaccacccccatcgtgctgcacagcgccagcagcggcgtggagaagcaggtggagcacggcccccccgccctggccttcagcgccctgagcgaggagatcaagaaggagatcgagcccagcagcagcaccaccaccgccagcgtgaccaagctggacagcaacctgaccagagccgtgaaggaggagatccccaccgacagcagcctgatcacccccgtggacagacccgtgctgaccaaggtgggcaagggcgagctgggcagcggcctgccccccctggtgaccagcgccgacgagcacagcgtgctggccgaggaggacaaggtggccatcaagggcgccagccccatcgagaccagcagcaagcacctggcctggagcgaggccgagaaggagatcaagttcgacagcctgcccagcgtgagcagcatcgccgagcacagcgtgctgagcgaggtggaggccaaggaggtgaaggccggcctgcccgtgatcaagaccagcagcagccagcacagcgacaagagcgaggaggccagagtggaggacaagcaggacctgctgttcagcaccgtgtgcgacagcgagagactggtgagcagccagaagaagagcctgatgagcaccagcgaggtgctggagcccgagcacgagctgcccctgagcctgtggggcgagatcaagaagaaggagaccgagctgcccagcagccagaacgtgagccccgccagcaagcacatcatccccaagggcaaggacgaggagaccgccagcagcagccccgagctggagaacctggccagcggcctggcccccaccctgctgctgctgagcgacgacaagaacaagcccgccgtggaggtgagcagcaccgcccagggcgacttccccagcgagaagcaggacgtggccctggccgagctgagcctggagcccgagaagaaggacaagccccaccagcccctggagctgcccaacgccggcagcgagttcagcagcgacctgggcagacagagcggcagcatcggcaccaagcaggccaagagccccatcaccgagaccgaggacagcgtgctggagaagggccccgccgagctgagaagcagagagggcaaggaggagaacagagagctgtgcgccagcagcaccatgcccgccatcagcgagctgagcagcctgctgagagaggagagccagaacgaggagatcaagcccttcagccccaagatcatcagcctggagagcaaggagccccccgccagcgtggccgagggcggcaaccccgaggagttccagcccttcaccttcagcctgaagggcctgagcgaggaggtgagccaccccgccgacttcaagaagggcggcaaccaggagatcggccccctgccccccaccggcaacctgaaggcccaggtgatgggcgacatcctggacaagctgagcgaggagaccggccaccccaacagcagccaggtgctgcagagcatcaccgagcccagcaagatcgcccccagcgacctgctggtggagcagaagaagaccgagaaggccctgcacagcgaccagaccgtgaagctgcccgacgtgagcaccagcagcgaggacaagcaggacctgggcatcaagcagttcagcctgatgagagagaacctgcccctggagcagagcaagagcttcatgaccaccaagcccgccgacgtgaaggagaccaagatggaggagttcttcatcagccccaaggacgagaactggatgctgggcaagcccgagaacgtggccagccagcacgagcagagaatcgccggcagcgtgcagctggacagcagcagcagcaacgagctgagacccggccagctgaaggccgccgtgagcagcaaggaccacacctgcgaggtgagaaagcaggtgctgccccacagcgccgaggagagccacctgagcagccaggaggccgtgagcgccctggacaccagcagcggcaacaccgagaccctgagcagcaagagctacagcagcgaggaggtgaagctggccgaggagcccaagagcctggtgctggccggcaacgtggagagaaacatcgccgagggcaaggagatccacagcctgatggagagcgagagcctgctgctggagaaggccaacaccgagctgagctggcccagcaaggaggacagccaggagaagatcaagctgccccccgagagattcttccagaagcccgtgagcggcctgagcgtggagcaggtgaagagcgagaccatcagcagcagcgtgaagaccgcccacttccccgccgagggcgtggagcccgccctgggcaacgagaaggaggcccacagaagcaccccccccttccccgaggagaagcccctggaggagagcaagatggtgcagagcaaggtgatcgacgacgccgacgagggcaagaagcccagccccgaggtgaagatccccacccagagaaagcccatcagcagcatccacgccagagagccccagagccccgagagccccgaggtgacccagaacccccccacccagcccaaggtggccaagcccgacctgcccgaggagaagggcaagaagggcatcagcagcttcaagagctggatgagcagcctgttcttcggcagcagcacccccgacaacaaggtggccgagcaggaggacctggagacccagcccagccccagcgtggagaaggccgtgaccgtgatcgaccccgagggcaccatccccaccaacttcaacgtggccgagaagcccgccgaccacagcctgagcgaggtgaagctgaagaccgccgacgagcccagaggcaccctggtgaagagcggcgacggccagaacgtgaaggagaagagcatgatcctgagcaacgtggaggacctgcagcagcccaagttcatcagcgaggtgagcagagaggactacggcaagaaggagatcagcggcgacagcgaggagatgaacatcaacagcgtggtgaccagcgccgacggcgagaacctggagatccagagctacagcctgatcggcgagaagctggtgatggaggaggccaagaccatcgtgcccccccacgtgaccgacagcaagagagtgcagaagcccgccatcgccccccccagcaagtggaacatcagcatcttcaaggaggagcccagaagcgaccagaagcagaagagcctgctgagcttcgacgtggtggacaaggtgccccagcagcccaagagcgccagcagcaacttcgccagcaagaacatcaccaaggagagcgagaagcccgagagcatcatcctgcccgtggaggagagcaagggcagcctgatcgacttcagcgaggacagactgaagaaggagatgcagaaccccaccagcctgaagatcagcgaggaggagaccaagctgagaagcgtgagccccaccgagaagaaggacaacctggagaacagaagctacaccctggccgagaagaaggtgctggccgagaagcagaacagcgtggcccccctggagctgagagacagcaacgagatcggcaagacccagatcaccctgggcagcagaagcaccgagctgaaggagagcaaggccgacgccatgccccagcacttctaccagaacgaggactacaacgagagacccaagatcatcgtgggcagcgagaaggagaagggcgaggagaaggagaaccaggtgtacgtgctgagcgagggcaagaagcagcaggagcaccagccctacagcgtgaacgtggccgagagcatgagcagagagagcgacatcagcctgggccacagcctgggcgagacccagagcttcagcctggtgaaggccaccagcgtgaccgagaagagcgaggccatgctggccgaggcccaccccgagatcagagaggccaaggccgtgggcacccagccccaccccctggaggagagcaaggtgctggtggagaagaccaagaccttcctgcccgtggccctgagctgcagagacgagatcgagaaccacagcctgagccaggagggcaacctggtgctggagaagagcagcagagacatgcccgaccacagcgaggagaaggagcagttcagagagagcgagctgagcaagggcggcagcgtggacatcaccaaggagaccgtgaagcagggcttccaggagaaggccgtgggcacccagcccagacccctggaggagagcaaggtgctggtggagaagaccaagaccttcctgcccgtggtgctgagctgccacgacgagatcgagaaccacagcctgagccaggagggcaacctggtgctggagaagagcagcagagacatgcccgaccacagcgaggagaaggagcagttcaaggagagcgagctgtggaagggcggcagcgtggacatcaccaaggagagcatgaaggagggcttccccagcaaggagagcgagagaaccctggccagacccttcgacgagaccaagagcagcgagacccccccctacctgctgagccccgtgaagccccagaccctggccagcggcgccagccccgagatcaacgccgtgaagaagaaggagatgcccagaagcgagctgacccccgagagacacaccgtgcacaccatccagaccagcaaggacgacaccagcgacgtgcccaagcagagcgtgctggtgagcaagcaccacctggaggccgccgaggacaccagagtgaaggagcccctgagcagcgccaagagcaactacgcccagttcatcagcaacaccagcgccagcaacgccgacaagatggtgagcaacaaggagatgcccaaggagcccgaggacacctacgccaagggcgaggacttcaccgtgaccagcaagcccgccggcctgagcgaggaccagaagaccgccttcagcatcatcagcgagggctgcgagatcctgaacatccacgcccccgccttcatcagcagcatcgaccaggaggagagcgagcagatgcaggacaagctggagtacctggaggagaaggccagcttcaagaccatccccctgcccgacgacagcgagaccgtggcctgccacaagaccctgaagagcagactggaggacgagaaggtgacccccctgaaggagaacaagcagaaggagacccacaagaccaaggaggagatcagcaccgacagcgagaccgacctgagcttcatccagcccaccatccccagcgaggaggactacttcgagaagtacaccctgatcgactacaacatcagccccgaccccgagaagcagaaggccccccagaagctgaacgtggaggagaagctgagcaaggaggtgaccgaggagaccatcagcttccccgtgagcagcgtggagagcgccctggagcacgagtacgacctggtgaagctggacgagagcttctacggccccgagaagggccacaacatcctgagccaccccgagacccagagccagaacagcgccgacagaaacgtgagcaaggacaccaagagagacgtggacagcaagagccccggcatgcccctgttcgaggccgaggagggcgtgctgagcagaacccagatcttccccaccaccatcaaggtgatcgaccccgagttcctggaggagccccccgccctggccttcctgtacaaggacctgtacgaggaggccgtgggcgagaagaagaaggaggaggagaccgccagcgagggcgacagcgtgaacagcgaggccagcttccccagcagaaacagcgacaccgacgacggcaccggcatctacttcgagaagtacatcctgaaggacgacatcctgcacgacaccagcctgacccagaaggaccagggccagggcctggaggagaagagagtgggcaaggacgacagctaccagcccatcgccgccgagggcgagatctggggcaagttcggcaccatctgcagagagaagagcctggaggagcagaagggcgtgtacggcgagggcgagagcgtggaccacgtggagaccgtgggcaacgtggccatgcagaagaaggcccccatcaccgaggacgtgagagtggccacccagaagatcagctacgccgtgcccttcgaggacacccaccacgtgctggagagagccgacgaggccggcagccacggcaacgaggtgggcaacgccagccccgaggtgaacctgaacgtgcccgtgcaggtgagcttccccgaggaggagttcgccagcggcgccacccacgtgcaggagaccagcctggaggagcccaagatcctggtgccccccgagcccagcgaggagagactgagaaacagccccgtgcaggacgagtacgagttcaccgagagcctgcacaacgaggtggtgccccaggacatcctgagcgaggagctgagcagcgagagcacccccgaggacgtgctgagccagggcaaggagagcttcgagcacatcagcgagaacgagttcgccagcgaggccgagcagagcacccccgccgagcagaaggagctgggcagcgagagaaaggaggaggaccagctgagcagcgaggtggtgaccgagaaggcccagaaggagctgaagaagagccagatcgacacctactgctacacctgcaagtgccccatcagcgccaccgacaaggtgttcggcacccacaaggaccacgaggtgagcaccctggacaccgccatcagcgccgtgaaggtgcagctggccgagttcctggagaacctgcaggagaagagcctgagaatcgaggccttcgtgagcgagatcgagagcttcttcaacaccatcgaggagaactgcagcaagaacgagaagagactggaggagcagaacgaggagatgatgaagaaggtgctggcccagtacgacgagaaggcccagagcttcgaggaggtgaagaagaagaagatggagttcctgcacgagcagatggtgcacttcctgcagagcatggacaccgccaaggacaccctggagaccatcgtgagagaggccgaggagctggacgaggccgtgttcctgaccagcttcgaggagatcaacgagagactgctgagcgccatggagagcaccgccagcctggagaagatgcccgccgccttcagcctgttcgagcactacgacgacagcagcgccagaagcgaccagatgctgaagcaggtggccgtgccccagccccccagactggagccccaggagcccaacagcgccaccagcaccaccatcgccgtgtactggagcatgaacaaggaggacgtgatcgacagcttccaggtgtactgcatggaggagccccaggacgaccaggaggtgaacgagctggtggaggagtacagactgaccgtgaaggagagctactgcatcttcgaggacctggagcccgacagatgctaccaggtgtgggtgatggccgtgaacttcaccggctgcagcctgcccagcgagagagccatcttcagaaccgcccccagcacccccgtgatcagagccgaggactgcaccgtgtgctggaacaccgccaccatcagatggagacccaccacccccgaggccaccgagacctacaccctggagtactgcagacagcacagccccgagggcgagggcctgagaagcttcagcggcatcaagggcctgcagctgaaggtgaacctgcagcccaacgacaactacttcttctacgtgagagccatcaacgccttcggcaccagcgagcagagcgaggccgccctgatcagcaccagaggcaccagattcctgctgctgagagagaccgcccaccccgccctgcacatcagcagcagcggcaccgtgatcagcttcggcgagagaagaagactgaccgagatccccagcgtgctgggcgaggagctgcccagctgcggccagcactactgggagaccaccgtgaccgactgccccgcctacagactgggcatctgcagcagcagcgccgtgcaggccggcgccctgggccagggcgagaccagctggtacatgcactgcagcgagccccagagatacaccttcttctacagcggcatcgtgagcgacgtgcacgtgaccgagagacccgccagagtgggcatcctgctggactacaacaaccagagactgatcttcatcaacgccgagagcgagcagctgctgttcatcatcagacacagattcaacgagggcgtgcaccccgccttcgccctggagaagcccggcaagtgcaccctgcacctgggcatcgagccccccgacagcgtgagacacaagtag

SEQ ID NO: 75493 - DNA, 678 bp, Artificial Sequence
  Description of Artificial Sequence: Synthetic coding sequence
atggacctgagagccggcgacagctggggcatgctggcctgcctgtgcaccgtgctgtggcacctgcccgccgtgcccgccctgaacagaaccggcgaccccggccccggccccagcatccagaagacctacgacctgaccagatacctggagcaccagctgagaagcctggccggcacctacctgaactacctgggcccccccttcaacgagcccgacttcaacccccccagactgggcgccgagaccctgcccagagccaccgtggacctggaggtgtggagaagcctgaacgacaagctgagactgacccagaactacgaggcctacagccacctgctgtgctacctgagaggcctgaacagacaggccgccaccgccgagctgagaagaagcctggcccacttctgcaccagcctgcagggcctgctgggcagcatcgccggcgtgatggccgccctgggctaccccctgccccagcccctgcccggcaccgagcccacctggacccccggccccgcccacagcgacttcctgcagaagatggacgacttctggctgctgaaggagctgcagacctggctgtggagaagcgccaaggacttcaacagactgaagaagaagatgcagccccccgccgccgccgtgaccctgcacctgggcgcccacggcttctag

SEQ ID NO: 75494 - DNA, 648 bp, Artificial Sequence
  Description of Artificial Sequence: Synthetic coding sequence
atgctggcctgcctgtgcaccgtgctgtggcacctgcccgccgtgcccgccctgaacagaaccggcgaccccggccccggccccagcatccagaagacctacgacctgaccagatacctggagcaccagctgagaagcctggccggcacctacctgaactacctgggcccccccttcaacgagcccgacttcaacccccccagactgggcgccgagaccctgcccagagccaccgtggacctggaggtgtggagaagcctgaacgacaagctgagactgacccagaactacgaggcctacagccacctgctgtgctacctgagaggcctgaacagacaggccgccaccgccgagctgagaagaagcctggcccacttctgcaccagcctgcagggcctgctgggcagcatcgccggcgtgatggccgccctgggctaccccctgccccagcccctgcccggcaccgagcccacctggacccccggccccgcccacagcgacttcctgcagaagatggacgacttctggctgctgaaggagctgcagacctggctgtggagaagcgccaaggacttcaacagactgaagaagaagatgcagccccccgccgccgccgtgaccctgcacctgggcgcccacggcttctag

SEQ ID NO: 75495 - DNA, 648 bp, Artificial Sequence; identical to SEQ ID NO: 75494
  Description of Artificial Sequence: Synthetic coding sequence

SEQ ID NO: 75496 - DNA, 1881 bp, Artificial Sequence
  Description of Artificial Sequence: Synthetic coding sequence
atgctggccttcgccgccagaaccgtggtgaagcccctgggcttcctgaagcccttcagcctgatgaaggccagcagcagattcaaggcccaccaggacgccctgcccagactgcccgtgccccccctgcagcagagcctggaccactacctgaaggccctgcagcccatcgtgagcgaggaggagtgggcccacaccaagcagctggtggacgagttccaggccagcggcggcgtgggcgagagactgcagaagggcctggagagaagagccagaaagaccgagaactggctgagcgagtggtggctgaagaccgcctacctgcagtacagacagcccgtggtgatctacagcagccccggcgtgatgctgcccaagcaggacttcgtggacctgcagggccagctgagattcgccgccaagctgatcgagggcgtgctggacttcaaggtgatgatcgacaacgagaccctgcccgtggagtacctgggcggcaagcccctgtgcatgaaccagtactaccagatcctgagcagctgcagagtgcccggccccaagcaggacaccgtgagcaacttcagcaagaccaagaagccccccacccacatcaccgtggtgcacaactaccagttcttcgagctggacgtgtaccacagcgacggcacccccctgaccgccgaccagatcttcgtgcagctggagaagatctggaacagcagcctgcagaccaacaaggagcccgtgggcatcctgaccagcaaccacagaaacagctgggccaaggcctacaacaccctgatcaaggacaaggtgaacagagacagcgtgagaagcatccagaagagcatcttcaccgtgtgcctggacgccaccatgcccagagtgagcgaggacgtgtacagaagccacgtggccggccagatgctgcacggcggcggcagcagactgaacagcggcaacagatggttcgacaagaccctgcagttcatcgtggccgaggacggcagctgcggcctggtgtacgagcacgccgccgccgagggcccccccatcgtgaccctgctggactacgtgatcgagtacaccaagaagcccgagctggtgagaagccccctggtgcccctgcccatgcccaagaagctgagattcaacatcacccccgagatcaagagcgacatcgagaaggccaagcagaacctgagcatcatgatccaggacctggacatcaccgtgatggtgttccaccacttcggcaaggacttccccaagagcgagaagctgagccccgacgccttcatccagatggccctgcagctggcctactacagaatctacggccaggcctgcgccacctacgagagcgccagcctgagaatgttccacctgggcagaaccgacaccatcagaagcgccagcatggacagcctgaccttcgtgaaggccatggacgacagcagcgtgaccgagcaccagaaggtggagctgctgagaaaggccgtgcaggcccacagaggctacaccgacagagccatcagaggcgaggccttcgacagacacctgctgggcctgaagctgcaggccatcgaggacctggtgagcatgcccgacatcttcatggacaccagctacgccatcgccatgcacttccacctgagcaccagccaggtgcccgccaagaccgactgcgtgatgttcttcggccccgtggtgcccgacggctacggcgtgtgctacaaccccatggaggcccacatcaacttcagcctgagcgcctacaacagctgcgccgagaccaacgccgccagactggcccactacctggagaaggccctgctggacatgagagccctgctgcagagccaccccagagccaagctgtag

SEQ ID NO: 75497 - DNA, 1638 bp, Artificial Sequence
  Description of Artificial Sequence: Synthetic coding sequence
atgctggccttcgccgccagaaccgtggtgaagcccctgggcttcctgaagcccttcagcctgatgaaggccagcagcagattcaaggcccaccaggacgccctgcccagactgcccgtgccccccctgcagcagagcctggaccactacctgaaggccctgcagcccatcgtgagcgaggaggagtgggcccacaccaagcagctggtggacgagttccaggccagcggcggcgtgggcgagagactgcagaagggcctggagagaagagccagaaagaccgagaactggctgagcgagtggtggctgaagaccgcctacctgcagtacagacagcccgtggtgatctacagcagccccggcgtgatgctgcccaagcaggacttcgtggacctgcagggccagctgagattcgccgccaagctgatcgagggcgtgctggacttcaaggtgatgatcgacaacgagaccctgcccgtggagtacctgggcggcaagcccctgtgcatgaaccagtactaccagatcctgagcagctgcagagtgcccggccccaagcaggacaccgtgagcaacttcagcaagaccaagaagccccccacccacatcaccgtggtgcacaactaccagttcttcgagctggacgtgtaccacagcgacggcacccccctgaccgccgaccagatcttcgtgcagctggagaagatctggaacagcagcctgcagaccaacaaggagcccgtgggcatcctgaccagcaaccacagaaacagctgggccaaggcctacaacaccctgatcaaggacaaggtgaacagagacagcgtgagaagcatccagaagaagaagcccgagctggtgagaagccccctggtgcccctgcccatgcccaagaagctgagattcaacatcacccccgagatcaagagcgacatcgagaaggccaagcagaacctgagcatcatgatccaggacctggacatcaccgtgatggtgttccaccacttcggcaaggacttccccaagagcgagaagctgagccccgacgccttcatccagatggccctgcagctggcctactacagaatctacggccaggcctgcgccacctacgagagcgccagcctgagaatgttccacctgggcagaaccgacaccatcagaagcgccagcatggacagcctgaccttcgtgaaggccatggacgacagcagcgtgaccgagcaccagaaggtggagctgctgagaaaggccgtgcaggcccacagaggctacaccgacagagccatcagaggcgaggccttcgacagacacctgctgggcctgaagctgcaggccatcgaggacctggtgagcatgcccgacatcttcatggacaccagctacgccatcgccatgcacttccacctgagcaccagccaggtgcccgccaagaccgactgcgtgatgttcttcggccccgtggtgcccgacggctacggcgtgtgctacaaccccatggaggcccacatcaacttcagcctgagcgcctacaacagctgcgccgagaccaacgccgccagactggcccactacctggagaaggccctgctggacatgagagccctgctgcagagccaccccagagccaagctgtag

SEQ ID NO: 75498 - DNA, 2322 bp, Artificial Sequence
  Description of Artificial Sequence: Synthetic coding sequence
atggccgaggcccaccaggccgtggccttccagttcaccgtgacccccgacggcatcgacctgagactgagccacgaggccctgagacagatctacctgagcggcctgcacagctggaagaagaagttcatcagattcaagaacggcatcatcaccggcgtgtaccccgccagccccagcagctggctgatcgtggtggtgggcgtgatgaccaccatgtacgccaagatcgaccccagcctgggcatcatcgccaagatcaacagaaccctggagaccgccaactgcatgagcagccagaccaagaacgtggtgagcggcgtgctgttcggcaccggcctgtgggtggccctgatcgtgaccatgagatacagcctgaaggtgctgctgagctaccacggctggatgttcaccgagcacggcaagatgagcagagccaccaagatctggatgggcatggtgaagatcttcagcggcagaaagcccatgctgtacagcttccagaccagcctgcccagactgcccgtgcccgccgtgaaggacaccgtgaacagatacctgcagagcgtgagacccctgatgaaggaggaggacttcaagagaatgaccgccctggcccaggacttcgccgtgggcctgggccccagactgcagtggtacctgaagctgaagagctggtgggccaccaactacgtgagcgactggtgggaggagtacatctacctgagaggcagaggccccctgatggtgaacagcaactactacgccatggacctgctgtacatcctgcccacccacatccaggccgccagagccggcaacgccatccacgccatcctgctgtacagaagaaagctggacagagaggagatcaagcccatcagactgctgggcagcaccatccccctgtgcagcgcccagtgggagagaatgttcaacaccagcagaatccccggcgaggagaccgacaccatccagcacatgagagacagcaagcacatcgtggtgtaccacagaggcagatacttcaaggtgtggctgtaccacgacggcagactgctgaagcccagagagatggagcagcagatgcagagaatcctggacaacaccagcgagccccagcccggcgaggccagactggccgccctgaccgccggcgacagagtgccctgggccagatgcagacaggcctacttcggcagaggcaagaacaagcagagcctggacgccgtggagaaggccgccttcttcgtgaccctggacgagaccgaggagggctacagaagcgaggaccccgacaccagcatggacagctacgccaagagcctgctgcacggcagatgctacgacagatggttcgacaagagcttcaccttcgtggtgttcaagaacggcaagatgggcctgaacgccgagcacagctgggccgacgcccccatcgtggcccacctgtgggagtacgtgatgagcatcgacagcctgcagctgggctacgccgaggacggccactgcaagggcgacatcaaccccaacatcccctaccccaccagactgcagtgggacatccccggcgagtgccaggaggtgatcgagaccagcctgaacaccgccaacctgctggccaacgacgtggacttccacagcttccccttcgtggccttcggcaagggcatcatcaagaagtgcagaaccagccccgacgccttcgtgcagctggccctgcagctggcccactacaaggacatgggcaagttctgcctgacctacgaggccagcatgaccagactgttcagagagggcagaaccgagaccgtgagaagctgcaccaccgagagctgcgacttcgtgagagccatggtggaccccgcccagaccgtggagcagagactgaagctgttcaagctggccagcgagaagcaccagcacatgtacagactggccatgaccggcagcggcatcgacagacacctgttctgcctgtacgtggtgagcaagtacctggccgtggagagccccttcctgaaggaggtgctgagcgagccctggagactgagcaccagccagaccccccagcagcaggtggagctgttcgacctggagaacaaccccgagtacgtgagcagcggcggcggcttcggccccgtggccgacgacggctacggcgtgagctacatcctggtgggcgagaacctgatcaacttccacatcagcagcaagttcagctgccccgagaccgacagccacagattcggcagacacctgaaggaggccatgaccgacatcatcaccctgttcggcctgagcagcaacagcaagaagtag

SEQ ID NO: 75499 - DNA, 2271 bp, Artificial Sequence
  Description of Artificial Sequence: Synthetic coding sequence
atggccgaggcccaccaggccgtggccttccagttcaccgtgacccccgacggcatcgacctgagactgagccacgaggccctgagacagatctacctgagcggcctgcacagctggaagaagaagttcatcagattcaagaacggcatcatcaccggcgtgtaccccgccagccccagcagctggctgatcgtggtggtgggcgtgatgaccaccatgtacgccaagatcgaccccagcctgggcatcatcgccaagatcaacagaaccctggagaccgccaactgcatgagcagccagaccaagaacgtggtgagcggcgtgctgttcggcaccggcctgtgggtggccctgatcgtgaccatgagatacagcctgaaggtgctgctgagctaccacggctggatgttcaccgagcacggcaagatgagcagagccaccaagatctggatgggcatggtgaagatcttcagcggcagaaagcccatgctgtacagcttccagaccagcctgcccagactgcccgtgcccgccgtgaaggacaccgtgaacagatacctgcagagcgtgagacccctgatgaaggaggaggacttcaagagaatgaccgccctggcccaggacttcgccgtgggcctgggccccagactgcagtggtacctgaagctgaagagctggtgggccaccaactacgtgagcgactggtgggaggagtacatctacctgagaggcagaggccccctgatggtgaacagcaactactacgccatggacctgctgtacatcctgcccacccacatccaggccgccagagccggcaacgccatccacgccatcctgctgtacagaagaaagctggacagagaggagatcaagcccatcagactgctgggcagcaccatccccctgtgcagcgcccagtgggagagaatgttcaacaccagcagaatccccggcgaggagaccgacaccatccagcacatgagagacagcaagcacatcgtggtgtaccacagaggcagatacttcaaggtgtggctgtaccacgacggcagactgctgaagcccagagagatggagcagcagatgcagagaatcctggacaacaccagcgagccccagcccggcgaggccagactggccgccctgaccgccggcgacagagtgccctgggccagatgcagacaggcctacttcggcagaggcaagaacaagcagagcctggacgccgtggagaaggccgccttcttcgtgaccctggacgagaccgaggagggctacagaagcgaggaccccgacaccagcatggacagctacgccaagagcctgctgcacggcagatgctacgacagatggttcgacaagagcttcaccttcgtggtgttcaagaacggcaagatgggcctgaacgccgagcacagctgggccgacgcccccatcgtggcccacctgtgggagtacgtgatgagcatcgacagcctgcagctgggctacgccgaggacggccactgcaagggcgacatcaaccccaacatcccctaccccaccagactgcagtgggacatccccggcgagtgccaggaggtgatcgagaccagcctgaacaccgccaacctgctggccaacgacgtggacttccacagcttccccttcgtggccttcggcaagggcatcatcaagaagtgcagaaccagccccgacgccttcgtgcagctggccctgcagctggcccactacaaggacatgggcaagttctgcctgacctacgaggccagcatgaccagactgttcagagagggcagaaccgagaccgtgagaagctgcaccaccgagagctgcgacttcgtgagagccatggtggaccccgcccagaccgtggagcagagactgaagctgttcaagctggccagcgagaagcaccagcacatgtacagactggccatgaccggcagcggcatcgacagacacctgttctgcctgtacgtggtgagcaagtacctggccgtggagagccccttcctgaaggaggtgctgagcgagccctggagactgagcaccagccagaccccccagcagcaggtggagctgttcgacctggagaacaaccccgagtacgtgagcagcggcggcggcttcggccccgtggccgacgacggctacggcgtgagctacatcctggtgggcgagaacctgatcaacttccacatcagcagcaagttcagctgccccgagaccggcatcatcagccagggccccagcagcgacacctag

SEQ ID NO: 75500 - DNA, 2322 bp, Artificial Sequence; identical to SEQ ID NO: 75498
  Description of Artificial Sequence: Synthetic coding sequence

SEQ ID NO: 75501 - DNA, 2322 bp, Artificial Sequence; identical to SEQ ID NO: 75498
  Description of Artificial Sequence: Synthetic coding sequence

SEQ ID NO: 75502 - DNA, 2271 bp, Artificial Sequence; identical to SEQ ID NO: 75499
  Description of Artificial Sequence: Synthetic coding sequence

SEQ ID NO: 75503 - DNA, 2319 bp, Artificial Sequence
  Description of Artificial Sequence: Synthetic coding sequence
atggccgaggcccaccaggccgtggccttccagttcaccgtgacccccgacggcgtggacttcagactgagcagagaggccctgaagcacgtgtacctgagcggcatcaacagctggaagaagagactgatcagaatcaagaacggcatcctgagaggcgtgtaccccggcagccccaccagctggctggtggtgatcatggccaccgtgggcagcagcttctgcaacgtggacatcagcctgggcctggtgagctgcatccagagatgcctgccccagggctgcggcccctaccagaccccccagaccagagccctgctgagcatggccatcttcagcaccggcgtgtgggtgaccggcatcttcttcttcagacagaccctgaagctgctgctgtgctaccacggctggatgttcgagatgcacggcaagaccagcaacctgaccagaatctgggccatgtgcatcagactgctgagcagcagacaccccatgctgtacagcttccagaccagcctgcccaagctgcccgtgcccagagtgagcgccaccatccagagatacctggagagcgtgagacccctgctggacgacgaggagtactacagaatggagctgctggccaaggagttccaggacaagaccgcccccagactgcagaagtacctggtgctgaagagctggtgggccagcaactacgtgagcgactggtgggaggagtacatctacctgagaggcagaagccccctgatggtgaacagcaactactacgtgatggacctggtgctgatcaagaacaccgacgtgcaggccgccagactgggcaacatcatccacgccatgatcatgtacagaagaaagctggacagagaggagatcaagcccgtgatggccctgggcatcgtgcccatgtgcagctaccagatggagagaatgttcaacaccaccagaatccccggcaaggacaccgacgtgctgcagcacctgagcgacagcagacacgtggccgtgtaccacaagggcagattcttcaagctgtggctgtacgagggcgccagactgctgaagccccaggacctggagatgcagttccagagaatcctggacgaccccagccccccccagcccggcgaggagaagctggccgccctgaccgccggcggcagagtggagtgggcccaggccagacaggccttcttcagcagcggcaagaacaaggccgccctggaggccatcgagagagccgccttcttcgtggccctggacgaggagagctacagctacgaccccgaggacgaggccagcctgagcctgtacggcaaggccctgctgcacggcaactgctacaacagatggttcgacaagagcttcaccctgatcagcttcaagaacggccagctgggcctgaacgccgagcacgcctgggccgacgcccccatcatcggccacctgtgggagttcgtgctgggcaccgacagcttccacctgggctacaccgagaccggccactgcctgggcaagcccaaccccgccctggccccccccaccagactgcagtgggacatccccaagcagtgccaggccgtgatcgagagcagctaccaggtggccaaggccctggccgacgacgtggagctgtactgcttccagttcctgcccttcggcaagggcctgatcaagaagtgcagaaccagccccgacgccttcgtgcagatcgccctgcagctggcccacttcagagacagaggcaagttctgcctgacctacgaggccagcatgaccagaatgttcagagagggcagaaccgagaccgtgagaagctgcaccagcgagagcaccgccttcgtgcaggccatgatggagggcagccacaccaaggccgacctgagagacctgttccagaaggccgccaagaagcaccagaacatgtacagactggccatgaccggcgccggcatcgacagacacctgttctgcctgtacctggtgagcaagtacctgggcgtgagcagccccttcctggccgaggtgctgagcgagccctggagactgagcaccagccagatcccccagagccagatcagaatgttcgaccccgagcagcaccccaaccacctgggcgccggcggcggcttcggccccgtggccgacgacggctacggcgtgagctacatgatcgccggcgagaacaccatcttcttccacatcagcagcaagttcagcagcagcgagaccaacgcccagagattcggcaaccacatcagaaaggccctgctggacatcgccgacctgttccaggtgcccaaggcctacagctag

SEQ ID NO: 75504 - DNA, 2319 bp, Artificial Sequence; identical to SEQ ID NO: 75503
  Description of Artificial Sequence: Synthetic coding sequence

SEQ ID NO: 75505 - DNA, 2319 bp, Artificial Sequence; identical to SEQ ID NO: 75503
  Description of Artificial Sequence: Synthetic coding sequence

SEQ ID NO: 75506 - DNA, 2319 bp, Artificial Sequence; identical to SEQ ID NO: 75503
  Description of Artificial Sequence: Synthetic coding sequence

SEQ ID NO: 75507 - DNA, 378 bp, Artificial Sequence
  Description of Artificial Sequence: Synthetic coding sequence
atggccgaggcccaccaggccgtggccttccagttcaccgtgacccccgacggcgtggacttcagactgagcagagaggccctgaagcacgtgtacctgagcggcatcaacagctggaagaagagactgatcagaatcaagaacggcatcctgagaggcgtgtaccccggcagccccaccagctggctggtggtgatcatggccaccgtgggcagcagcttctgcaacgtggacatcagcctgggcctggtgagctgcatccagagatgcctgccccagggctgcggcccctaccagaccccccagaccagagccctgctgagcatggccatcttcagcaccggcgtgtgggtgaccggcatcttcttcttcagatag

SEQ ID NO: 75508 - DNA, 1704 bp, Artificial Sequence
  Description of Artificial Sequence: Synthetic coding sequence
atggagctgctggccaaggagttccaggacaagaccgcccccagactgcagaagtacctggtgctgaagagctggtgggccagcaactacgtgagcgactggtgggaggagtacatctacctgagaggcagaagccccctgatggtgaacagcaactactacgtgatggacctggtgctgatcaagaacaccgacgtgcaggccgccagactgggcaacatcatccacgccatgatcatgtacagaagaaagctggacagagaggagatcaagcccgtgatggccctgggcatcgtgcccatgtgcagctaccagatggagagaatgttcaacaccaccagaatccccggcaaggacaccgacgtgctgcagcacctgagcgacagcagacacgtggccgtgtaccacaagggcagattcttcaagctgtggctgtacgagggcgccagactgctgaagccccaggacctggagatgcagttccagagaatcctggacgaccccagccccccccagcccggcgaggagaagctggccgccctgaccgccggcggcagagtggagtgggcccaggccagacaggccttcttcagcagcggcaagaacaaggccgccctggaggccatcgagagagccgccttcttcgtggccctggacgaggagagctacagctacgaccccgaggacgaggccagcctgagcctgtacggcaaggccctgctgcacggcaactgctacaacagatggttcgacaagagcttcaccctgatcagcttcaagaacggccagctgggcctgaacgccgagcacgcctgggccgacgcccccatcatcggccacctgtgggagttcgtgctgggcaccgacagcttccacctgggctacaccgagaccggccactgcctgggcaagcccaaccccgccctggccccccccaccagactgcagtgggacatccccaagcaggccgtgatcgagagcagctaccaggtggccaaggccctggccgacgacgtggagctgtactgcttccagttcctgcccttcggcaagggcctgatcaagaagtgcagaaccagccccgacgccttcgtgcagatcgccctgcagctggcccacttcagagacagaggcaagttctgcctgacctacgaggccagcatgaccagaatgttcagagagggcagaaccgagaccgtgagaagctgcaccagcgagagcaccgccttcgtgcaggccatgatggagggcagccacaccaaggccgacctgagagacctgttccagaaggccgccaagaagcaccagaacatgtacagactggccatgaccggcgccggcatcgacagacacctgttctgcctgtacctggtgagcaagtacctgggcgtgagcagccccttcctggccgaggtgctgagcgagccctggagactgagcaccagccagatcccccagagccagatcagaatgttcgaccccgagcagcaccccaaccacctgggcgccggcggcggcttcggccccgtggccgacgacggctacggcgtgagctacatgatcgccggcgagaacaccatcttcttccacatcagcagcaagttcagcagcagcgagaccaacgcccagagattcggcaaccacatcagaaaggccctgctggacatcgccgacctgttccaggtgcccaaggcctacagctag

SEQ ID NO: 75509 - DNA, 2076 bp, Artificial Sequence
  Description of Artificial Sequence: Synthetic coding sequence
atggccgaggcccaccaggccgtggccttccagttcaccgtgacccccgacggcgtggacttcagactgagcagagaggccctgaagcacgtgtacctgagcggcatcaacagctggaagaagagactgatcagaatcaagaacggcatcctgagaggcgtgtaccccggcagccccaccagctggctggtggtgatcatggccaccgtgggcagcagcttctgcaacgtggacatcagcctgggcctggtgagctgcatccagagatgcctgccccagggctgcggcccctaccagaccccccagaccagagccctgctgagcatggccatcttcagcaccggcgtgtgggtgaccggcatcttcttcttcagacagaccctgaagctgctgctgtgctaccacggctggatgttcgagatgcacggcaagaccagcaacctgaccagaatctgggccatgtgcatcagactgctgagcagcagacaccccatgctgtacagcttccagaccagcctgcccaagctgcccgtgcccagagtgagcgccaccatccagagatacctggagagcgtgagacccctgctggacgacgaggagtactacagaatggagctgctggccaaggagttccaggacaagaccgcccccagactgcagaagtacctggtgctgaagagctggtgggccagcaactacgtgagcgactggtgggaggagtacatctacctgagaggcagaagccccctgatggtgaacagcaactactacgtgatggacctggtgctgatcaagaacaccgacgtgcaggccgccagactgggcaacatcatccacgccatgatcatgtacagaagaaagctggacagagaggagatcaagcccgtgatggccctgggcatcgtgcccatgtgcagctaccagatggagagaatgttcaacaccaccagaatccccggcaaggacaccgacgtgctgcagcacctgagcgacagcagacacgtggccgtgtaccacaagggcagattcttcaagctgtggctgtacgagggcgccagactgctgagcctgtacggcaaggccctgctgcacggcaactgctacaacagatggttcgacaagagcttcaccctgatcagcttcaagaacggccagctgggcctgaacgccgagcacgcctgggccgacgcccccatcatcggccacctgtgggagttcgtgctgggcaccgacagcttccacctgggctacaccgagaccggccactgcctgggcaagcccaaccccgccctggccccccccaccagactgcagtgggacatccccaagcagtgccaggccgtgatcgagagcagctaccaggtggccaaggccctggccgacgacgtggagctgtactgcttccagttcctgcccttcggcaagggcctgatcaagaagtgcagaaccagccccgacgccttcgtgcagatcgccctgcagctggcccacttcagagacagaggcaagttctgcctgacctacgaggccagcatgaccagaatgttcagagagggcagaaccgagaccgtgagaagctgcaccagcgagagcaccgccttcgtgcaggccatgatggagggcagccacaccaaggccgacctgagagacctgttccagaaggccgccaagaagcaccagaacatgtacagactggccatgaccggcgccggcatcgacagacacctgttctgcctgtacctggtgagcaagtacctgggcgtgagcagccccttcctggccgaggtgctgagcgagccctggagactgagcaccagccagatcccccagagccagatcagaatgttcgaccccgagcagcaccccaaccacctgggcgccggcggcggcttcggccccgtggccgacgacggctacggcgtgagctacatgatcgccggcgagaacaccatcttcttccacatcagcagcaagttcagcagcagcgagaccaacgcccagagattcggcaaccacatcagaaaggccctgctggacatcgccgacctgttccaggtgcccaaggcctacagctag

SEQ ID NO: 75510 - DNA, 2217 bp, Artificial Sequence
  Description of Artificial Sequence: Synthetic coding sequence
atggccgaggcccaccaggccgtggccttccagttcaccgtgacccccgacggcgtggacttcagactgagcagagaggccctgaagcacgtgtacctgagcggcatcaacagctggaagaagagactgatcagaatcaagaacggcatcctgagaggcgtgtaccccggcagccccaccagctggctggtggtgatcatggccaccgtgggcagcagcttctgcaacgtggacatcagcctgggcctggtgagctgcatccagagatgcctgccccagggctgcggcccctaccagaccccccagaccagagccctgctgagcatggccatcttcagcaccggcgtgtgggtgaccggcatcttcttcttcagacagaccctgaagctgctgctgtgctaccacggctggatgttcgagatgcacggcaagaccagcaacctgaccagaatctgggcctacctggagagcgtgagacccctgctggacgacgaggagtactacagaatggagctgctggccaaggagttccaggacaagaccgcccccagactgcagaagtacctggtgctgaagagctggtgggccagcaactacgtgagcgactggtgggaggagtacatctacctgagaggcagaagccccctgatggtgaacagcaactactacgtgatggacctggtgctgatcaagaacaccgacgtgcaggccgccagactgggcaacatcatccacgccatgatcatgtacagaagaaagctggacagagaggagatcaagcccgtgatggccctgggcatcgtgcccatgtgcagctaccagatggagagaatgttcaacaccaccagaatccccggcaaggacaccgacgtgctgcagcacctgagcgacagcagacacgtggccgtgtaccacaagggcagattcttcaagctgtggctgtacgagggcgccagactgctgaagccccaggacctggagatgcagttccagagaatcctggacgaccccagccccccccagcccggcgaggagaagctggccgccctgaccgccggcggcagagtggagtgggcccaggccagacaggccttcttcagcagcggcaagaacaaggccgccctggaggccatcgagagagccgccttcttcgtggccctggacgaggagagctacagctacgaccccgaggacgaggccagcctgagcctgtacggcaaggccctgctgcacggcaactgctacaacagatggttcgacaagagcttcaccctgatcagcttcaagaacggccagctgggcctgaacgccgagcacgcctgggccgacgcccccatcatcggccacctgtgggagttcgtgctgggcaccgacagcttccacctgggctacaccgagaccggccactgcctgggcaagcccaaccccgccctggccccccccaccagactgcagtgggacatccccaagcagtgccaggccgtgatcgagagcagctaccaggtggccaaggccctggccgacgacgtggagctgtactgcttccagttcctgcccttcggcaagggcctgatcaagaagtgcagaaccagccccgacgccttcgtgcagatcgccctgcagctggcccacttcagagacagaggcaagttctgcctgacctacgaggccagcatgaccagaatgttcagagagggcagaaccgagaccgtgagaagctgcaccagcgagagcaccgccttcgtgcaggccatgatggagggcagccacaccaaggccgacctgagagacctgttccagaaggccgccaagaagcaccagaacatgtacagactggccatgaccggcgccggcatcgacagacacctgttctgcctgtacctggtgagcaagtacctgggcgtgagcagccccttcctggccgaggtgctgagcgagccctggagactgagcaccagccagatcccccagagccagatcagaatgttcgaccccgagcagcaccccaaccacctgggcgccggcggcggcttcggccccgtggccgacgacggctacggcgtgagctacatgatcgccggcgagaacaccatcttcttccacatcagcagcaagttcagcagcagcgagaccaacgcccagagattcggcaaccacatcagaaaggccctgctggacatcgccgacctgttccaggtgcccaaggcctacagctag

SEQ ID NO: 75511 - DNA, 1458 bp, Artificial Sequence
  Description of Artificial Sequence: Synthetic coding sequence
atgctgttcagctaccagagaagcctgcccagacagcccgtgcccagcgtgcaggacaccgtgagaaagtacctggagagcgtgagacccatcctgagcgacgaggacttcgactggaccgccgtgctggcccaggagttcctgagactgcaggccagcctgctgcagtggtacctgagactgaagagctggtgggccagcaactacgtgagcgactggtgggaggagttcgtgtacctgagaagcagaaaccccctgatggtgaacagcaactactacatgatggacttcctgtacgtgacccccacccccctgcaggccgccagagccggcaacgccgtgcacgccctgctgctgtacagacacagactgaacagacaggagatcccccccgtgagaggcccccagtgggtgagagacggcggcgtggtgctgtggcccctgggccacgtgggccccggcagacagctgaccgcccacggcttcctgcagaccctgctgatgggcatgagacccctgtgcagcgcccagtacgagaagatcttcaacaccaccagaatccccggcgtgcagaaggactacatcagacacctgcacgacagccagcacgtggccgtgttccacagaggcagattcttcagaatgggcacccacagcagaaacagcctgctgagccccagagccctggagcagcagttccagagaatcctggacgaccccagccccgcctgcccccacgaggagcacctggccgccctgaccgccgcccccagaggcacctgggcccaggtgagaaccagcctgaagacccaggccgccgaggccctggaggccgtggagggcgccgccttcttcgtgagcctggacgccgagcccgccggcctgaccagagaggaccccgccgccagcctggacgcctacgcccacgccctgctggccggcagaggccacgacagatggttcgacaagagcttcaccctgatcgtgttcagcaacggcaagctgggcctgagcgtggagcacagctgggccgactgccccatcagcggccacatgtgggagttcaccctggccaccgagtgcttccagctgggctacagcaccgacggccactgcaagggccaccccgaccccaccctgccccagccccagagactgcagtgggacctgcccgaccagatccacagcagcatcagcctggccctgagaggcgccaagatcctgagcgagaacgtggactgccacgtggtgcccttcagcctgttcggcaagagcttcatcagaagatgccacctgagcagcgacagcttcatccagatcgccctgcagctggcccacttcagagtgagctgggtgccccacccccagcccccccagggcctgagcccccccgagccccccagacccgccccccccagattcctggtggtggccgccatcgtgggcagacccagctag

SEQ ID NO: 75512 - DNA, 2412 bp, Artificial Sequence
  Description of Artificial Sequence: Synthetic coding sequence
atggccgaggcccaccaggccgtgggcttcagacccagcctgaccagcgacggcgccgaggtggagctgagcgcccccgtgctgcaggagatctacctgagcggcctgagaagctggaagagacacctgagcagattctggaacgacttcctgaccggcgtgttccccgccagccccctgagctggctgttcctgttcagcgccatccagctggcctggttcctgcagctggaccccagcctgggcctgatggagaagatcaaggagctgctgcccgactggggcggccagcaccacggcctgagaggcgtgctggccgccgccctgttcgccagctgcctgtggggcgccctgatcttcaccctgcacgtggccctgagactgctgctgagctaccacggctggctgctggagccccacggcgccatgagcagccccaccaagacctggctggccctggtgagaatcttcagcggcagacaccccatgctgttcagctaccagagaagcctgcccagacagcccgtgcccagcgtgcaggacaccgtgagaaagtacctggagagcgtgagacccatcctgagcgacgaggacttcgactggaccgccgtgctggcccaggagttcctgagactgcaggccagcctgctgcagtggtacctgagactgaagagctggtgggccagcaactacgtgagcgactggtgggaggagttcgtgtacctgagaagcagaaaccccctgatggtgaacagcaactactacatgatggacttcctgtacgtgacccccacccccctgcaggccgccagagccggcaacgccgtgcacgccctgctgctgtacagacacagactgaacagacaggagatcccccccaccctgctgatgggcatgagacccctgtgcagcgcccagtacgagaagatcttcaacaccaccagaatccccggcgtgcagaaggactacatcagacacctgcacgacagccagcacgtggccgtgttccacagaggcagattcttcagaatgggcacccacagcagaaacagcctgctgagccccagagccctggagcagcagttccagagaatcctggacgaccccagccccgcctgcccccacgaggagcacctggccgccctgaccgccgcccccagaggcacctgggcccaggtgagaaccagcctgaagacccaggccgccgaggccctggaggccgtggagggcgccgccttcttcgtgagcctggacgccgagcccgccggcctgaccagagaggaccccgccgccagcctggacgcctacgcccacgccctgctggccggcagaggccacgacagatggttcgacaagagcttcaccctgatcgtgttcagcaacggcaagctgggcctgagcgtggagcacagctgggccgactgccccatcagcggccacatgtgggagttcaccctggccaccgagtgcttccagctgggctacagcaccgacggccactgcaagggccaccccgaccccaccctgccccagccccagagactgcagtgggacctgcccgaccagatccacagcagcatcagcctggccctgagaggcgccaagatcctgagcgagaacgtggactgccacgtggtgcccttcagcctgttcggcaagagcttcatcagaagatgccacctgagcagcgacagcttcatccagatcgccctgcagctggcccacttcagagacagaggccagttctgcctgacctacgagagcgccatgaccagactgttcctggagggcagaaccgagaccgtgagaagctgcaccagagaggcctgcaacttcgtgagagccatggaggacaaggagaagaccgacccccagtgcctggccctgttcagagtggccgtggacaagcaccaggccctgctgaaggccgccatgagcggccagggcgtggacagacacctgttcgccctgtacatcgtgagcagattcctgcacctgcagagccccttcctgacccaggtgcacagcgagcagtggcagctgagcaccagccagatccccgtgcagcagatgcacctgttcgacgtgcacaactaccccgactacgtgagcagcggcggcggcttcggccccgccgacgaccacggctacggcgtgagctacatcttcatgggcgacggcatgatcaccttccacatcagcagcaagaagagcagcaccaagaccgacagccacagactgggccagcacatcgaggacgccctgctggacgtggccagcctgttccaggccggccagcacttcaagagaagattcagaggcagcggcaaggagaacagcagacacagatgcggcttcctgagcagacagaccggcgccagcaaggccagcatgaccagcaccgacttctag

SEQ ID NO: 75513 - DNA, 2145 bp, Artificial Sequence
  Description of Artificial Sequence: Synthetic coding sequence
atggccgaggcccaccaggccgtgggcttcagacccagcctgaccagcgacggcgccgaggtggagctgagcgcccccgtgctgcaggagatctacctgagcggcctgagaagctggaagagacacctgagcagattctggaacgacttcctgaccggcgtgttccccgccagccccctgagctggctgttcctgttcagcgccatccagctggcctggttcctgcagctggaccccagcctgggcctgatggagaagatcaaggagctgctgcccgactggggcggccagcaccacggcctgagaggcgtgctggccgccgccctgttcgccagctgcctgtggggcgccctgatcttcaccctgcacgtggccctgagactgctgctgagctaccacggctggctgctggagccccacggcgccatgagcagccccaccaagacctggctggccctggtgagaatcttcagcggcagacaccccatgctgttcagctaccagagaagcctgcccagacagcccgtgcccagcgtgcaggacaccgtgagaaagtacctggagagcgtgagacccatcctgagcgacgaggacttcgactggaccgccgtgctggcccaggagttcctgagactgcaggccagcctgctgcagtggtacctgagactgaagagctggtgggccagcaactacgtgagcgactggtgggaggagttcgtgtacctgagaagcagaaaccccctgatggtgaacagcaactactacatgatggacttcctgtacgtgacccccacccccctgcaggccgccagagccggcaacgccgtgcacgccctgctgctgtacagacacagactgaacagacaggagatcccccccaccctgctgatgggcatgagacccctgtgcagcgcccagtacgagaagatcttcaacaccaccagaatccccggcgtgcagaaggactacatcagacacctgcacgacagccagcacgtggccgtgttccacagaggcagattcttcagaatgggcacccacagcagaaacagcctgctgagccccagagccctggagcagcagttccagagaatcctggacgaccccagccccgcctgcccccacgaggagcacctggccgccctgaccgccgcccccagaggcacctgggcccaggtgagaaccagcctgaagacccaggccgccgaggccctggaggccgtggagggcgccgccttcttcgtgagcctggacgccgagcccgccggcctgaccagagaggaccccgccgccagcctggacgcctacgcccacgccctgctggccggcagaggccacgacagatggttcgacaagagcttcaccctgatcgtgttcagcaacggcaagctgggcctgagcgtggagcacagctgggccgactgccccatcagcggccacatgtgggagttcaccctggccaccgagtgcttccagctgggctacagcaccgacggccactgcaagggccaccccgaccccaccctgccccagccccagagactgcagtgggacctgcccgaccagatccacagcagcatcagcctggccctgagaggcgccaagatcctgagcgagaacgtggactgccacgtggtgcccttcagcctgttcggcaagagcttcatcagaagatgccacctgagcagcgacagcttcatccagatcgccctgcagctggcccacttcagagacagaggccagttctgcctgacctacgagagcgccatgaccagactgttcctggagggcagaaccgagaccgtgagaagctgcaccagagaggcctgcaacttcgtgagagccatggaggacaaggagaagaccgccgacgaccacggctacggcgtgagctacatcttcatgggcgacggcatgatcaccttccacatcagcagcaagaagagcagcaccaagaccgacagccacagactgggccagcacatcgaggacgccctgctggacgtggccagcctgttccaggccggccagcacttcaagagaagattcagaggcagcggcaaggagaacagcagacacagatgcggcttcctgagcagacagaccggcgccagcaaggccagcatgaccagcaccgacttctag

SEQ ID NO: 75514 - DNA, 2412 bp, Artificial Sequence; identical to SEQ ID NO: 75512
  Description of Artificial Sequence: Synthetic coding sequence

SEQ ID NO: 75515 - DNA, 2379 bp, Artificial Sequence
  Description of Artificial Sequence: Synthetic coding sequence
atggccgaggcccaccaggccgtgggcttcagacccagcctgaccagcgacggcgccgaggtggagctgagcgcccccgtgctgcaggagatctacctgagcggcctgagaagctggaagagacacctgagcagattctggaacgacttcctgaccggcgtgttccccgccagccccctgagctggctgttcctgttcagcgccatccagctggcctggttcctgcagctggaccccagcctgggcctgatggagaagatcaaggagctgctgcccgactggggcggccagcaccacggcctgagaggcgtgctggccgccgccctgttcgccagctgcctgtggggcgccctgatcttcaccctgcacgtggccctgagactgctgctgagctaccacggctggctgctggagccccacggcgccatgagcagccccaccaagacctggctggccctggtgagaatcttcagcggcagacaccccatgctgttcagctaccagagaagcctgcccagacagcccgtgcccagcgtgcaggacaccgtgagaaagtacctggagagcgtgagacccatcctgagcgacgaggacttcgactggaccgccgtgctggcccaggagttcctgagactgcaggccagcctgctgcagtggtacctgagactgaagagctggtgggccagcaactacgtgagcgactggtgggaggagttcgtgtacctgagaagcagaaaccccctgatggtgaacagcaactactacatgatggccgccagagccggcaacgccgtgcacgccctgctgctgtacagacacagactgaacagacaggagatcccccccaccctgctgatgggcatgagacccctgtgcagcgcccagtacgagaagatcttcaacaccaccagaatccccggcgtgcagaaggactacatcagacacctgcacgacagccagcacgtggccgtgttccacagaggcagattcttcagaatgggcacccacagcagaaacagcctgctgagccccagagccctggagcagcagttccagagaatcctggacgaccccagccccgcctgcccccacgaggagcacctggccgccctgaccgccgcccccagaggcacctgggcccaggtgagaaccagcctgaagacccaggccgccgaggccctggaggccgtggagggcgccgccttcttcgtgagcctggacgccgagcccgccggcctgaccagagaggaccccgccgccagcctggacgcctacgcccacgccctgctggccggcagaggccacgacagatggttcgacaagagcttcaccctgatcgtgttcagcaacggcaagctgggcctgagcgtggagcacagctgggccgactgccccatcagcggccacatgtgggagttcaccctggccaccgagtgcttccagctgggctacagcaccgacggccactgcaagggccaccccgaccccaccctgccccagccccagagactgcagtgggacctgcccgaccagatccacagcagcatcagcctggccctgagaggcgccaagatcctgagcgagaacgtggactgccacgtggtgcccttcagcctgttcggcaagagcttcatcagaagatgccacctgagcagcgacagcttcatccagatcgccctgcagctggcccacttcagagacagaggccagttctgcctgacctacgagagcgccatgaccagactgttcctggagggcagaaccgagaccgtgagaagctgcaccagagaggcctgcaacttcgtgagagccatggaggacaaggagaagaccgacccccagtgcctggccctgttcagagtggccgtggacaagcaccaggccctgctgaaggccgccatgagcggccagggcgtggacagacacctgttcgccctgtacatcgtgagcagattcctgcacctgcagagccccttcctgacccaggtgcacagcgagcagtggcagctgagcaccagccagatccccgtgcagcagatgcacctgttcgacgtgcacaactaccccgactacgtgagcagcggcggcggcttcggccccgccgacgaccacggctacggcgtgagctacatcttcatgggcgacggcatgatcaccttccacatcagcagcaagaagagcagcaccaagaccgacagccacagactgggccagcacatcgaggacgccctgctggacgtggccagcctgttccaggccggccagcacttcaagagaagattcagaggcagcggcaaggagaacagcagacacagatgcggcttcctgagcagacagaccggcgccagcaaggccagcatgaccagcaccgacttctag

SEQ ID NO: 75516 - DNA, 2412 bp, Artificial Sequence; identical to SEQ ID NO: 75512
  Description of Artificial Sequence: Synthetic coding sequence

SEQ ID NO: 75517 - DNA, 1524 bp, Artificial Sequence
  Description of Artificial Sequence: Synthetic coding sequence
atggaccccaagctgggcagaatggccgccagcctgctggccgtgctgctgctgctgctggagagaggcatgttcagcagccccagccccccccccgccctgctggagaaggtgttccagtacatcgacctgcaccaggacgagttcgtgcagaccctgaaggagtgggtggccatcgagagcgacagcgtgcagcccgtgcccagattcagacaggagctgttcagaatgatggccgtggccgccgacaccctgcagagactgggcgccagagtggccagcgtggacatgggcccccagcagctgcccgacggccagagcctgcccatcccccccatcatcctggccgagctgggcagcgaccccaccaagggcaccgtgtgcttctacggccacctggacgtgcagcccgccgacagaggcgacggctggctgaccgacccctacgtgctgaccgaggtggacggcaagctgtacggcagaggcgccaccgacaacaagggccccgtgctggcctggatcaacgccgtgagcgccttcagagccctggagcaggacctgcccgtgaacatcaagttcatcatcgagggcatggaggaggccggcagcgtggccctggaggagctggtggagaaggagaaggacagattcttcagcggcgtggactacatcgtgatcagcgacaacctgtggatcagccagagaaagcccgccatcacctacggcaccagaggcaacagctacttcatggtggaggtgaagtgcagagaccaggacttccacagcggcaccttcggcggcatcctgcacgagcccatggccgacctggtggccctgctgggcagcctggtggacagcagcggccacatcctggtgcccggcatctacgacgaggtggtgcccctgaccgaggaggagatcaacacctacaaggccatccacctggacctggaggagtacagaaacagcagcagagtggagaagttcctgttcgacaccaaggaggagatcctgatgcacctgtggagataccccagcctgagcatccacggcatcgagggcgccttcgacgagcccggcaccaagaccgtgatccccggcagagtgatcggcaagttcagcatcagactggtgccccacatgaacgtgagcgccgtggagaagcaggtgaccagacacctggaggacgtgttcagcaagagaaacagcagcaacaagatggtggtgagcatgaccctgggcctgcacccctggatcgccaacatcgacgacacccagtacctggccgccaagagagccatcagaaccgtgttcggcaccgagcccgacatgatcagagacggcagcaccatccccatcgccaagatgttccaggagatcgtgcacaagagcgtggtgctgatccccctgggcgccgtggacgacggcgagcacagccagaacgagaagatcaacagatggaactacatcgagggcaccaagctgttcgccgccttcttcctggagatggcccagctgcactag

SEQ ID NO: 75518 - DNA, 2484 bp, Artificial Sequence
  Description of Artificial Sequence: Synthetic coding sequence
atgctgctgtgcctgagccccgcctggctgatgaaggtgcccgcccccggccagcccggcgaggccgccctgctggtgagcaaggccgtgagcttccaccccggcggcctgaccttcctggacgacttcgtgccccccagaagagccacctacttcctggccggcctgggcctgggccccggcagaggcagagaggccgccgagctggccagagacctgacctgccccaccggcgccagcgccgagctggccagactgctggaggacagactgctgaccagacagctgctggcccagcagggcggcgtggccgtgcccgccaccctggccttcacctacaagccccccggcctgctgagaggcggcgacgccagcctgggcctgagactggtggagctgagcggcaaggagggccaggagaccctggtgaaggaggaggtggaggccttcctgagaagcgaggccctgggcgacatcctgcaggtggccgtgaagctgagcggctggagatggagaggcagacaggcctggagactgcaccccagagccgagctgggcgccgtggtggacaccgtgctggccctgctggagaagctggaggaggaggagagcgtgctggtggaggccgtgtacccccccgcccagctgccctgcagcgacggccccagccccggccccggcctggccgtgagaatctgcgccgtggtgtgcagaacccagggcgacagacccctgctgagcaaggtggtgtgcggcgtgggcagaggcgacagacccctgagacaccacaacagcctgcccagaaccctggaggtggccctggcccagtgcggcctgggcgaggaggcccaggtggccgccgtgagacagagagtgaaggccgccgccgaggccgccctggccgccgtgctggccctggaggccggcctgagcgccgagcagagaggcggcagaagagcccacaccgacttcctgggcgtggacttcgccctgaccgccgccggcggcgtgctgacccccgtggccctggagctgaacggcggcctgtgcctggaggcctgcggcgccctggagggcctgtgggccgcccccagactgggccccgccgccgacgaggccgtggccgcccccctggtggagaccatgctgagaagaagcgccagatgcctgatggagggcaagcagctgctggtggtgggcgccggcggcgtgagcaagaagttcgtgtgggaggccgccagagactacggcctgcagctgcacctggtggagagcgaccccaaccacttcgccagccagctggtgcagaccttcatccacttcgacatgaccgagcacagaagagacgaggagaacgccagactgctggccgagctggtgagagccagaggcctgaagctggacggctgcttcagctactgggacgactgcctggtgctgaccgccctgctgtgccaggagctgggcctgccctgcagcagccccgccgccatgagactggccaagcagaagagcctgacccagctgcacctgctgcaccaccacggccccccctggcccgcccccagcctgcacgccgtgccctgctgccccctggagagcgaggccgacgtggagagagccgtgcaccaggtgcccctgcccggcgtgatgaagctggagttcggcgccggcgccgtgggcgtgagactggtggaggacgccccccagtgccacgagcacttcagcagaatcaccagagacctgcagggcgaggccgaccaccccggcatcggcctgggctggggcaacgccatgctgctgatggagttcgtggagggcaccgagcacgacgtggacctggtgctgttcggcggcagactgctggccgccttcgtgagcgacaacggccccaccagactgcccggcttcaccgagaccgccgcctgcatgcccaccggcctggcccccgagcaggaggcccagatggtgcaggccgccttcagatgctgcctgggctgcggcctgctggacggcgtgttcaacgtggagctgaagctgaccggcgccggccccagactgatcgagatcaaccccagaatgggcggcttctacctgagagactggatcctggagctgtacggcgtggacctgctgctggccgccgtgatggtggcctgcggcctgagacccgccctgcccaccagacccagagccagaggccacctggtgggcgtgatgtgcctggtgagccagcacctgcaggccctgagcagcaccgccagcagagagaccctgcaggccctgcacgacagaggcctgctgagactgaacctgctggaggaggccctggtgcccggcgagtacgaggagccctactgcagcgtggcctgcgccggccccagccccaccgaggccagactgagactgctgggcctgtgccagggcctgggcatcgacggccccagctaccccgtggcccacttcctgagccacttcaagtag

SEQ ID NO: 75519 - DNA, 2484 bp, Artificial Sequence; identical to SEQ ID NO: 75518
  Description of Artificial Sequence: Synthetic coding sequence

SEQ ID NO: 75520 - DNA, 2853 bp, Artificial Sequence
  Description of Artificial Sequence: Synthetic coding sequence
atgctgagcctggaccccagcggccccgagtgggactgccccctgggcagcaaggacctggaggaggagggcccctggggcggcggcagcggcctgccccccaccggctgcttccccggcagctggagacaggacgtgggcctggactgcaagggcagccccgagggcgccgaggccagagcctggaccgtgtactactacagcctgctgcagagctgcctgcagcaggccggcctgcccgagacccaggacagaggccaggtgcccagaaccggctgccccggcgccgaggtgaccctgtgcgtgctgggcagccccagcaccttcctgcccgtgctgctggagggcggcgtgcagagccccggcaacatgctgctgtgcctgagccccgcctggctgatgaaggtgcccgcccccggccagcccggcgaggccgccctgctggtgagcaaggccgtgagcttccaccccggcggcctgaccttcctggacgacttcgtgccccccagaagagccacctacttcctggccggcctgggcctgggccccggcagaggcagagaggccgccgagctggccagagacctgacctgccccaccggcgccagcgccgagctggccagactgctggaggacagactgctgaccagacagctgctggcccagcagggcggcgtggccgtgcccgccaccctggccttcacctacaagccccccggcctgctgagaggcggcgacgccagcctgggcctgagactggtggagctgagcggcaaggagggccaggagaccctggtgaaggaggaggtggaggccttcctgagaagcgaggccctgggcgacatcctgcaggtggccgtgaagctgagcggctggagatggagaggcagacaggcctggagactgcaccccagagccgagctgggcgccgtggtggacaccgtgctggccctgctggagaagctggaggaggaggagagcgtgctggtggaggccgtgtacccccccgcccagctgccctgcagcgacggccccagccccggccccggcctggccgtgagaatctgcgccgtggtgtgcagaacccagggcgacagacccctgctgagcaaggtggtgtgcggcgtgggcagaggcgacagacccctgagacaccacaacagcctgcccagaaccctggaggtggccctggcccagtgcggcctgggcgaggaggcccaggtggccgccgtgagacagagagtgaaggccgccgccgaggccgccctggccgccgtgctggccctggaggccggcctgagcgccgagcagagaggcggcagaagagcccacaccgacttcctgggcgtggacttcgccctgaccgccgccggcggcgtgctgacccccgtggccctggagctgaacggcggcctgtgcctggaggcctgcggcgccctggagggcctgtgggccgcccccagactgggccccgccgccgacgaggccgtggccgcccccctggtggagaccatgctgagaagaagcgccagatgcctgatggagggcaagcagctgctggtggtgggcgccggcggcgtgagcaagaagttcgtgtgggaggccgccagagactacggcctgcagctgcacctggtggagagcgaccccaaccacttcgccagccagctggtgcagaccttcatccacttcgacatgaccgagcacagaagagacgaggagaacgccagactgctggccgagctggtgagagccagaggcctgaagctggacggctgcttcagctactgggacgactgcctggtgctgaccgccctgctgtgccaggagctgggcctgccctgcagcagccccgccgccatgagactggccaagcagaagagcctgacccagctgcacctgctgcaccaccacggccccccctggcccgcccccagcctgcacgccgtgccctgctgccccctggagagcgaggccgacgtggagagagccgtgcaccaggtgcccctgcccggcgtgatgaagctggagttcggcgccggcgccgtgggcgtgagactggtggaggacgccccccagtgccacgagcacttcagcagaatcaccagagacctgcagggcgaggccgaccaccccggcatcggcctgggctggggcaacgccatgctgctgatggagttcgtggagggcaccgagcacgacgtggacctggtgctgttcggcggcagactgctggccgccttcgtgagcgacaacggccccaccagactgcccggcttcaccgagaccgccgcctgcatgcccaccggcctggcccccgagcaggaggcccagatggtgcaggccgccttcagatgctgcctgggctgcggcctgctggacggcgtgttcaacgtggagctgaagctgaccggcgccggccccagactgatcgagatcaaccccagaatgggcggcttctacctgagagactggatcctggagctgtacggcgtggacctgctgctggccgccgtgatggtggcctgcggcctgagacccgccctgcccaccagacccagagccagaggccacctggtgggcgtgatgtgcctggtgagccagcacctgcaggccctgagcagcaccgccagcagagagaccctgcaggccctgcacgacagaggcctgctgagactgaacctgctggaggaggccctggtgcccggcgagtacgaggagccctactgcagcgtggcctgcgccggccccagccccaccgaggccagactgagactgctgggcctgtgccagggcctgggcatcgacggccccagctaccccgtggcccacttcctgagccacttcaagtag

SEQ ID NO: 75521 - DNA, 2775 bp, Artificial Sequence
  Description of Artificial Sequence: Synthetic coding sequence
atgctgagcctggaccccagcggccccgagtgggactgccccctgggcagcaaggacctggaggaggagggcccctggggcggcggcagcggcctgccccccaccggctgcttccccggcagctggagacaggacgtgggcctggactgcaagggcagccccgagggcgccgaggccagagcctggaccgtgtactactacagcctgctgcagagctgcctgcagcaggccggcctgcccgagacccaggacagaggccaggtgcccagaaccggctgccccggcgccgaggtgaccctgtgcgtgctgggcagccccagcaccttcctgcccgtgctgctggagggcggcgtgcagagccccggcaacatgctgctgtgcctgagccccgcctggctgatgaaggtgcccgcccccggccagcccggcgaggccgccctgctggtgagcaaggccgtgagcttccaccccggcggcctgaccttcctggacgacttcgtgccccccagaagagccacctacttcctggccggcctgggcctgggccccggcagaggcagagaggccgccgagctggccagagacctgacctgccccaccggcgccagcgccgagctggccagactgctggaggacagactgctgaccagacagctgctggcccagcagggcggcgtggccgtgcccgccaccctggccttcacctacaagccccccggcctgctgagaggcggcgacgccagcctgggcctgagactggtggagctgagcggcaaggagggccaggagaccctggtgaaggaggaggtggaggccttcctgagaagcgaggccctgggcgacatcctgcaggtggccgtgaagctgagcggctggagatggagaggcagacaggcctggagactgcaccccagagccgagctgggcgccgtggtggacaccgtgctggccctgctggagaagctggaggaggaggagagcgtgctggtggaggccgtgtacccccccgcccagctgccctgcagcgacggccccagccccggccccggcctggccgtgagaatctgcgccgtggtgtgcagaacccagggcgacagacccctgctgagcaaggtggtgtgcggcgtgggcagaggcgacagacccctgagacaccacaacagcctgcccagaaccctggaggccgccctggccgccgtgctggccctggaggccggcctgagcgccgagcagagaggcggcagaagagcccacaccgacttcctgggcgtggacttcgccctgaccgccgccggcggcgtgctgacccccgtggccctggagctgaacggcggcctgtgcctggaggcctgcggcgccctggagggcctgtgggccgcccccagactgggccccgccgccgacgaggccgtggccgcccccctggtggagaccatgctgagaagaagcgccagatgcctgatggagggcaagcagctgctggtggtgggcgccggcggcgtgagcaagaagttcgtgtgggaggccgccagagactacggcctgcagctgcacctggtggagagcgaccccaaccacttcgccagccagctggtgcagaccttcatccacttcgacatgaccgagcacagaagagacgaggagaacgccagactgctggccgagctggtgagagccagaggcctgaagctggacggctgcttcagctactgggacgactgcctggtgctgaccgccctgctgtgccaggagctgggcctgccctgcagcagccccgccgccatgagactggccaagcagaagagcctgacccagctgcacctgctgcaccaccacggccccccctggcccgcccccagcctgcacgccgtgccctgctgccccctggagagcgaggccgacgtggagagagccgtgcaccaggtgcccctgcccggcgtgatgaagctggagttcggcgccggcgccgtgggcgtgagactggtggaggacgccccccagtgccacgagcacttcagcagaatcaccagagacctgcagggcgaggccgaccaccccggcatcggcctgggctggggcaacgccatgctgctgatggagttcgtggagggcaccgagcacgacgtggacctggtgctgttcggcggcagactgctggccgccttcgtgagcgacaacggccccaccagactgcccggcttcaccgagaccgccgcctgcatgcccaccggcctggcccccgagcaggaggcccagatggtgcaggccgccttcagatgctgcctgggctgcggcctgctggacggcgtgttcaacgtggagctgaagctgaccggcgccggccccagactgatcgagatcaaccccagaatgggcggcttctacctgagagactggatcctggagctgtacggcgtggacctgctgctggccgccgtgatggtggcctgcggcctgagacccgccctgcccaccagacccagagccagaggccacctggtgggcgtgatgtgcctggtgagccagcacctgcaggccctgagcagcaccgccagcagagagaccctgcaggccctgcacgacagaggcctgctgagactgaacctgctggaggaggccctggtgcccggcgagtacgaggagccctactgcagcgtggcctgcgccggccccagccccaccgaggccagactgagactgctgggcctgtgccagggcctgggcatcgacggccccagctaccccgtggcccacttcctgagccacttcaagtag

SEQ ID NO: 75522 - DNA, 903 bp, Artificial Sequence
  Description of Artificial Sequence: Synthetic coding sequence
atgtgccccctggcccaccccgcccaggacctgcccctgctgcccagccagctgagcctggaccccagcggccccgagtgggactgccccctgggcagcaaggacctggaggaggagggcccctggggcggcggcagcggcctgccccccaccggctgcttccccggcagctggagacaggacgtgggcctggactgcaagggcagccccgagggcgccgaggccagagcctggaccgtgtactactacagcctgctgcagagctgcctgcagcaggccggcctgcccgagacccaggacagaggccaggtgcccagaaccggctgccccggcgccgaggtgaccctgtgcgtgctgggcagccccagcaccttcctgcccgtgctgctggagggcggcgtgcagagccccggcaacatgctgctgtgcctgagccccgcctggctgatgaaggtgcccgcccccggccagcccggcgaggccgccctgctggtgagcaaggccgtgagcttccaccccggcggcctgaccttcctggacgacttcgtgccccccagaagagccacctacttcctggccggcctgggcctgggccccggcagaggcagagaggccgccgagctggccagagacctgacctgccccaccggcgccagcgccgagctggccagactgctggaggacagactgctgaccagacagctgctggcccagcagggcggcgtggccgtgcccgccaccctggccttcacctacaagccccccggcctgctgagaggcggcgacgccagcctgggcctgagactggtggagctgagcggcaaggagggccaggagaccctggtgaaggaggagagaacctggctgggccccaagccctggaccaaccccggcaagacctag

SEQ ID NO: 75523 - DNA, 2775 bp, Artificial Sequence
  Description of Artificial Sequence: Synthetic coding sequence
atgctgagcctggaccccagcggccccgagtgggactgccccctgggcagcaaggacctggaggaggagggcccctggggcggcggcagcggcctgccccccaccggctgcttccccggcagctggagacaggacgtgggcctggactgcaagggcagccccgagggcgccgaggccagagcctggaccgtgtactactacagcctgctgcagagctgcctgcagcaggccggcctgcccgagacccaggacagaggccaggtgcccagaaccggctgccccggcgccgaggtgaccctgtgcgtgctgggcagccccagcaccttcctgcccgtgctgctggagggcggcgtgcagagccccggcaacatgctgctgtgcctgagccccgcctggctgatgaaggtgcccgcccccggccagcccggcgaggccgccctgctggtgagcaaggccgtgagcttccaccccggcggcctgaccttcctggacgacttcgtgccccccagaagagccacctacttcctggccggcctgggcctgggccccggcagaggcagagaggccgccgagctggccagagacctgacctgccccaccggcgccagcgccgagctggccagactgctggaggacagactgctgaccagacagctgctggcccagcagggcggcgtggccgtgcccgccaccctggccttcacctacaagccccccggcctgctgagaggcggcgacgccagcctgggcctgagactggtggagctgagcggcaaggagggccaggagaccctggtgaaggaggaggtggaggccttcctgagaagcgaggccctgggcgacatcctgcaggtggccgtgaagctgagcggctggagatggagaggcagacaggcctggagactgcaccccagagccgagctgggcgccgtggtggacaccgtgctggccctgctggagaagctggaggaggaggagagcgtgctggtggaggccgtgtacccccccgcccagctgccctgcagcgacggccccagccccggccccggcctggccgtgagaatctgcgccgtggtgtgcagaacccagggcgacagacccctgctgagcaaggtggtgtgcggcgtgggcagaggcgacagacccctgagacaccacaacagcctgcccagaaccctggaggtggccctggccgccgtgctggccctggaggccggcctgagcgccgagcagagaggcggcagaagagcccacaccgacttcctgggcgtggacttcgccctgaccgccgccggcggcgtgctgacccccgtggccctggagctgaacggcggcctgtgcctggaggcctgcggcgccctggagggcctgtgggccgcccccagactgggccccgccgccgacgaggccgtggccgcccccctggtggagaccatgctgagaagaagcgccagatgcctgatggagggcaagcagctgctggtggtgggcgccggcggcgtgagcaagaagttcgtgtgggaggccgccagagactacggcctgcagctgcacctggtggagagcgaccccaaccacttcgccagccagctggtgcagaccttcatccacttcgacatgaccgagcacagaagagacgaggagaacgccagactgctggccgagctggtgagagccagaggcctgaagctggacggctgcttcagctactgggacgactgcctggtgctgaccgccctgctgtgccaggagctgggcctgccctgcagcagccccgccgccatgagactggccaagcagaagagcctgacccagctgcacctgctgcaccaccacggccccccctggcccgcccccagcctgcacgccgtgccctgctgccccctggagagcgaggccgacgtggagagagccgtgcaccaggtgcccctgcccggcgtgatgaagctggagttcggcgccggcgccgtgggcgtgagactggtggaggacgccccccagtgccacgagcacttcagcagaatcaccagagacctgcagggcgaggccgaccaccccggcatcggcctgggctggggcaacgccatgctgctgatggagttcgtggagggcaccgagcacgacgtggacctggtgctgttcggcggcagactgctggccgccttcgtgagcgacaacggccccaccagactgcccggcttcaccgagaccgccgcctgcatgcccaccggcctggcccccgagcaggaggcccagatggtgcaggccgccttcagatgctgcctgggctgcggcctgctggacggcgtgttcaacgtggagctgaagctgaccggcgccggccccagactgatcgagatcaaccccagaatgggcggcttctacctgagagactggatcctggagctgtacggcgtggacctgctgctggccgccgtgatggtggcctgcggcctgagacccgccctgcccaccagacccagagccagaggccacctggtgggcgtgatgtgcctggtgagccagcacctgcaggccctgagcagcaccgccagcagagagaccctgcaggccctgcacgacagaggcctgctgagactgaacctgctggaggaggccctggtgcccggcgagtacgaggagccctactgcagcgtggcctgcgccggccccagccccaccgaggccagactgagactgctgggcctgtgccagggcctgggcatcgacggccccagctaccccgtggcccacttcctgagccacttcaagtag

SEQ ID NO: 75524 - DNA, 1206 bp, Artificial Sequence
  Description of Artificial Sequence: Synthetic coding sequence
atggagcccggcagaagaggcgccgccgccctgctggccctgctgtgcgtggcctgcgccctgagagccggcagagcccagtacgagagatacagcttcagaagcttccccagagacgagctgatgcccctggagagcgcctacagacacgccctggacaagtacagcggcgagcactgggccgagagcgtgggctacctggagatcagcctgagactgcacagactgctgagagacagcgaggccttctgccacagaaactgcagcgccgccccccagcccgagcccgccgccggcctggccagctaccccgagctgagactgttcggcggcctgctgagaagagcccactgcctgaagagatgcaagcagggcctgcccgccttcagacagagccagcccagcagagaggtgctggccgacttccagagaagagagccctacaagttcctgcagttcgcctacttcaaggccaacaacctgcccaaggccatcgccgccgcccacaccttcctgctgaagcaccccgacgacgagatgatgaagagaaacatggcctactacaagagcctgcccggcgccgaggactacatcaaggacctggagaccaagagctacgagagcctgttcatcagagccgtgagagcctacaacggcgagaactggagaaccagcatcaccgacatggagctggccctgcccgacttcttcaaggccttctacgagtgcctggccgcctgcgagggcagcagagagatcaaggacttcaaggacttctacctgagcatcgccgaccactacgtggaggtgctggagtgcaagatccagtgcgaggagaacctgacccccgtgatcggcggctaccccgtggagaagttcgtggccaccatgtaccactacctgcagttcgcctactacaagctgaacgacctgaagaacgccgccccctgcgccgtgagctacctgctgttcgaccagaacgacaaggtgatgcagcagaacctggtgtactaccagtaccacagagacacctggggcctgagcgacgagcacttccagcccagacccgaggccgtgcagttcttcaacgtgaccaccctgcagaaggagctgtacgacttcgccaaggagaacatcatggacgacgacgagggcgaggtggtggagtacgtggacgacctgctggagctggaggagaccagctag

SEQ ID NO: 75525 - DNA, 789 bp, Artificial Sequence
  Description of Artificial Sequence: Synthetic coding sequence
atggagcccggcagaagaggcgccgccgccctgctggccctgctgtgcgtggcctgcgccctgagagccggcagagcccagtacgagagatacagcttcagaagcttccccagagacgagctgatgcccctggagagcgcctacagacacgccctggacaagtacagcggcgagcactgggccgagagcgtgggctacctggagatcagcctgagactgcacagactgctgagagacagcgaggccttctgccacagaaactgcagcgccgccccccagcccgagcccgccgccggcctggccagctaccccgagctgagactgttcggcggcctgctgagaagagcccactgcctgaagagatgcaagcagggcctgcccgccttcagacagagccagcccagcagagaggtgctggccgacttccagagaagagagccctacaagttcctgcagttcgcctacttcaaggccaacaacctgcccaaggccatcgccgccgcccacaccttcctgctgaagcaccccgacgacgagatgatgaagagaaacatggcctactacaagagcctgcccggcgccgaggactacctgaagacctggaagcccagccacatgaaggcctgcagcagcgagcagtgcggccacaccaccgtgagaaccggcgagcaccccagccagacctggagctggcccttccccaccagcagcaagcccttcaccagcgtgagccagcccgccagagtgcccggcagaagcagaaccagcagaatcagcaccttcccctag

SEQ ID NO: 75526 - DNA, 789 bp, Artificial Sequence
  Description of Artificial Sequence: Synthetic coding sequence
atggagcccggcagaagaggcgccgccgccctgctggccctgctgtgcgtggcctgcgccctgagagccggcagagcccagtacgagagatacagcttcagaagcttccccagagacgagctgatgcccctggagagcgcctacagacacgccctggacaagtacagcggcgagcactgggccgagagcgtgggctacctggagatcagcctgagactgcacagactgctgagagacagcgaggccttctgccacagaaactgcagcgccgccccccagcccgagcccgccgccggcctggccagctaccccgagctgagactgttcggcggcctgctgagaagagcccactgcctgaagagatgcaagcagggcctgcccgccttcagacagagccagcccagcagagaggtgctggccgacttccagagaagagagccctacaagttcctgcagttcgcctacttcaaggccaacaacctgcccaaggccatcgccgccgcccacaccttcctgctgaagcaccccgacgacgagatgatgaagagaaacatggcctactacaagagcctgcccggcgccgaggactacatcaaggacctggagaccaagagctacgagagcctgttcatcgagcagtgcggccacaccaccgtgagaaccggcgagcaccccagccagacctggagctggcccttccccaccagcagcaagcccttcaccagcgtgagccagcccgccagagtgcccggcagaagcagaaccagcagaatcagcaccttcccctag

SEQ ID NO: 75527 - DNA, 1167 bp, Artificial Sequence
  Description of Artificial Sequence: Synthetic coding sequence
atggagcccggcagaagaggcgccgccgccctgctggccctgctgtgcgtggcctgcgccctgagagccggcagagcccagtacgagagatacagcttcagaagcttccccagagacgagctgatgcccctggagagcgcctacagacacgccctggacaagtacagcggcgagcactgggccgagagcgtgagagacagcgaggccttctgccacagaaactgcagcgccgccccccagcccgagcccgccgccggcctggccagctaccccgagctgagactgttcggcggcctgctgagaagagcccactgcctgaagagatgcaagcagggcctgcccgccttcagacagagccagcccagcagagaggtgctggccgacttccagagaagagagccctacaagttcctgcagttcgcctacttcaaggccaacaacctgcccaaggccatcgccgccgcccacaccttcctgctgaagcaccccgacgacgagatgatgaagagaaacatggcctactacaagagcctgcccggcgccgaggactacatcaaggacctggagaccaagagctacgagagcctgttcatcagagccgtgagagcctacaacggcgagaactggagaaccagcatcaccgacatggagctggccctgcccgacttcttcaaggccttctacgagtgcctggccgcctgcgagggcagcagagagatcaaggacttcaaggacttctacctgagcatcgccgaccactacgtggaggtgctggagtgcaagatccagtgcgaggagaacctgacccccgtgatcggcggctaccccgtggagaagttcgtggccaccatgtaccactacctgcagttcgcctactacaagctgaacgacctgaagaacgccgccccctgcgccgtgagctacctgctgttcgaccagaacgacaaggtgatgcagcagaacctggtgtactaccagtaccacagagacacctggggcctgagcgacgagcacttccagcccagacccgaggccgtgcagttcttcaacgtgaccaccctgcagaaggagctgtacgacttcgccaaggagaacatcatggacgacgacgagggcgaggtggtggagtacgtggacgacctgctggagctggaggagaccagctag

SEQ ID NO: 75528 - DNA, 3471 bp, Artificial Sequence
  Description of Artificial Sequence: Synthetic coding sequence
atggccagcctgctgcccctgctgtgcctgtgcgtggtggccgcccacctggccggcgccagagacgccacccccaccgaggagcccatggccaccgccctgggcctggagagaagaagcgtgtacaccggccagcccagccccgccctggaggactgggaggaggccagcgagtggaccagctggttcaacgtggaccaccccggcggcgacggcgacttcgagagcctggccgccatcagattctactacggccccgccagagtgtgccccagacccctggccctggaggccagaaccaccgactgggccctgcccagcgccgtgggcgagagagtgcacctgaaccccaccagaggcttctggtgcctgaacagagagcagcccagaggcagaagatgcagcaactaccacgtgagattcagatgccccctggaggccagctggggcgcctggggcccctggggcccctgcagcggcagctgcggccccggcagaagactgagaagaagacactgccccagccccgccggcgacgcctgccccggcagacccctggaggcccagaagtgcgtgagacccagatgccccggctgcagcctggacacctgcgagtgccccgaccacatcctgctgggcagcgtggtgacccccagcggccagcccctgctgggcgccagagtgagcctgagagaccagcccggcaccgtggccaccagcgacgcccacggcaccttcagagtgcccggcgtgtgcgccgacagcagagccaacatcagagcccagatggacggcttcagcgccggcgaggcccaggcccaggccaacggcagcatcagcgtggtgaccatcatcctggacaagctggagaagccctacctggtgaagcaccccgagagcagagtgagagaggccggccagaacgtgaccttctgctgcaaggccagcggcacccccatgcccaagaagtacagctggttccacaacggcaccctgctggacagaagagcccacggctacggcgcccacctggagctgagaggcctgagacccgaccaggccggcatctaccactgcaaggcctggaacgaggccggcgccgtgagaagcggcaccgccagactgaccgtgctggcccccggccagcccgcctgcgaccccagacccagagagtacctgatcaagctgcccgaggactgcggccagcccggcagcggccccgcctacctggacgtgggcctgtgccccgacaccagatgccccagcctggccggcagcagccccagatgcggcgacgccagcagcagatgctgcagcgtgagaagactggagagaagagagatccactgccccggctacgtgctgcccgtgaaggtggtggccgagtgcggctgccagaagtgcctgccccccagaggcctggtgagaggcagagtggtggccgccgacagcggcgagcccctgagattcgccagaatcctgctgggccaggagcccatcggcttcaccgcctaccagggcgacttcaccatcgaggtgccccccagcacccagagactggtggtgaccttcgtggaccccagcggcgagttcatggacgccgtgagagtgctgcccttcgaccccagaggcgccggcgtgtaccacgaggtgaaggccatgagaaagaaggcccccgtgatcctgcacaccagccagagcaacaccatccccctgggcgagctggaggacgaggcccccctgggcgagctggtgctgcccagcggcgccttcagaagagccgacggcaagccctacagcggccccgtggaggccagagtgaccttcgtggaccccagagacctgaccagcgccgccagcgcccccagcgacctgagattcgtggacagcgacggcgagctggcccccctgagaacctacggcatgttcagcgtggacctgagagcccccggcagcgccgagcagctgcaggtgggccccgtggccgtgagagtggccgccagccagatccacatgcccggccacgtggaggccctgaagctgtggagcctgaaccccgagaccggcctgtgggaggaggagagcggcttcagaagagagggcagcagcggccccagagtgagaagagaggagagagtgttcctggtgggcaacgtggagatcagagagagaagactgttcaacctggacgtgcccgagagaagaagatgcttcgtgaaggtgagagcctacgccaacgacaagttcacccccagcgagcaggtggagggcgtggtggtgaccctggtgaacctggagcccgcccccggcttcagcgccaaccccagagcctggggcagattcgacagcgccgtgaccggccccaacggcgcctgcctgcccgccttctgcgacgccgacagacccgacgcctacaccgccctggtgaccgccaccctgggcggcgaggagctggagcccgcccccagcctgcccagacccctgcccgccaccgtgggcgtgacccagccctacctggacagactgggctacagaagaaccgaccacgacgaccccgccttcaagagaaacggcttcagaatcaacctggccaagcccagacccggcgaccccgccgaggccaacggccccgtgtacccctggagaagcctgagagagtgccagggcgcccccgtgaccgccagccacttcagattcgccagagtggaggccgacaagtacgagtacaacgtggtgcccttcagagagggcacccccgccagctggaccggcgacctgctggcctggtggcccaacccccaggagttcagagcctgcttcctgaaggtgaagatccagggcccccaggagtacatggtgagaagccacaacgccggcggcagccaccccagaaccagaggccagctgtacggcctgagagacgccagaagcgtgagagaccccgagagacccggcaccagcgccgcctgcgtggagttcaagtgcagcggcatgctgttcgaccagagacaggtggacagaaccctggtgaccatcatgccccagggcagctgcagaagagtggccgtgaacggcctgctgagagactacctgaccagacaccccccccccgtgcccgccgaggaccccgccgccttcagcatgctggcccccctggaccccctgggccacaactacggcgtgtacaccgtgaccgaccagagccccagactggccaaggagatcgccatcggcagatgcttcgacggcagcagcgacggcttcagcagagagatgaaggccgacgccggcaccgccgtgaccttccagtgcagagagccccccgccggcagacccagcctgttccagagactgctggagagccccgccaccgccctgggcgacatcagaagagagatgagcgaggccgcccaggcccaggccagagccagcggccccctgagaaccagaagaggcagagtgagacagtag

SEQ ID NO: 75529 - DNA, 3555 bp, Artificial Sequence
  Description of Artificial Sequence: Synthetic coding sequence
atggtgggcaccaaggcctgggtgttcagcttcctggtgctggaggtgaccagcgtgctgggcagacagaccatgctgacccagagcgtgagaagagtgcagcccggcaagaagaaccccagcatcttcgccaagcccgccgacaccctggagagccccggcgagtggaccacctggttcaacatcgactaccccggcggcaagggcgactacgagagactggacgccatcagattctactacggcgacagagtgtgcgccagacccctgagactggaggccagaaccaccgactggacccccgccggcagcaccggccaggtggtgcacggcagccccagagagggcttctggtgcctgaacagagagcagagacccggccagaactgcagcaactacaccgtgagattcctgtgcccccccggcagcctgagaagagacaccgagagaatctggagcccctggagcccctggagcaagtgcagcgccgcctgcggccagaccggcgtgcagaccagaaccagaatctgcctggccgagatggtgagcctgtgcagcgaggccagcgaggagggccagcactgcatgggccaggactgcaccgcctgcgacctgacctgccccatgggccaggtgaacgccgactgcgacgcctgcatgtgccaggacttcatgctgcacggcgccgtgagcctgcccggcggcgcccccgccagcggcgccgccatctacctgctgaccaagacccccaagctgctgacccagaccgacagcgacggcagattcagaatccccggcctgtgccccgacggcaagagcatcctgaagatcaccaaggtgaagttcgcccccatcgtgctgaccatgcccaagaccagcctgaaggccgccaccatcaaggccgagttcgtgagagccgagaccccctacatggtgatgaaccccgagaccaaggccagaagagccggccagagcgtgagcctgtgctgcaaggccaccggcaagcccagacccgacaagtacttctggtaccacaacgacaccctgctggaccccagcctgtacaagcacgagagcaagctggtgctgagaaagctgcagcagcaccaggccggcgagtacttctgcaaggcccagagcgacgccggcgccgtgaagagcaaggtggcccagctgatcgtgatcgccagcgacgagaccccctgcaaccccgtgcccgagagctacctgatcagactgccccacgactgcttccagaacgccaccaacagcttctactacgacgtgggcagatgccccgtgaagacctgcgccggccagcaggacaacggcatcagatgcagagacgccgtgcagaactgctgcggcatcagcaagaccgaggagagagagatccagtgcagcggctacaccctgcccaccaaggtggccaaggagtgcagctgccagagatgcaccgagaccagaagcatcgtgagaggcagagtgagcgccgccgacaacggcgagcccatgagattcggccacgtgtacatgggcaacagcagagtgagcatgaccggctacaagggcaccttcaccctgcacgtgccccaggacaccgagagactggtgctgaccttcgtggacagactgcagaagttcgtgaacaccaccaaggtgctgcccttcaacaagaagggcagcgccgtgttccacgagatcaagatgctgagaagaaagaagcccatcaccctggaggccatggagaccaacatcatccccctgggcgaggtggtgggcgaggaccccatggccgagctggagatccccagcagaagcttctacagacagaacggcgagccctacatcggcaaggtgaaggccagcgtgaccttcctggaccccagaaacatcagcaccgccaccgccgcccagaccgacctgaacttcatcaacgacgagggcgacaccttccccctgagaacctacggcatgttcagcgtggacttcagagacgaggtgaccagcgagcccctgaacgccggcaaggtgaaggtgcacctggacagcacccaggtgaagatgcccgagcacatcagcaccgtgaagctgtggagcctgaaccccgacaccggcctgtgggaggaggagggcgacttcaagttcgagaaccagagaagaaacaagagagaggacagaaccttcctggtgggcaacctggagatcagagagagaagactgttcaacctggacgtgcccgagagcagaagatgcttcgtgaaggtgagagcctacagaagcgagagattcctgcccagcgagcagatccagggcgtggtgatcagcgtgatcaacctggagcccagaaccggcttcctgagcaaccccagagcctggggcagattcgacagcgtgatcaccggccccaacggcgcctgcgtgcccgccttctgcgacgaccagagccccgacgcctacagcgcctacgtgctggccagcctggccggcgaggagctgcaggccgtggagagcagccccaagttcaaccccaacgccatcggcgtgccccagccctacctgaacaagctgaactacagaagaaccgaccacgaggaccccagagtgaagaagaccgccttccagatcagcatggccaagcccagacccaacagcgccgaggagagcaacggccccatctacgccttcgagaacctgagagcctgcgaggaggccccccccagcgccgcccacttcagattctaccagatcgagggcgacagatacgactacaacaccgtgcccttcaacgaggacgaccccatgagctggaccgaggactacctggcctggtggcccaagcccatggagttcagagcctgctacatcaaggtgaagatcgtgggccccctggaggtgaacgtgagaagcagaaacatgggcggcacccacagacagaccgtgggcaagctgtacggcatcagagacgtgagaagcaccagagacagagaccagcccaacgtgagcgccgcctgcctggagttcaagtgcagcggcatgctgtacgaccaggacagagtggacagaaccctggtgaaggtgatcccccagggcagctgcagaagagccagcgtgaaccccatgctgcacgagtacctggtgaaccacctgcccctggccgtgaacaacgacaccagcgagtacaccatgctggcccccctggaccccctgggccacaactacggcatctacaccgtgaccgaccaggaccccagaaccgccaaggagatcgccctgggcagatgcttcgacggcaccagcgacggcagcagcagaatcatgaagagcaacgtgggcgtggccctgaccttcaactgcgtggagagacaggtgggcagacagagcgccttccagtacctgcagagcacccccgcccagagccccgccgccggcaccgtgcagggcagagtgcccagcagaagacagcagagagccagcagaggcggccagagacagggcggcgtggtggccagcctgagattccccagagtggcccagcagcccctgatcaactag

SEQ ID NO: 75530 - DNA, 8148 bp, Artificial Sequence
  Description of Artificial Sequence: Synthetic coding sequence
atggccgccgccgccggcggcggcagctgccccggccccggcagcgccagaggcagattccccggcagacccagaggcgccggcggcggcggcggcagaggcggcagaggcaacggcgccgagagagtgagagtggccctgagaagaggcggcggcgccaccggccccggcggcgccgagcccggcgaggacaccgccctgctgagactgctgggcctgagaagaggcctgagaagactgagaagactgtgggccggccccagagtgcagagaggcagaggcagaggcagaggcagaggctggggccccagcagaggctgcgtgcccgaggaggagagcagcgacggcgagagcgacgaggaggagttccagggcttccacagcgacgaggacgtggcccccagcagcctgagaagcgccctgagaagccagagaggcagagcccccagaggcagaggcagaaagcacaagaccacccccctgcccccccccagactggccgacgtggcccccaccccccccaagacccccgccagaaagagaggcgaggagggcaccgagagaatggtgcaggccctgaccgagctgctgagaagagcccaggccccccaggcccccagaagcagagcctgcgagcccagcacccccagaagaagcagaggcagaccccccggcagacccgccggcccctgcagaagaaagcagcaggccgtggtggtggccgaggccgccgtgaccatccccaagcccgagccccccccccccgtggtgcccgtgaagcaccagaccggcagctggaagtgcaaggagggccccggccccggccccggcacccccagaagaggcggccagagcagcagaggcggcagaggcggcagaggcagaggcagaggcggcggcctgcccttcgtgatcaagttcgtgagcagagccaagaaggtgaagatgggccagctgagcctgggcctggagagcggccagggccagggccagcacgaggagagctggcaggacgtgccccagagaagagtgggcagcggccagggcggcagcccctgctggaagaagcaggagcagaagctggacgacgaggaggaggagaagaaggaggaggaggagaaggacaaggagggcgaggagaaggaggagagagccgtggccgaggagatgatgcccgccgccgagaaggaggaggccaagctgccccccccccccctgaccccccccgcccccagcccccccccccccctgcccccccccagcaccagcccccccccccccctgtgcccccccccccccccccccgtgagccccccccccctgcccagccccccccccccccccgcccaggaggagcaggaggagagccccccccccgtggtgcccgccacctgcagcagaaagagaggcagaccccccctgacccccagccagagagccgagagagaggccgccagagccggccccgagggcaccagcccccccacccccacccccagcaccgccaccggcggcccccccgaggacagccccaccgtggcccccaagagcaccaccttcctgaagaacatcagacagttcatcatgcccgtggtgagcgccagaagcagcagagtgatcaagacccccagaagattcatggacgaggacccccccaagccccccaaggtggaggtgagccccgtgctgagaccccccatcaccaccagcccccccgtgccccaggagcccgcccccgtgcccagcccccccagagcccccaccccccccagcacccccgtgcccctgcccgagaagagaagaagcatcctgagagagcccaccttcagatggaccagcctgaccagagagctgcccccccccccccccgcccccccccccccccccgcccccagccccccccccgcccccgccaccagcagcagaagacccctgctgctgagagccccccagttcacccccagcgaggcccacctgaagatctacgagagcgtgctgacccccccccccctgggcgcccccgaggcccccgagcccgagcccccccccgccgacgacagccccgccgagcccgagcccagagccgtgggcagaaccaaccacctgagcctgcccagattcgcccccgtggtgaccacccccgtgaaggccgaggtgagcccccacggcgcccccgccctgagcaacggcccccagacccaggcccagctgctgcagcccctgcaggccctgcagacccagctgctgccccaggccctgccccccccccagccccagctgcagcccccccccagcccccagcagatgccccccctggagaaggccagaatcgccggcgtgggcagcctgcccctgagcggcgtggaggagaagatgttcagcctgctgaagagagccaaggtgcagctgttcaagatcgaccagcagcagcagcagaaggtggccgccagcatgcccctgagccccggcggccagatggaggaggtggccggcgccgtgaagcagatcagcgacagaggccccgtgagaagcgaggacgagagcgtggaggccaagagagagagacccagcggccccgagagccccgtgcagggccccagaatcaagcacgtgtgcagacacgccgccgtggccctgggccaggccagagccatggtgcccgaggacgtgcccagactgagcgccctgcccctgagagacagacaggacctggccaccgaggacaccagcagcgccagcgagaccgagagcgtgcccagcagaagcagaagaggcaaggtggaggccgccggccccggcggcgagagcgagcccaccggcagcggcggcaccctggcccacacccccagaagaagcctgcccagccaccacggcaagaagatgagaatggccagatgcggccactgcagaggctgcctgagagtgcaggactgcggcagctgcgtgaactgcctggacaagcccaagttcggcggccccaacaccaagaagcagtgctgcgtgtacagaaagtgcgacaagatcgaggccagaaagatggagagactggccaagaagggcagaaccatcgtgaagaccctgctgccctgggacagcgacgagagccccgaggccagccccggcccccccggccccagaagaggcgccggcgccggcggccccagagaggaggtggtggcccaccccggccccgaggagcaggacagcctgctgcagagaaagagcgccagaagatgcgtgaagcagagacccagctacgacatcttcgaggacagcgacgacagcgagcccggcggcccccccgcccccagaagaagaacccccagagagaacgagctgcccctgcccgagcccgaggagcagagcagacccagaaagcccaccctgcagcccgtgctgcagctgaaggccagaagaagactggacaaggacgccctggcccccggccccttcgccagcttccccaacggctggaccggcaagcagaagagccccgacggcgtgcacagagtgagagtggacttcaaggaggactgcgacctggagaacgtgtggctgatgggcggcctgagcgtgctgaccagcgtgcccggcggcccccccatggtgtgcctgctgtgcgccagcaagggcctgcacgagctggtgttctgccaggtgtgctgcgaccccttccaccccttctgcctggaggaggccgagagacccctgccccagcaccacgacacctggtgctgcagaagatgcaagttctgccacgtgtgcggcagaaagggcagaggcagcaagcacctgctggagtgcgagagatgcagacacgcctaccaccccgcctgcctgggccccagctaccccaccagagccaccagaaagagaagacactggatctgcagcgcctgcgtgagatgcaagagctgcggcgccacccccggcaagaactgggacgtggagtggagcggcgactacagcctgtgccccagatgcacccagctgtacgagaagggcaactactgccccatctgcaccagatgctacgaggacaacgactacgagagcaagatgatgcagtgcgcccagtgcgaccactgggtgcacgccaagtgcgagggcctgagcgacgaggactacgagatcctgagcggcctgcccgacagcgtgctgtacacctgcggcccctgcgccggcgccgcccagcccagatggagagaggccctgagcggcgccctgcagggcggcctgagacaggtgctgcagggcctgctgagcagcaaggtggtgggccccctgctgctgtgcacccagtgcggccccgacggcaagcagctgcaccccggcccctgcggcctgcaggccgtgagccagagattcgaggacggccactacaagagcgtgcacagcttcatggaggacatggtgggcatcctgatgagacacagcgaggagggcgagacccccgacagaagagccggcggccagatgaagggcctgctgctgaagctgctggagagcgccttcggctggttcgacgcccacgaccccaagtactggagaagaagcaccagactgcccaacggcgtgctgcccaacgccgtgctgccccccagcctggaccacgtgtacgcccagtggagacagcaggagcccgagacccccgagagcggccagccccccggcgaccccagcgccgccttccagggcaaggaccccgccgccttcagccacctggaggaccccagacagtgcgccctgtgcctgaagtacggcgacgccgacagcaaggaggccggcagactgctgtacatcggccagaacgagtggacccacgtgaactgcgccatctggagcgccgaggtgttcgaggagaacgacggcagcctgaagaacgtgcacgccgccgtggccagaggcagacagatgagatgcgagctgtgcctgaagcccggcgccaccgtgggctgctgcctgagcagctgcctgagcaacttccacttcatgtgcgccagagccagctactgcatcttccaggacgacaagaaggtgttctgccagaagcacaccgacctgctggacggcaaggagatcgtgaaccccgacggcttcgacgtgctgagaagagtgtacgtggacttcgagggcatcaacttcaagagaaagttcctgaccggcctggagcccgacgccatcaacgtgctgatcggcagcatcagaatcgacagcctgggcaccctgagcgacctgagcgactgcgagggcagactgttccccatcggctaccagtgcagcagactgtactggagcaccgtggacgccagaagaagatgctggtacagatgcagaatcctggagtacagaccctggggccccagagaggagcccgcccacctggaggccgccgaggagaaccagaccatcgtgcacagccccgcccccagcagcgagccccccggcggcgaggacccccccctggacaccgacgtgctggtgcccggcgcccccgagagacacagccccatccagaacctggacccccccctgagacccgacagcggcagcgcccccccccccgcccccagaagcttcagcggcgccagaatcaaggtgcccaactacagccccagcagaagacccctgggcggcgtgagcttcggccccctgcccagccccggcagccccagcagcctgacccaccacatccccaccgtgggcgaccccgacttccccgccccccccagaagaagcagaagacccagccccctggcccccagacccccccccagcagatgggccagcccccccctgaagaccagcccccagctgagagtgcccccccccaccagcgtggtgaccgccctgacccccaccagcggcgagctggccccccccggccccgcccccagcccccccccccccgaggacctgggccccgacttcgaggacatggaggtggtgagcggcctgagcgccgccgacctggacttcgccgccagcctgctgggcaccgagcccttccaggaggagatcgtggccgccggcgccatgggcagcagccacggcggccccggcgacagcagcgaggaggagagcagccccaccagcagatacatccacttccccgtgaccgtggtgagcgcccccggcctggcccccagcgccacccccggcgcccccagaatcgagcagctggacggcgtggacgacggcaccgacagcgaggccgaggccgtgcagcagcccagaggccagggcaccccccccagcggccccggcgtggtgagagccggcgtgctgggcgccgccggcgacagagccagaccccccgaggacctgcccagcgagatcgtggacttcgtgctgaagaacctgggcggccccggcgacggcggcgccggccccagagaggagagcctgccccccgccccccccctggccaacggcagccagcccagccagggcctgaccgccagccccgccgaccccaccagaaccttcgcctggctgcccggcgcccccggcgtgagagtgctgagcctgggccccgcccccgagccccccaagcccgccaccagcaagatcatcctggtgaacaagctgggccaggtgttcgtgaagatggccggcgagggcgagcccgtgcccccccccgtgaagcagccccccctgccccccaccatcagccccaccgcccccaccagctggaccctgccccccggccccctgctgggcgtgctgcccgtggtgggcgtggtgagacccgcccccccccccccccccccccccctgaccctggtgctgagcagcggccccgccagcccccccagacaggccatcagagtgaagagagtgagcaccttcagcggcagaagcccccccgccccccccccctacaaggcccccagactggacgaggacggcgaggccagcgaggacaccccccaggtgcccggcctgggcagcggcggcttcagcagagtgagaatgaagacccccaccgtgagaggcgtgctggacctggacagacccggcgagcccgccggcgaggagagccccggccccctgcaggagagaagccccctgctgcccctgcccgaggacggccccccccaggtgcccgacggcccccccgacctgctgctggagagccagtggcaccactacagcggcgaggccagcagcagcgaggaggagccccccagccccgacgacaaggagaaccaggcccccaagagaaccggcccccacctgagattcgagatcagcagcgaggacggcttcagcgtggaggccgagagcctggagggcgcctggagaaccctgatcgagaaggtgcaggaggccagaggccacgccagactgagacacctgagcttcagcggcatgagcggcgccagactgctgggcatccaccacgacgccgtgatcttcctggccgagcagctgcccggcgcccagagatgccagcactacaagttcagataccaccagcagggcgagggccaggaggagccccccctgaacccccacggcgccgccagagccgaggtgtacctgagaaagtgcaccttcgacatgttcaacttcctggccagccagcacagagtgctgcccgagggcgccacctgcgacgaggaggaggacgaggtgcagctgagaagcaccagaagagccaccagcctggagctgcccatggccatgagattcagacacctgaagaagaccagcaaggaggccgtgggcgtgtacagaagcgccatccacggcagaggcctgttctgcaagagaaacatcgacgccggcgagatggtgatcgagtacagcggcatcgtgatcagaagcgtgctgaccgacaagagagagaagttctacgacggcaagggcatcggctgctacatgttcagaatggacgacttcgacgtggtggacgccaccatgcacggcaacgccgccagattcatcaaccacagctgcgagcccaactgcttcagcagagtgatccacgtggagggccagaagcacatcgtgatcttcgccctgagaagaatcctgagaggcgaggagctgacctacgactacaagttccccatcgaggacgccagcaacaagctgccctgcaactgcggcgccaagagatgcagaagattcctgaactag

SEQ ID NO: 75531 - DNA, 2115 bp, Artificial Sequence
  Description of Artificial Sequence: Synthetic coding sequence
atggtgcccgacaccgcctgcgtgctgctgctgaccctggccgccctgggcgccagcggccagggccagagccccctgggcagcgacctgggcccccagatgctgagagagctgcaggagaccaacgccgccctgcaggacgtgagagagctgctgagacagcaggtgagagagatcaccttcctgaagaacaccgtgatggagtgcgacgcctgcggcatgcagcagagcgtgagaaccggcctgcccagcgtgagacccctgctgcactgcgcccccggcttctgcttccccggcgtggcctgcatccagaccgagagcggcgccagatgcggcccctgccccgccggcttcaccggcaacggcagccactgcaccgacgtgaacgagtgcgagaccggccagcacaactgcgtgcccaacagcgtgtgcatcaacaccagaggcagcttccagtgcggcccctgccagcccggcttcgtgggcgaccaggccagcggctgccagagaagagcccagagattctgccccgacggcagccccagcgagtgccacgagcacgccgactgcgtgctggagagagacggcagcagaagctgcgtgtgcgccgtgggctgggccggcaacggcatcctgtgcggcagagacaccgacctggacggcttccccgacgagaagctgagatgccccgagagacagtgcagaaaggacaactgcgtgaccgtgcccaacagcggccaggaggacgtggacagagacggcatcggcgacgcctgcgaccccgacgccgacggcgacggcgtgcccaacgagaaggacaactgccccctggtgagaaaccccgaccagagaaacaccgacgaggacaagtggggcgacgcctgcgacaactgcagaagccagaagaacgacgaccagaaggacaccgaccaggacggcagaggcgacgcctgcgacgacgacatcgacggcgacagaatcagaaaccaggccgacaactgccccagagtgcccaacagcgaccagaaggacagcgacggcgacggcatcggcgacgcctgcgacaactgcccccagaagagcaaccccgaccaggccgacgtggaccacgacttcgtgggcgacgcctgcgacagcgaccaggaccaggacggcgacggccaccaggacagcagagacaactgccccaccgtgcccaacagcgcccaggaggacagcgaccacgacggccagggcgacgcctgcgacgacgacgacgacaacgacggcgtgcccgacagcagagacaactgcagactggtgcccaaccccggccaggaggacgccgacagagacggcgtgggcgacgtgtgccaggacgacttcgacgccgacaaggtggtggacaagatcgacgtgtgccccgagaacgccgaggtgaccctgaccgacttcagagccttccagaccgtggtgctggaccccgagggcgacgcccagatcgaccccaactgggtggtgctgaaccagggcagagagatcgtgcagaccatgaacagcgaccccggcctggccgtgggctacaccgccttcaacggcgtggacttcgagggcaccttccacgtgaacaccgtgaccgacgacgactacgccggcttcatcttcggctaccaggacagcagcagcttctacgtggtgatgtggaagcagatggagcagacctactggcaggccaaccccttcagagccgtggccgagcccggcatccagctgaaggccgtgaagagcagcaccggccccggcgagcagctgagaaacgccctgtggcacaccggcgacaccgagagccaggtgagactgctgtggaaggaccccagaaacgtgggctggaaggacaagaagagctacagatggttcctgcagcacagaccccaggtgggctacatcagagtgagattctacgagggccccgagctggtggccgacagcaacgtggtgctggacaccaccatgagaggcggcagactgggcgtgttctgcttcagccaggagaacatcatctgggccaacctgagatacagatgcaacgacaccatccccgaggactacgagacccaccagctgagacaggcctag

SEQ ID NO: 75532 - DNA, 2235 bp, Artificial Sequence
  Description of Artificial Sequence: Synthetic coding sequence
atggtgcccgacaccgcctgcgtgctgctgctgaccctggccgccctgggcgccagcggccagggccagagccccctgggcagcgacctgggcccccagatgctgagagagctgcaggagaccaacgccgccctgcaggacgtgagagagctgctgagacagcaggtgagagagatcaccttcctgaagaacaccgtgatggagtgcgacgcctgcggcatgcagcagagcgtgagaaccggcctgcccagcgtgagacccctgctgcactgcgcccccggcttctgcttccccggcccctgccccgccggcttcaccggcaacggcagccactgcaccgacgtgaacgagtgcaacgcccacccctgcttccccagagtgagatgcatcaacaccagccccggcttcagatgcgaggcctgcccccccggctacagcggccccacccaccagggcgtgggcctggccttcgccaaggccaacaagcaggtgtgcaccgacatcaacgagtgcgagaccggccagcacaactgcgtgcccaacagcgtgtgcatcaacaccagaggcagcttccagtgcggcccctgccagcccggcttcgtgggcgaccaggccagcggctgccagagaagagcccagagattctgccccgacggcagccccagcgagtgccacgagcacgccgactgcgtgctggagagagacggcagcagaagctgcgtgtgcgccgtgggctgggccggcaacggcatcctgtgcggcagagacaccgacctggacggcttccccgacgagaagctgagatgccccgagagacagtgcagaaaggacaactgcgtgaccgtgcccaacagcggccaggaggacgtggacagagacggcatcggcgacgcctgcgaccccgacgccgacggcgacggcgtgcccaacgagaaggacaactgccccctggtgagaaaccccgaccagagaaacaccgacgaggacaagtggggcgacgcctgcgacaactgcagaagccagaagaacgacgaccagaaggacaccgaccaggacggcagaggcgacgcctgcgacgacgacatcgacggcgacagaatcagaaaccaggccgacaactgccccagagtgcccaacagcgaccagaaggacagcgacggcgacggcatcggcgacgcctgcgacaactgcccccagaagagcaaccccgaccaggccgacgtggaccacgacttcgtgggcgacgcctgcgacagcgaccaggaccaggacggcgacggccaccaggacagcagagacaactgccccaccgtgcccaacagcgcccaggaggacagcgaccacgacggccagggcgacgcctgcgacgacgacgacgacaacgacggcgtgcccgacagcagagacaactgcagactggtgcccaaccccggccaggaggacgccgacagagacggcgtgggcgacgtgtgccaggacgacttcgacgccgacaaggtggtggacaagatcgacgtgtgccccgagaacgccgaggtgaccctgaccgacttcagagccttccagaccgtggtgctggaccccgagggcgacgcccagatcgaccccaactgggtggtgctgaaccagggcagagagatcgtgcagaccatgaacagcgaccccggcctggccgtgggctacaccgccttcaacggcgtggacttcgagggcaccttccacgtgaacaccgtgaccgacgacgactacgccggcttcatcttcggctaccaggacagcagcagcttctacgtggtgatgtggaagcagatggagcagacctactggcaggccaaccccttcagagccgtggccgagcccggcatccagctgaaggccgtgaagagcagcaccggccccggcgagcagctgagaaacgccctgtggcacaccggcgacaccgagagccaggtgagactgctgtggaaggaccccagaaacgtgggctggaaggacaagaagagctacagatggttcctgcagcacagaccccaggtgggctacatcagagtgagattctacgagggccccgagctggtggccgacagcaacgtggtgctggacaccaccatgagaggcggcagactgggcgtgttctgcttcagccaggagaacatcatctgggccaacctgagatacagatgcaacgacaccatccccgaggactacgagacccaccagctgagacaggcctag

SEQ ID NO: 75533 - DNA, 2394 bp, Artificial Sequence
  Description of Artificial Sequence: Synthetic coding sequence
atggccgccctggcctacaacctgggcaagagagagatcaaccactacttcagcgtgagaagcgccaaggtgctggccctggtggccgtgctgctgctggccgcctgccacctggccagcagaagatacagaggcaacgacagctgcgagtacctgctgagcagcggcagattcctgggcgagaaggtgtggcagccccacagctgcatgatgcacaagtacaagatcagcgaggccaagaactgcctggtggacaagcacatcgccttcatcggcgacagcagaatcagacagctgttctacagcttcgtgaagatcatcaacccccagttcaaggaggagggcaacaagcacgagaacatccccttcgaggacaagaccgccagcgtgaaggtggacttcctgtggcaccccgaggtgaacggcagcatgaagcagtgcatcaaggtgtggaccgaggacagcatcgccaagccccacgtgatcgtggccggcgccgccacctggagcatcaagatccacaacggcagcagcgaggccctgagccagtacaagatgaacatcaccagcatcgcccccctgctggagaagctggccaagaccagcgacgtgtactgggtgctgcaggaccccgtgtacgaggacctgctgagcgagaacagaaagatgatcaccaacgagaagatcgacgcctacaacgaggccgccgtgagcatcctgaacagcagcaccagaaacagcaagagcaacgtgaagatgttcagcgtgagcaagctgatcgcccaggagaccatcatggagagcctggacggcctgcacctgcccgagagcagcagagagaccaccgccatgatcctgatgaacgtgtactgcaacaagatcctgaagcccgtggacggcagctgctgccagcccagaccccccgtgaccctgatccagaagctggccgcctgcttcttcaccctgagcatcatcggctacctgatcttctacatcatccacagaaacgcccacagaaagaacaagccctgcaccgacctggagagcggcgaggagaagaagaacatcatcaacacccccgtgagcagcctggagatcctgctgcagagcttctgcaagctgggcctgatcatggcctacttctacatgtgcgacagagccaacctgttcatgaaggagaacaagttctacacccacagcagcttcttcatccccatcatctacatcctggtgctgggcgtgttctacaacgagaacaccaaggagaccaaggtgctgaacagagagcagaccgacgagtggaagggctggatgcagctggtgatcctgatctaccacatcagcggcgccagcaccttcctgcccgtgtacatgcacatcagagtgctggtggccgcctacctgttccagaccggctacggccacttcagctacttctggatcaagggcgacttcggcatctacagagtgtgccaggtgctgttcagactgaacttcctggtggtggtgctgtgcatcgtgatggacagaccctaccagttctactacttcgtgcccctggtgaccgtgtggttcatggtgatctacgtgaccctggccctgtggccccagatcatccagaagaaggccaacggcaactgcttctggcacttcggcctgctgctgaagctgggcttcctgctgctgttcatctgcttcctggcctacagccagggcgccttcgagaagatcttcagcctgtggcccctgagcaagtgcttcgagctgaagggcaacgtgtacgagtggtggttcagatggagactggacagatacgtggtgttccacggcatgctgttcgccttcatctacctggccctgcagaagagacagatcctgagcgagggcaagggcgagcccctgttcagcaacaagatcagcaacttcctgctgttcatcagcgtggtgagcttcctgacctacagcatctgggccagcagctgcaagaacaaggccgagtgcaacgagctgcaccccagcgtgagcgtggtgcagatcctggccttcatcctgatcagaaacatccccggctacgccagaagcgtgtacagcagcttcttcgcctggttcggcaagatcagcctggagctgttcatctgccagtaccacatctggctggccgccgacaccagaggcatcctggtgctgatccccggcaaccccatgctgaacatcatcgtgagcaccttcatcttcgtgtgcgtggcccacgagatcagccagatcaccaacgacctggcccagatcatcatccccaaggacaacagcagcctgctgaagagactggcctgcatcgccgccttcttctgcggcctgctgatcctgagcagcatccaggacaagagcaagcactag

SEQ ID NO: 75534 - DNA, 2721 bp, Artificial Sequence
  Description of Artificial Sequence: Synthetic coding sequence
atggccggcaacgtgaagaagagcagcggcgccggcggcggcagcggcagcggcggcagcggcagcggcggcctgatcggcctgatgaaggacgccttccagccccaccaccaccaccaccaccacctgagcccccacccccccggcaccgtggacaagaagatggtggagaagtgctggaagctgatggacaaggtggtgagactgtgccagaaccccaagctggccctgaagaacagccccccctacatcctggacctgctgcccgacacctaccagcacctgagaaccatcctgagcagatacgagggcaagatggagaccctgggcgagaacgagtacttcagagtgttcatggagaacctgatgaagaagaccaagcagaccatcagcctgttcaaggagggcaaggagagaatgtacgaggagaacagccagcccagaagaaacctgaccaagctgagcctgatcttcagccacatgctggccgagctgaagggcatcttccccagcggcctgttccagggcgacaccttcagaatcaccaaggccgacgccgccgagttctggagaaaggccttcggcgagaagaccatcgtgccctggaagagcttcagacaggccctgcacgaggtgcaccccatcagcagcggcctggaggccatggccctgaagagcaccatcgacctgacctgcaacgactacatcagcgtgttcgagttcgacatcttcaccagactgttccagccctggagcagcctgctgagaaactggaacagcctggccgtgacccaccccggctacatggccttcctgacctacgacgaggtgaaggccagactgcagaagttcatccacaagcccggcagctacatcttcagactgagctgcaccagactgggccagtgggccatcggctacgtgaccgccgacggcaacatcctgcagaccatcccccacaacaagcccctgttccaggccctgatcgacggcttcagagagggcttctacctgttccccgacggcagaaaccagaaccccgacctgaccggcctgtgcgagcccaccccccaggaccacatcaaggtgacccaggagcagtacgagctgtactgcgagatgggcagcaccttccagctgtgcaagatctgcgccgagaacgacaaggacgtgaagatcgagccctgcggccacctgatgtgcaccagctgcctgaccagctggcaggagagcgagggccagggctgccccttctgcagatgcgagatcaagggcaccgagcccatcgtggtggaccccttcgaccccagaggcagcggcagcctgctgagacagggcgccgagggcgcccccagccccaactacgacgacgacgacgacgagagagccgacgacaccctgttcatgatgaaggagctggccggcgccaaggtggagagaccccccagccccttcagcatggccccccaggccagcctgccccccgtgccccccagactggacctgctgccccagagagtgtgcgtgcccagcagcgccagcgccctgggcaccgccagcaaggccgccagcggcagcctgcacaaggacaagcccctgcccgtgccccccaccctgagagacctgccccccccccccccccccgacagaccctacagcgtgggcgccgagagcagaccccagagaagacccctgccctgcacccccggcgactgccccagcagagacaagctgccccccgtgcccagcagcagactgggcgacagctggctgcccagacccatccccaaggtgcccgtgagcgcccccagcagcagcgacccctggaccggcagagagctgaccaacagacacagcctgcccttcagcctgcccagccagatggagcccagacccgacgtgcccagactgggcagcaccttcagcctggacaccagcatgagcatgaacagcagccccctggtgggccccgagtgcgaccaccccaagatcaagcccagcagcagcgccaacgccatctacagcctggccgccagacccctgcccgtgcccaagctgccccccggcgagcagtgcgagggcgaggaggacaccgagtacatgacccccagcagcagacccctgagacccctggacaccagccagagcagcagagcctgcgactgcgaccagcagatcgacagctgcacctacgaggccatgtacaacatccagagccaggcccccagcatcaccgagagcagcaccttcggcgagggcaacctggccgccgcccacgccaacaccggccccgaggagagcgagaacgaggacgacggctacgacgtgcccaagccccccgtgcccgccgtgctggccagaagaaccctgagcgacatcagcaacgccagcagcagcttcggctggctgagcctggacggcgaccccaccaccaacgtgaccgagggcagccaggtgcccgagagaccccccaagcccttccccagaagaatcaacagcgagagaaaggccggcagctgccagcagggcagcggccccgccgccagcgccgccaccgccagcccccagctgagcagcgagatcgagaacctgatgagccagggctacagctaccaggacatccagaaggccctggtgatcgcccagaacaacatcgagatggccaagaacatcctgagagagttcgtgagcatcagcagccccgcccacgtggccacctag

SEQ ID NO: 75535 - DNA, 2949 bp, Artificial Sequence
  Description of Artificial Sequence: Synthetic coding sequence
atggccaacagcatgaacggcagaaaccccggcggcagaggcggcaaccccagaaagggcagaatcctgggcatcatcgacgccatccaggacgccgtgggcccccccaagcaggccgccgccgacagaagaaccgtggagaagacctggaagctgatggacaaggtggtgagactgtgccagaaccccaagctgcagctgaagaacagccccccctacatcctggacatcctgcccgacacctaccagcacctgagactgatcctgagcaagtacgacgacaaccagaagctggcccagctgagcgagaacgagtacttcaagatctacatcgacagcctgatgaagaagagcaagagagccatcagactgttcaaggagggcaaggagagaatgtacgaggagcagagccaggacagaagaaacctgaccaagctgagcctgatcttcagccacatgctggccgagatcaaggccatcttccccaacggccagttccagggcgacaacttcagaatcaccaaggccgacgccgccgagttctggagaaagttcttcggcgacaagaccatcgtgccctggaaggtgttcagacagtgcctgcacgaggtgcaccagatcagcagcggcctggaggccatggccctgaagagcaccatcgacctgacctgcaacgactacatcagcgtgttcgagttcgacatcttcaccagactgttccagccctggggcagcatcctgagaaactggaacttcctggccgtgacccaccccggctacatggccttcctgacctacgacgaggtgaaggccagactgcagaagtacagcaccaagcccggcagctacatcttcagactgagctgcaccagactgggccagtgggccatcggctacgtgaccggcgacggcaacatcctgcagaccatcccccacaacaagcccctgttccaggccctgatcgacggcagcagagagggcttctacctgtaccccgacggcagaagctacaaccccgacctgaccggcctgtgcgagcccaccccccacgaccacatcaaggtgacccaggagcagtacgagctgtactgcgagatgggcagcaccttccagctgtgcaagatctgcgccgagaacgacaaggacgtgaagatcgagccctgcggccacctgatgtgcaccagctgcctgaccgcctggcaggagagcgacggccagggctgccccttctgcagatgcgagatcaagggcaccgagcccatcatcgtggaccccttcgaccccagagacgagggcagcagatgctgcagcatcatcgaccccttcggcatgcccatgctggacctggacgacgacgacgacagagaggagagcctgatgatgaacagactggccaacgtgagaaagtgcaccgacagacagaacagccccgtgaccagccccggcagcagccccctggcccagagaagaaagccccagcccgaccccctgcagatcccccacctgagcctgccccccgtgccccccagactggacctgatccagaagggcatcgtgagaagcccctgcggcagccccaccggcagccccaagagcagcccctgcatggtgagaaagcaggacaagcccctgcccgccccccccccccccctgagagacccccccccccccccccccgagagacccccccccatcccccccgacaacagactgagcagacacatccaccacgtggagagcgtgcccagcagagacccccccatgcccctggaggcctggtgccccagagacgtgttcggcaccaaccagctggtgggctgcagactgctgggcgagggcagccccaagcccggcatcaccgccagcagcaacgtgaacggcagacacagcagagtgggcagcgaccccgtgctgatgagaaagcacagaagacacgacctgcccctggagggcgccaaggtgttcagcaacggccacctgggcagcgaggagtacgacgtgccccccagactgagcccccccccccccgtgaccaccctgctgcccagcatcaagtgcaccggccccctggccaacagcctgagcgagaagaccagagaccccgtggaggaggacgacgacgagtacaagatccccagcagccaccccgtgagcctgaacagccagcccagccactgccacaacgtgaagccccccgtgagaagctgcgacaacggccactgcatgctgaacggcacccacggccccagcagcgagaagaagagcaacatccccgacctgagcatctacctgaagggcgacgtgttcgacagcgccagcgaccccgtgcccctgccccccgccagaccccccaccagagacaaccccaagcacggcagcagcctgaacagaacccccagcgactacgacctgctgatcccccccctgggcgaggacgccttcgacgccctgccccccagcctgccccccccccccccccccgccagacacagcctgatcgagcacagcaagccccccggcagcagcagcagacccagcagcggccaggacctgttcctgctgcccagcgaccccttcgtggacctggccagcggccaggtgcccctgccccccgccagaagactgcccggcgagaacgtgaagaccaacagaaccagccaggactacgaccagctgcccagctgcagcgacggcagccaggcccccgccagaccccccaagcccagacccagaagaaccgcccccgagatccaccacagaaagccccacggccccgaggccgccctggagaacgtggacgccaagatcgccaagctgatgggcgagggctacgccttcgaggaggtgaagagagccctggagatcgcccagaacaacgtggaggtggccagaagcatcctgagagagttcgccttccccccccccgtgagccccagactgaacctgtag

SEQ ID NO: 75536 - DNA, 2883 bp, Artificial Sequence
  Description of Artificial Sequence: Synthetic coding sequence
atggccctggcccccggccccgacgcccacgcccacctgccccccctgatcgagctgaagttccagatggccaacagcatgaacggcagaaaccccggcggcagaggcggcaaccccagaaagggcagaatcctgggcatcatcgacgccatccaggacgccgtgggcccccccaagcaggccgccgccgacagaagaaccgtggagaagacctggaagctgatggacaaggtggtgagactgtgccagaaccccaagctgcagctgaagaacagccccccctacatcctggacatcctgcccgacacctaccagcacctgagactgatcctgagcaagtacgacgacaaccagaagctggcccagctgagcgagaacgagtacttcaagatctacatcgacagcctgatgaagaagagcaagagagccatcagactgttcaaggagggcaaggagagaatgtacgaggagcagagccaggacagaagaaacctgaccaagctgagcctgatcttcagccacatgctggccgagatcaaggccatcttccccaacggccagttccagggcgacaacttcagaatcaccaaggccgacgccgccgagttctggagaaagttcttcggcgacaagaccatcgtgccctggaaggtgttcagacagtgcctgcacgaggtgcaccagatcagcagcggcctggaggccatggccctgaagagcaccatcgacctgacctgcaacgactacatcagcgtgttcgagttcgacatcttcaccagactgttccagccctggggcagcatcctgagaaactggaacttcctggccgtgacccaccccggctacatggccttcctgacctacgacgaggtgaaggccagactgcagaagtacagcaccaagcccggcagctacatcttcagactgagctgcaccagactgggccagtgggccatcggctacgtgaccggcgacggcaacatcctgcagaccatcccccacaacaagcccctgttccaggccctgatcgacggcagcagagagggcttctacctgtaccccgacggcagaagctacaaccccgacctgaccggcctgtgcgagcccaccccccacgaccacatcaaggtgacccaggagcagtacgagctgtactgcgagatgggcagcaccttccagctgtgcaagatctgcgccgagaacgacaaggacgtgaagatcgagccctgcggccacctgatgtgcaccagctgcctgaccgcctggcaggagagcgacggccagggctgccccttctgcagatgcgagatcaagggcaccgagcccatcatcgtggaccccttcgaccccagagacgagggcagcagatgctgcagcatcatcgaccccttcggcatgcccatgctggacctggacgacgacgacgacagagaggagagcctgatgatgaacagactggccaacgtgagaaagtgcaccgacagacagaacagccccgtgaccagccccggcagcagccccctggcccagagaagaaagccccagcccgaccccctgcagatcccccacctgagcctgccccccgtgccccccagactggacctgatccagaagggcatcgtgagaagcccctgcggcagccccaccggcagccccaagagcagcccctgcatggtgagaaagcaggacaagcccctgcccgccccccccccccccctgagagacccccccccccccccccccgagagacccccccccatcccccccgacaacagactgagcagacacatccaccacgtggagagcgtgcccagcagagacccccccatgcccctggaggcctggtgccccagagacgtgttcggcaccaaccagctggtgggctgcagactgctgggcgagggcagccccaagcccggcatcaccgccagcagcaacgtgaacggcagacacagcagagtgggcagcgaccccgtgctgatgagaaagcacagaagacacgacctgcccctggagggcgccaaggtgttcagcaacggccacctgggcagcgaggagtacgacgtgccccccagactgagcccccccccccccgtgaccaccctgctgcccagcatcaagtgcaccggccccctggccaacagcctgagcgagaagaccagagaccccgtggaggaggacgacgacgagtacaagatccccagcagccaccccgtgagcctgaacagccagcccagccactgccacaacgtgaagccccccgtgagaagctgcgacaacggccactgcatgctgaacggcacccacggccccagcagcgagaagaagagcaacatccccgacctgagcatctacctgaagggcgaggacgccttcgacgccctgccccccagcctgccccccccccccccccccgccagacacagcctgatcgagcacagcaagccccccggcagcagcagcagacccagcagcggccaggacctgttcctgctgcccagcgaccccttcgtggacctggccagcggccaggtgcccctgccccccgccagaagactgcccggcgagaacgtgaagaccaacagaaccagccaggactacgaccagctgcccagctgcagcgacggcagccaggcccccgccagaccccccaagcccagacccagaagaaccgcccccgagatccaccacagaaagccccacggccccgaggccgccctggagaacgtggacgccaagatcgccaagctgatgggcgagggctacgccttcgaggaggtgaagagagccctggagatcgcccagaacaacgtggaggtggccagaagcatcctgagagagttcgccttccccccccccgtgagccccagactgaacctgtag

SEQ ID NO: 75537 - DNA, 2313 bp, Artificial Sequence
  Description of Artificial Sequence: Synthetic coding sequence
atggccaacagcatgaacggcagaaaccccggcggcagaggcggcaaccccagaaagggcagaatcctgggcatcatcgacgccatccaggacgccgtgggcccccccaagcaggccgccgccgacagaagaaccgtggagaagacctggaagctgatggacaaggtggtgagactgtgccagaaccccaagctgcagctgaagaacagccccccctacatcctggacatcctgcccgacacctaccagcacctgagactgatcctgagcaagtacgacgacaaccagaagctggcccagctgagcgagaacgagtacttcaagatctacatcgacagcctgatgaagaagagcaagagagccatcagactgttcaaggagggcaaggagagaatgtacgaggagcagagccaggacagaagaaacctgaccaagctgagcctgatcttcagccacatgctggccgagatcaaggccatcttccccaacggccagttccagggcgacaacttcagaatcaccaaggccgacgccgccgagttctggagaaagttcttcggcgacaagaccatcgtgccctggaaggtgttcagacagtgcctgcacgaggtgcaccagatcagcagcggcctggaggccatggccctgaagagcaccatcgacctgacctgcaacgactacatcagcgtgttcgagttcgacatcttcaccagactgttccagccctggggcagcatcctgagaaactggaacttcctggccgtgacccaccccggctacatggccttcctgacctacgacgaggtgaaggccagactgcagaagtacagcaccaagcccggcagctacatcttcagactgagctgcaccagactgggccagtgggccatcggctacgtgaccggcgacggcaacatcctgcagaccatcccccacaacaagcccctgttccaggccctgatcgacggcagcagagagggcttctacctgtaccccgacggcagaagctacaaccccgacctgaccggcctgtgcgagcccaccccccacgaccacatcaaggtgacccaggagcagtacgagctgtactgcgagatgggcagcaccttccagctgtgcaagatctgcgccgagaacgacaaggacgtgaagatcgagccctgcggccacctgatgtgcaccagctgcctgaccgcctggcaggagagcgacggccagggctgccccttctgcagatgcgagatcaagggcaccgagcccatcatcgtggaccccttcgaccccagagacgagggcagcagatgctgcagcatcatcgaccccttcggcatgcccatgctggacctggacgacgacgacgacagagaggagagcctgatgatgaacagactggccaacgtgagaaagtgcaccgacagacagaacagccccgtgaccagccccggcagcagccccctggcccagagaagaaagccccagcccgaccccctgcagatcccccacctgagcctgccccccgtgccccccagactggacctgatccagaagggcatcgtgagaagcccctgcggcagccccaccggcagccccaagagcagcccctgcatggtgagaaagcaggacaagcccctgcccgccccccccccccccctgagagacccccccccccccccccccgagagacccccccccatcccccccgacaacagactgagcagacacatccaccacgtggagagcgtgcccagcagagacccccccatgcccctggaggcctggtgccccagagacgtgttcggcaccaaccagctggtgggctgcagactgctgggcgagggcagccccaagcccggcatcaccgccagcagcaacgtgaacggcagacacagcagagtgggcagcgaccccgtgctgatgagaaagcacagaagacacgacctgcccctggagggcgccaaggtgttcagcaacggccacctgggcagcgaggagtacgacgtgccccccagactgagcccccccccccccgtgaccaccctgctgcccagcatcaagtgcaccggccccctggccaacagcctgagcgagaagaccagagaccccgtggaggaggacgacgacgagtacaagatccccagcagccaccccgtgagcctgaacagccagcccagccactgccacaacgtgaagccccccgtgagaagctgcgacaacggccactgcatgctgaacggcacccacggccccagcagcgagaagaagagcaacatccccgacctgagcatctacctgaagggcacctacagaatctag

SEQ ID NO: 75538 - DNA, 2433 bp, Artificial Sequence
  Description of Artificial Sequence: Synthetic coding sequence
atggccaacagcatgaacggcagaaaccccggcggcagaggcggcaaccccagaaagggcagaatcctgggcatcatcgacgccatccaggacgccgtgggcccccccaagcaggccgccgccgacagaagaaccgtggagaagacctggaagctgatggacaaggtggtgagactgtgccagaaccccaagctgcagctgaagaacagccccccctacatcctggacatcctgcccgacacctaccagcacctgagactgatcctgagcaagtacgacgacaaccagaagctggcccagctgagcgagaacgagtacttcaagatctacatcgacagcctgatgaagaagagcaagagagccatcagactgttcaaggagggcaaggagagaatgtacgaggagcagagccaggacagaagaaacctgaccaagctgagcctgatcttcagccacatgctggccgagatcaaggccatcttccccaacggccagttccagggcgacaacttcagaatcaccaaggccgacgccgccgagttctggagaaagttcttcggcgacaagaccatcgtgccctggaaggtgttcagacagtgcctgcacgaggtgcaccagatcagcagcggcctggaggccatggccctgaagagcaccatcgacctgacctgcaacgactacatcagcgtgttcgagttcgacatcttcaccagactgttccagccctggggcagcatcctgagaaactggaacttcctggccgtgacccaccccggctacatggccttcctgacctacgacgaggtgaaggccagactgcagaagtacagcaccaagcccggcagctacatcttcagactgagctgcaccagactgggccagtgggccatcggctacgtgaccggcgacggcaacatcctgcagaccatcccccacaacaagcccctgttccaggccctgatcgacggcagcagagagggcttctacctgtaccccgacggcagaagctacaaccccgacctgaccggcctgtgcgagcccaccccccacgaccacatcaaggtgacccaggagcagtacgagctgtactgcgagatgggcagcaccttccagctgtgcaagatctgcgccgagaacgacaaggacgtgaagatcgagccctgcggccacctgatgtgcaccagctgcctgaccgcctggcaggagagcgacggccagggctgccccttctgcagatgcgagatcaagggcaccgagcccatcatcgtggaccccttcgaccccagagacgagggcagcagatgctgcagcatcatcgaccccttcggcatgcccatgctggacctggacgacgacgacgacagagaggagagcctgatgatgaacagactggccaacgtgagaaagtgcaccgacagacagaacagccccgtgaccagccccggcagcagccccctggcccagagaagaaagccccagcccgaccccctgcagatcccccacctgagcctgccccccgtgccccccagactggacctgatccagaagggcatcgtgagaagcccctgcggcagccccaccggcagccccaagagcagcccctgcatggtgagaaagcaggacaagcccctgcccgccccccccccccccctgagagacccccccccccccccccccgagagacccccccccatcccccccgacaacagactgagcagacacatccaccacgtggagagcgtgcccagcagagacccccccatgcccctggaggcctggtgccccagagacgtgttcggcaccaaccagctggtgggctgcagactgctgggcgagggcagccccaagcccggcatcaccgccagcagcaacgtgaacggcagacacagcagagtgggcagcgaccccgtgctgatgagaaagcacagaagacacgacctgcccctggagggcgccaaggtgttcagcaacggccacctgggcagcgaggagtacgacgtgccccccagactgagcccccccccccccgtgaccaccctgctgcccagcatcaagtgcaccggccccctggccaacagcctgagcgagaagaccagagaccccgtggaggaggacgacgacgagtacaagatccccagcagccaccccgtgagcctgaacagccagcccagccactgccacaacgtgaagccccccgtgagaagctgcgacaacggccactgcatgctgaacggcacccacggccccagcagcgagaagaagagcaacatccccgacctgagcatctacctgaagggcgacgtgttcgacagcgccagcgaccccgtgcccctgccccccgccagaccccccaccagagacaaccccaagcacggcagcagcctgaacagaacccccagcgactacgacctgctgatcccccccctgggctag

SEQ ID NO: 75539 - DNA, 420 bp, Artificial Sequence
  Description of Artificial Sequence: Synthetic coding sequence
atggccaacagcatgaacggcagaaaccccggcggcagaggcggcaaccccagaaagggcagaatcctgggcatcatcgacgccatccaggacgccgtgggcccccccaagcaggccgccgccgacagaagaaccgtggagaagacctggaagctgatggacaaggtggtgagactgtgccagaaccccaagctgcagctgaagaacagccccccctacatcctggacatcctgcccgacacctaccagcacctgagactgatcctgagcaagtacgacgacaaccagaagctggcccagctgagcgagaacgagtacttcaagatctacatcgacagcctgatgaagaagagcaagagagccatcagactgttcaaggagggcaaggagagaatgtacgaggagcagagccaggactag

SEQ ID NO: 75540 - DNA, 684 bp, Artificial Sequence
  Description of Artificial Sequence: Synthetic coding sequence
atggccctggcccccggccccgacgcccacgcccacctgccccccctgatcgagctgaagttccagatggccaacagcatgaacggcagaaaccccggcggcagaggcggcaaccccagaaagggcagaatcctgggcatcatcgacgccatccaggacgccgtgggcccccccaagcaggccgccgccgacagaagaaccgtggagaagacctggaagctgatggacaaggtggtgagactgtgccagaaccccaagctgcagctgaagaacagccccccctacatcctggacatcctgcccgacacctaccagcacctgagactgatcctgagcaagtacgacgacaaccagaagctggcccagctgagcgagaacgagtacttcaagatctacatcgacagcctgatgaagaagagcaagagagccatcagactgttcaaggagggcaaggagagaatgtacgaggagcagagccaggacagaaccatcgtgccctggaaggtgttcagacagtgcctgcacgaggtgcaccagatcagcagcggcctggaggccatggccctgaagagcaccatcgacctgacctgcaacgactacatcagcgtgttcgagttcgacatcttcaccagactgttccaggtgagcgacaacttcaccgagtacctgatctacctgacctag

SEQ ID NO: 75541 - DNA, 1425 bp, Artificial Sequence
  Description of Artificial Sequence: Synthetic coding sequence
atggccctggccgtggccccctggggcagacagtgggaggaggccagagccctgggcagagccgtgagaatgctgcagagactggaggagcagtgcgtggaccccagactgagcgtgagcccccccagcctgagagacctgctgcccagaaccgcccagctgctgagagaggtggcccacagcagaagagccgccggcggcggcggccccggcggccccggcggcagcggcgacttcctgctgatctacctggccaacctggaggccaagagcagacaggtggccgccctgctgccccccagaggcagaagaagcgccaacgacgagctgttcagagccggcagcagactgagaagacagctggccaagctggccatcatcttcagccacatgcacgccgagctgcacgccctgttccccggcggcaagtactgcggccacatgtaccagctgaccaaggcccccgcccacaccttctggagagagagctgcggcgccagatgcgtgctgccctgggccgagttcgagagcctgctgggcacctgccaccccgtggagcccggctgcaccgccctggccctgagaaccaccatcgacctgacctgcagcggccacgtgagcatcttcgagttcgacgtgttcaccagactgttccagccctggcccaccctgctgaagaactggcagctgctggccgtgaaccaccccggctacatggccttcctgacctacgacgaggtgcaggagagactgcaggcctgcagagacaagcccggcagctacatcttcagacccagctgcaccagactgggccagtgggccatcggctacgtgagcagcgacggcagcatcctgcagaccatccccgccaacaagcccctgagccaggtgctgctggagggccagaaggacggcttctacctgtaccccgacggcaagacccacaaccccgacctgaccgagctgggccaggccgagccccagcagagaatccacgtgagcgaggagcagctgcagctgtactgggccatggacagcaccttcgagctgtgcaagatctgcgccgagagcaacaaggacgtgaagatcgagccctgcggccacctgctgtgcagctgctgcctggccgcctggcagcacagcgacagccagacctgccccttctgcagatgcgagatcaagggctgggaggccgtgagcatctaccagttccacggccaggccaccgccgaggacagcggcaacagcagcgaccaggagggcagagagctggagctgggccaggtgcccctgagcgccccccccctgccccccagacccgacctgccccccagaaagcccagaaacgcccagcccaaggtgagactgctgaagggcaacagcccccccgccgccctgggcccccaggaccccgcccccgcctag

SEQ ID NO: 75542 - DNA, 1287 bp, Artificial Sequence
  Description of Artificial Sequence: Synthetic coding sequence
atggccctggccgtggccccctggggcagacagtgggaggaggccagagccctgggcagagccgtgagaatgctgcagagactggaggagcagtgcgtggaccccagactgagcgtgagcccccccagcctgagagacctgctgcccagaaccgcccagctgctgagagaggtggcccacagcagaagagccgccggcggcggcggccccggcggccccggcggcagcggcgacttcctgctgatctacctggccaacctggaggccaagagcagacaggtggccgccctgctgccccccagaggcagaagaagcgccaacgacgagctgttcagagccggcagcagactgagaagacagctggccaagctggccatcatcttcagccacatgcacgccgagctgcacgccctgttccccggcggcaagtactgcggccacatgtaccagctgaccaaggcccccgcccacaccttctggagagagagctgcggcgccagatgcgtgctgccctgggccgagttcgagagcctgctgggcacctgccaccccgtggagcccggctgcaccgccctggccctgagaaccaccatcgacctgacctgcagcggccacgtgagcatcttcgagttcgacgtgttcaccagactgttccagccctggcccaccctgctgaagaactggcagctgctggccgtgaaccaccccggctacatggccttcctgacctacgacgaggtgcaggagagactgcaggcctgcagagacaagcccggcagctacctgtaccccgacggcaagacccacaaccccgacctgaccgagctgggccaggccgagccccagcagagaatccacgtgagcgaggagcagctgcagctgtactgggccatggacagcaccttcgagctgtgcaagatctgcgccgagagcaacaaggacgtgaagatcgagccctgcggccacctgctgtgcagctgctgcctggccgcctggcagcacagcgacagccagacctgccccttctgcagatgcgagatcaagggctgggaggccgtgagcatctaccagttccacggccaggccaccgccgaggacagcggcaacagcagcgaccaggagggcagagagctggagctgggccaggtgcccctgagcgccccccccctgccccccagacccgacctgccccccagaaagcccagaaacgcccagcccaaggtgagactgctgaagggcaacagcccccccgccgccctgggcccccaggaccccgcccccgcctag

SEQ ID NO: 75543 - DNA, 2355 bp, Artificial Sequence
  Description of Artificial Sequence: Synthetic coding sequence
atgagcgaccagaagaaggaggaggaggaggaggccgccgccgccgccgccatggccaccgagggcggcaagaccagcgagcccgagaacaacaacaagaagcccaagaccagcggcagccaggacagccagcccagccccctggccctgctggccgccacctgcagcaagatcggcacccccggcgagaaccaggccaccggccagcagcagatcatcatcgaccccagccagggcctggtgcagctgcagaaccagccccagcagctggagctggtgaccacccagctggccggcaacgcctggcagctggtggccagcaccccccccgccagcaaggagaacaacgtgagccagcccgccagcagcagcagcagcagcagcagcagcaacaacggcagcgccagccccaccaagaccaagagcggcaacagcagcacccccggccagttccaggtgatccaggtgcagaaccccagcggcagcgtgcagtaccaggtgatcccccagctgcagaccgtggagggccagcagatccagatcaaccccaccagcagcagcagcctgcaggacctgcagggccagatccagctgatcagcgccggcaacaaccaggccatcctgaccgccgccaacagaaccgccagcggcaacatcctggcccagaacctggccaaccagaccgtgcccgtgcagatcagacccggcgtgagcatccccctgcagctgcagaccctgcccggcacccaggcccaggtggtgaccaccctgcccatcaacatcggcggcgtgaccctggccctgcccgtgatcaacaacgtggccgccggcggcggcaccggccaggtgggccagcccgccgccaccgccgacagcggcaccagcaacggcaaccagctggtgagcacccccaccaacaccaccaccagcgccagcaccatgcccgagagccccagcagcagcaccacctgcaccaccaccgccagcaccagcctgaccagcagcgacaccctggtgagcagcgccgacaccggccagtacgccagcaccagcgccagcagcagcgagagaaccatcgaggagagccagacccccgccgccaccgagagcgaggcccagagcagcagccagctgcagcccaacggcatgcagaacgcccaggaccagagcaacagcctgcagcaggtgcagatcgtgggccagcccatcctgcagcagatccagatccagcagccccagcagcagatcatccaggccatccccccccagagcttccagctgcagagcggccagaccatccagaccatccagcagcagcccctgcagaacgtgcagctgcaggccgtgaaccccacccaggtgctgatcagagcccccaccctgacccccagcggccagatcagctggcagaccgtgcaggtgcagaacatccagagcctgagcaacctgcaggtgcagaacgccggcctgagccagcagctgaccatcacccccgtgagcagcagcggcggcaccaccctggcccagatcgcccccgtggccgtggccggcgcccccatcaccctgaacaccgcccagctggccagcgtgcccaacctgcagaccgtgagcgtggccaacctgggcgccgccggcgtgcaggtgcagggcgtgcccgtgaccatcaccagcgtggccggccagcagcagggccaggacggcgtgaaggtgcagcaggccaccatcgcccccgtgaccgtggccgtgggcggcatcgccaacgccaccatcggcgccgtgagccccgaccagctgacccaggtgcacctgcagcagggccagcagaccagcgaccaggaggtgcagcccggcaagagactgagaagagtggcctgcagctgccccaactgcagagagggcgagggcagaggcagcaacgagcccggcaagaagaagcagcacatctgccacatcgagggctgcggcaaggtgtacggcaagaccagccacctgagagcccacctgagatggcacaccggcgagagacccttcatctgcaactggatgttctgcggcaagagattcaccagaagcgacgagctgcagagacacagaagaacccacaccggcgagaagagattcgagtgccccgagtgcagcaagagattcatgagaagcgaccacctgagcaagcacgtgaagacccaccagaacaagaagggcggcggcaccgccctggccatcgtgaccagcggcgagctggacagcagcgtgaccgaggtgctgggcagccccagaatcgtgaccgtggccgccatcagccaggacagcaaccccgccacccccaacgtgagcaccaacatggaggagttctag

SEQ ID NO: 75544 - DNA, 1476 bp, Artificial Sequence
  Description of Artificial Sequence: Synthetic coding sequence
atggaccacaccgacaacgagctgcagggcaccaacagcagcggcagcctgggcggcctggacgtgagaagaagaatccccatcaagctgatcagcaagcaggccaacaaggccaagcccgcccccagaacccagagaaccatcaacagaatgcccgccaaggccccccccggcgacgaggagggcttcgactacaacgaggaggagagatacgactgcaagggcggcgagctgttcgccaaccagagaagattccccggccacctgttctgggacttccagatcaacatcctgggcgagaaggacgacacccccgtgcacttctgcgacaagtgcggcctgcccatcaagatctacggcagaatgatcccctgcaagcacgtgttctgctacgactgcgccatcctgcacgagaagaagggcgacaagatgtgccccggctgcagcgaccccgtgcagagaatcgagcagtgcaccagaggcagcctgttcatgtgcagcatcgtgcagggctgcaagagaacctacctgagccagagagacctgcaggcccacatcaaccacagacacatgagagccggcaagcccgtgaccagagccagcctggagaacgtgcacccccccatcgcccccccccccaccgagatccccgagagattcatcatgccccccgacaagcaccacatgagccacatcccccccaagcagcacatcatgatgccccccccccccctgcagcacgtgccccacgagcactacaaccagccccacgaggacatcagagccccccccgccgagctgagcatggccccccccccccccagaagcgtgagccaggagaccttcagaatcagcaccagaaagcacagcaacctgatcaccgtgcccatccaggacgacagcaacagcggcgccagagagccccccccccccgcccccgcccccgcccaccaccaccccgagtaccagggccagcccgtggtgagccacccccaccacatcatgcccccccagcagcactacgccccccccccccccccccccccccccatcagccaccccatgccccaccccccccaggccgccggcaccccccacctggtgtacagccaggccccccccccccccatgaccagcgcccccccccccatcacccccccccccggccacatcatcgcccagatgcccccctacatgaaccaccccccccccggccccccccccccccagcacggcggcccccccgtgaccgccccccccccccaccactacaaccccaacagcctgccccagttcaccgaggaccagggcaccctgagcccccccttcacccagcccggcggcatgagccccggcatctggcccgcccccagaggccccccccccccccccagactgcagggcccccccagccagacccccctgcccggcccccaccaccccgaccagaccagatacagaccctactaccagtag

SEQ ID NO: 75545 - DNA, 1113 bp, Artificial Sequence
  Description of Artificial Sequence: Synthetic coding sequence
atgatcccctgcaagcacgtgttctgctacgactgcgccatcctgcacgagaagaagggcgacaagatgtgccccggctgcagcgaccccgtgcagagaatcgagcagtgcaccagaggcagcctgttcatgtgcagcatcgtgcagggctgcaagagaacctacctgagccagagagacctgcaggcccacatcaaccacagacacatgagagccggcaagcccgtgaccagagccagcctggagaacgtgcacccccccatcgcccccccccccaccgagatccccgagagattcatcatgccccccgacaagcaccacatgagccacatcccccccaagcagcacatcatgatgccccccccccccctgcagcacgtgccccacgagcactacaaccagccccacgaggacatcagagccccccccgccgagctgagcatggccccccccccccccagaagcgtgagccaggagaccttcagaatcagcaccagaaagcacagcaacctgatcaccgtgcccatccaggacgacagcaacagcggcgccagagagccccccccccccgcccccgcccccgcccaccaccaccccgagtaccagggccagcccgtggtgagccacccccaccacatcatgcccccccagcagcactacgccccccccccccccccccccccccccatcagccaccccatgccccaccccccccaggccgccggcaccccccacctggtgtacagccaggccccccccccccccatgaccagcgcccccccccccatcacccccccccccggccacatcatcgcccagatgcccccctacatgaaccaccccccccccggccccccccccccccagcacggcggcccccccgtgaccgccccccccccccaccactacaaccccaacagcctgccccagttcaccgaggaccagggcaccctgagcccccccttcacccagcccggcggcatgagccccggcatctggcccgcccccagaggccccccccccccccccagactgcagggcccccccagccagacccccctgcccggcccccaccaccccgaccagaccagatacagaccctactaccagtag

SEQ ID NO: 75546 - DNA, 681 bp, Artificial Sequence
  Description of Artificial Sequence: Synthetic coding sequence
atgaaggtgctgatcctggcctgcctggtggccctggccctggccagagagaccatcgagagcctgagcagcagcgaggagagcatcaccgagtacaagcagaaggtggagaaggtgaagcacgaggaccagcagcagggcgaggacgagcaccaggacaagatctaccccagcttccagccccagcccctgatctaccccttcgtggagcccatcccctacggcttcctgccccagaacatcctgcccctggcccagcccgccgtggtgctgcccgtgccccagcccgagatcatggaggtgcccaaggccaaggacaccgtgtacaccaagggcagagtgatgcccgtgctgaagagccccaccatccccttcttcgacccccagatccccaagctgaccgacctggagaacctgcacctgcccctgcccctgctgcagcccctgatgcagcaggtgccccagcccatcccccagaccctggccctgcccccccagcccctgtggagcgtgccccagcccaaggtgctgcccatcccccagcaggtggtgccctacccccagagagccgtgcccgtgcaggccctgctgctgaaccaggagctgctgctgaaccccacccaccagatctaccccgtgacccagcccctggcccccgtgcacaaccccatcagcgtgtag

SEQ ID NO: 75547 - DNA, 549 bp, Artificial Sequence
  Description of Artificial Sequence: Synthetic coding sequence
atgaagagcttcctgctggtggtgaacgccctggccctgaccctgcccttcctggccgtggaggtgcagaaccagaagcagcccgcctgccacgagaacgacgagagacccttctaccagaagaccgccccctacgtgcccatgtactacgtgcccaacagctacccctactacggcaccaacctgtaccagagaagacccgccatcgccatcaacaacccctacgtgcccagaacctactacgccaaccccgccgtggtgagaccccacgcccagatcccccagagacagtacctgcccaacagccacccccccaccgtggtgagaagacccaacctgcaccccagcttcatcgccatcccccccaagaagatccaggacaagatcatcatccccaccatcaacaccatcgccaccgtggagcccacccccgcccccgccaccgagcccaccgtggacagcgtggtgacccccgaggccttcagcgagagcatcatcaccagcacccccgagaccaccaccgtggccgtgaccccccccaccgcctag

SEQ ID NO: 75548 - DNA, 978 bp, Artificial Sequence
  Description of Artificial Sequence: Synthetic coding sequence
atggccagcagcagcggcagcaaggccgagttcatcgtgggcggcaagtacaagctggtgagaaagatcggcagcggcagcttcggcgacatctacctggccatcaacatcaccaacggcgaggaggtggccgtgaagctggagagccagaaggccagacacccccagctgctgtacgagagcaagctgtacaagatcctgcagggcggcgtgggcatcccccacatcagatggtacggccaggagaaggactacaacgtgctggtgatggacctgctgggccccagcctggaggacctgttcaacttctgcagcagaagattcaccatgaagaccgtgctgatgctggccgaccagatgatcagcagaatcgagtacgtgcacaccaagaacttcatccacagagacatcaagcccgacaacttcctgatgggcatcggcagacactgcaacaagctgttcctgatcgacttcggcctggccaagaagtacagagacaacagaaccagacagcacatcccctacagagaggacaagaacctgaccggcaccgccagatacgccagcatcaacgcccacctgggcatcgagcagagcagaagagacgacatggagagcctgggctacgtgctgatgtacttcaacagaaccagcctgccctggcagggcctgaaggccgccaccaagaagcagaagtacgagaagatcagcgagaagaagatgagcacccccgtggaggtgctgtgcaagggcttccccgccgagttcgccatgtacctgaactactgcagaggcctgagattcgaggaggcccccgactacatgtacctgagacagctgttcagaatcctgttcagaaccctgaaccaccagtacgactacaccttcgactggaccatgctgaagcagaaggccgcccagcaggccgccagcagcagcggccagggccagcaggcccagacccccaccggcttctag

SEQ ID NO: 75549 - DNA, 978 bp, Artificial Sequence; identical to SEQ ID NO: 75548
  Description of Artificial Sequence: Synthetic coding sequence

SEQ ID NO: 75550 - DNA, 1014 bp, Artificial Sequence
  Description of Artificial Sequence: Synthetic coding sequence
atggccagcagcagcggcagcaaggccgagttcatcgtgggcggcaagtacaagctggtgagaaagatcggcagcggcagcttcggcgacatctacctggccatcaacatcaccaacggcgaggaggtggccgtgaagctggagagccagaaggccagacacccccagctgctgtacgagagcaagctgtacaagatcctgcagggcggcgtgggcatcccccacatcagatggtacggccaggagaaggactacaacgtgctggtgatggacctgctgggccccagcctggaggacctgttcaacttctgcagcagaagattcaccatgaagaccgtgctgatgctggccgaccagatgatcagcagaatcgagtacgtgcacaccaagaacttcatccacagagacatcaagcccgacaacttcctgatgggcatcggcagacactgcaacaagctgttcctgatcgacttcggcctggccaagaagtacagagacaacagaaccagacagcacatcccctacagagaggacaagaacctgaccggcaccgccagatacgccagcatcaacgcccacctgggcatcgagcagagcagaagagacgacatggagagcctgggctacgtgctgatgtacttcaacagaaccagcctgccctggcagggcctgaaggccgccaccaagaagcagaagtacgagaagatcagcgagaagaagatgagcacccccgtggaggtgctgtgcaagggcttccccgccgagttcgccatgtacctgaactactgcagaggcctgagattcgaggaggcccccgactacatgtacctgagacagctgttcagaatcctgttcagaaccctgaaccaccagtacgactacaccttcgactggaccatgctgaagcagaaggccgcccagcaggccgccagcagcagcggccagggccagcaggcccagacccccaccggcaagcagaccgacaagaccaagagcaacatgaagggcttctag

SEQ ID NO: 75551 - DNA, 1098 bp, Artificial Sequence
  Description of Artificial Sequence: Synthetic coding sequence
atggccagcagcagcggcagcaaggccgagttcatcgtgggcggcaagtacaagctggtgagaaagatcggcagcggcagcttcggcgacatctacctggccatcaacatcaccaacggcgaggaggtggccgtgaagctggagagccagaaggccagacacccccagctgctgtacgagagcaagctgtacaagatcctgcagggcggcgtgggcatcccccacatcagatggtacggccaggagaaggactacaacgtgctggtgatggacctgctgggccccagcctggaggacctgttcaacttctgcagcagaagattcaccatgaagaccgtgctgatgctggccgaccagatgatcagcagaatcgagtacgtgcacaccaagaacttcatccacagagacatcaagcccgacaacttcctgatgggcatcggcagacactgcaacaagtgcctggagagccccgtgggcaagagaaagagaagcatgaccgtgagcaccagccaggaccccagcttcagcggcctgaaccagctgttcctgatcgacttcggcctggccaagaagtacagagacaacagaaccagacagcacatcccctacagagaggacaagaacctgaccggcaccgccagatacgccagcatcaacgcccacctgggcatcgagcagagcagaagagacgacatggagagcctgggctacgtgctgatgtacttcaacagaaccagcctgccctggcagggcctgaaggccgccaccaagaagcagaagtacgagaagatcagcgagaagaagatgagcacccccgtggaggtgctgtgcaagggcttccccgccgagttcgccatgtacctgaactactgcagaggcctgagattcgaggaggcccccgactacatgtacctgagacagctgttcagaatcctgttcagaaccctgaaccaccagtacgactacaccttcgactggaccatgctgaagcagaaggccgcccagcaggccgccagcagcagcggccagggccagcaggcccagacccccaccggcaagcagaccgacaagaccaagagcaacatgaagggcttctag

SEQ ID NO: 75552 - DNA, 1029 bp, Artificial Sequence
  Description of Artificial Sequence: Synthetic coding sequence
tgcagagaggagatcagcagaatcgagtacatccacagcaagaacttcatccacagagacgtgaagcccgacaacttcctgatgggcctgggcaagaagggcaacctggtgtacatcatcgacttcggcctggccaagaagtacagagacgccagaacccaccagcacatcccctacagagagaacaagaacctgaccggcaccgccagatacgccagcatcaacacccacctgggcatcgagcagagcagaagagacgacctggagagcctgggctacgtgctgatgtacttcaacctgggcagcctgccctggcagggcctgaaggccgccaccaagagacagaagtacgagagaatcagcgagaagaagatgagcacccccatcgaggtgctgtgcaagggctaccccagcgagttcgccacctacctgaacttctgcagaagcctgagattcgacgacaagcccgactacagctacctgagacagctgttcagaaacctgttccacagacagggcttcagctacgactacgtgttcgactggaacatgctgaagttcggcgccagcagagccgccgacgacgccgagagagagagaagagacagagaggagagactgagacacagcagaaaccccgccaccagaggcctgcccagcaccgccagcggcagactgagaggcacccaggaggtggccccccccacccccctgacccccaccagccacaccgccaacaccagccccagacccgtgagcggcatggagagagagagaaaggtgagcatgagactgcacagaggcgcccccgtgaacatcagcagcagcgacctgaccggcagacaggacaccagcagaatgagcaccagccaggtgggcgccgagctgcccggcggcagatgggccagcggctaccccgtgagagtgaagagcggcctgtggttcctgcagggcttcttcttccccttcttcccccccttcctgagagtgttcaacctggccagagtgtggagactgggctgcagatag

SEQ ID NO: 75553 - DNA, 1248 bp, Artificial Sequence
  Description of Artificial Sequence: Synthetic coding sequence
atggagctgagagtgggcaacagatacagactgggcagaaagatcggcagcggcagcttcggcgacatctacctgggcaccgacatcgccgccggcgaggaggtggccatcaagctggagtgcgtgaagaccaagcacccccagctgcacatcgagagcaagatctacaagatgatgcagggcggcgtgggcatccccaccatcagatggtgcggcgccgagggcgactacaacgtgatggtgatggagctgctgggccccagcctggaggacctgttcaacttctgcagcagaaagttcagcctgaagaccgtgctgctgctggccgaccagatgatcagcagaatcgagtacatccacagcaagaacttcatccacagagacgtgaagcccgacaacttcctgatgggcctgggcaagaagggcaacctggtgtacatcatcgacttcggcctggccaagaagtacagagacgccagaacccaccagcacatcccctacagagagaacaagaacctgaccggcaccgccagatacgccagcatcaacacccacctgggcatcgagcagagcagaagagacgacctggagagcctgggctacgtgctgatgtacttcaacctgggcagcctgccctggcagggcctgaaggccgccaccaagagacagaagtacgagagaatcagcgagaagaagatgagcacccccatcgaggtgctgtgcaagggctaccccagcgagttcgccacctacctgaacttctgcagaagcctgagattcgacgacaagcccgactacagctacctgagacagctgttcagaaacctgttccacagacagggcttcagctacgactacgtgttcgactggaacatgctgaagttcggcgccagcagagccgccgacgacgccgagagagagagaagagacagagaggagagactgagacacagcagaaaccccgccaccagaggcctgcccagcaccgccagcggcagactgagaggcacccaggaggtggccccccccacccccctgacccccaccagccacaccgccaacaccagccccagacccgtgagcggcatggagagagagagaaaggtgagcatgagactgcacagaggcgcccccgtgaacatcagcagcagcgacctgaccggcagacaggacaccagcagaatgagcaccagccagatccccggcagagtggccagcagcggcctgcagagcgtggtgcacagatag

SEQ ID NO: 75554 - DNA, 1230 bp, Artificial Sequence
  Description of Artificial Sequence: Synthetic coding sequence
atggagctgagagtgggcaacagatacagactgggcagaaagatcggcagcggcagcttcggcgacatctacctgggcaccgacatcgccgccggcgaggaggtggccatcaagctggagtgcgtgaagaccaagcacccccagctgcacatcgagagcaagatctacaagatgatgcagggcggcgtgggcatccccaccatcagatggtgcggcgccgagggcgactacaacgtgatggtgatggagctgctgggccccagcctggaggacctgttcaacttctgcagcagaaagttcagcctgaagaccgtgctgctgctggccgaccagatgatcagcagaatcgagtacatccacagcaagaacttcatccacagagacgtgaagcccgacaacttcctgatgggcctgggcaagaagggcaacctggtgtacatcatcgacttcggcctggccaagaagtacagagacgccagaacccaccagcacatcccctacagagagaacaagaacctgaccggcaccgccagatacgccagcatcaacacccacctgggcatcgagcagagcagaagagacgacctggagagcctgggctacgtgctgatgtacttcaacctgggcagcctgccctggcagggcctgaaggccgccaccaagagacagaagtacgagagaatcagcgagaagaagatgagcacccccatcgaggtgctgtgcaagggctaccccagcgagttcgccacctacctgaacttctgcagaagcctgagattcgacgacaagcccgactacagctacctgagacagctgttcagaaacctgttccacagacagggcttcagctacgactacgtgttcgactggaacatgctgaagttcggcgccagcagagccgccgacgacgccgagagagagagaagagacagagaggagagactgagacacagcagaaaccccgccaccagaggcctgcccagcaccgccagcggcagactgagaggcacccaggaggtggccccccccacccccctgacccccaccagccacaccgccaacaccagccccagacccgtgagcggcatggagagagagagaaaggtgagcatgagactgcacagaggcgcccccgtgaacatcagcagcagcgacctgaccggcagacaggacaccagcagaatgagcaccagccagaacagcatccccttcgagcaccacggcaagtag

SEQ ID NO: 75555 - DNA, 1077 bp, Artificial Sequence
  Description of Artificial Sequence: Synthetic coding sequence
atgatgcagggcggcgtgggcatccccaccatcagatggtgcggcgccgagggcgactacaacgtgatggtgatggagctgctgggccccagcctggaggacctgttcaacttctgcagcagaaagttcagcctgaagaccgtgctgctgctggccgaccagatgatcagcagaatcgagtacatccacagcaagaacttcatccacagagacgtgaagcccgacaacttcctgatgggcctgggcaagaagggcaacctggtgtacatcatcgacttcggcctggccaagaagtacagagacgccagaacccaccagcacatcccctacagagagaacaagaacctgaccggcaccgccagatacgccagcatcaacacccacctgggcatcgagcagagcagaagagacgacctggagagcctgggctacgtgctgatgtacttcaacctgggcagcctgccctggcagggcctgaaggccgccaccaagagacagaagtacgagagaatcagcgagaagaagatgagcacccccatcgaggtgctgtgcaagggctaccccagcgagttcgccacctacctgaacttctgcagaagcctgagattcgacgacaagcccgactacagctacctgagacagctgttcagaaacctgttccacagacagggcttcagctacgactacgtgttcgactggaacatgctgaagttcggcgccagcagagccgccgacgacgccgagagagagagaagagacagagaggagagactgagacacagcagaaaccccgccaccagaggcctgcccagcaccgccagcggcagactgagaggcacccaggaggtggccccccccacccccctgacccccaccagccacaccgccaacaccagccccagacccgtgagcggcatggagagagagagaaaggtgagcatgagactgcacagaggcgcccccgtgaacatcagcagcagcgacctgaccggcagacaggacaccagcagaatgagcaccagccagatccccggcagagtggccagcagcggcctgcagagcgtggtgcacagatag

SEQ ID NO: 75556 - DNA, 381 bp, Artificial Sequence
  Description of Artificial Sequence: Synthetic coding sequence
atggagctgagagtgggcaacagatacagactgggcagaaagatcggcagcggcagcttcggcgacatctacctgggcaccgacatcgccgccggcgaggaggtggccatcaagctggagtgcgtgaagaccaagcacccccagctgcacatcgagagcaagatctacaagatgatgcagggcggcgtgggcatccccaccatcagatggtgcggcgccgagggcgactacaacgtgatggtgatggagctgctgggccccagcctggaggacctgttcaacttctgcagcagaaagttcagcctgaagaccgtgctgctgctggccgaccagatgaacaaccccgaggagatgacctggagcctgtgggccacctgctag

SEQ ID NO: 75557 - DNA, 1251 bp, Artificial Sequence
  Description of Artificial Sequence: Synthetic coding sequence
atggagctgagagtgggcaacaagtacagactgggcagaaagatcggcagcggcagcttcggcgacatctacctgggcgccaacatcgccagcggcgaggaggtggccatcaagctggagtgcgtgaagaccaagcacccccagctgcacatcgagagcaagttctacaagatgatgcagggcggcgtgggcatccccagcatcaagtggtgcggcgccgagggcgactacaacgtgatggtgatggagctgctgggccccagcctggaggacctgttcaacttctgcagcagaaagttcagcctgaagaccgtgctgctgctggccgaccagatgatcagcagaatcgagtacatccacagcaagaacttcatccacagagacgtgaagcccgacaacttcctgatgggcctgggcaagaagggcaacctggtgtacatcatcgacttcggcctggccaagaagtacagagacgccagaacccaccagcacatcccctacagagagaacaagaacctgaccggcaccgccagatacgccagcatcaacacccacctgggcatcgagcagagcagaagagacgacctggagagcctgggctacgtgctgatgtacttcaacctgggcagcctgccctggcagggcctgaaggccgccaccaagagacagaagtacgagagaatcagcgagaagaagatgagcacccccatcgaggtgctgtgcaagggctaccccagcgagttcagcacctacctgaacttctgcagaagcctgagattcgacgacaagcccgactacagctacctgagacagctgttcagaaacctgttccacagacagggcttcagctacgactacgtgttcgactggaacatgctgaagttcggcgccgccagaaaccccgaggacgtggacagagagagaagagagcacgagagagaggagagaatgggccagctgagaggcagcgccaccagagccctgccccccggcccccccaccggcgccaccgccaacagactgagaagcgccgccgagcccgtggccagcacccccgccagcagaatccagcccgccggcaacaccagccccagagccatcagcagagtggacagagagagaaaggtgagcatgagactgcacagaggcgcccccgccaacgtgagcagcagcgacctgaccggcagacaggaggtgagcagaatccccgccagccagaccagcgtgcccttcgaccacctgggcaagtag

SEQ ID NO: 75558 - DNA, 360 bp, Artificial Sequence
  Description of Artificial Sequence: Synthetic coding sequence
tgaagaaaccccgaggacgtggacagagagagaagagagcacgagagagaggagagaatgggccagctgagaggcagcgccaccagagccctgccccccggcccccccaccggcgccaccgccaacagactgagaagcgccgccgagcccgtggccagcacccccgccagcagaatccagcccgccggcaacaccagccccagagccatcagcagagtggacagagagagaaaggtgagcatgagactgcacagaggcgcccccgccaacgtgagcagcagcgacctgaccggcagacaggaggtgagcagaatccccgccagccagaccagcgtgcccttcgaccacctgggcaagtag

SEQ ID NO: 75559 - DNA, 1251 bp, Artificial Sequence; identical to SEQ ID NO: 75557
  Description of Artificial Sequence: Synthetic coding sequence

SEQ ID NO: 75560 - DNA, 1251 bp, Artificial Sequence; identical to SEQ ID NO: 75557
  Description of Artificial Sequence: Synthetic coding sequence

SEQ ID NO: 75561 - DNA, 1251 bp, Artificial Sequence; identical to SEQ ID NO: 75557
  Description of Artificial Sequence: Synthetic coding sequence

SEQ ID NO: 75562 - DNA, 1251 bp, Artificial Sequence; identical to SEQ ID NO: 75557
  Description of Artificial Sequence: Synthetic coding sequence

SEQ ID NO: 75563 - DNA, 678 bp, Artificial Sequence
  Description of Artificial Sequence: Synthetic coding sequence
atggagctgagagtgggcaacaagtacagactgggcagaaagatcggcagcggcagcttcggcgacatctacctgggcgccaacatcgccagcggcgaggaggtggccatcaagctggagtgcgtgaagaccaagcacccccagctgcacatcgagagcaagttctacaagatgatgcagggcggcgtgggcatccccagcatcaagtggtgcggcgccgagggcgactacaacgtgatggtgatggagctgctgggccccagcctggaggacctgttcaacttctgcagcagaaagttcagcctgaagaccgtgctgctgctggccgaccagatgatcagcagaatcgagtacatccacagcaagaacttcatccacagagacgtgaagcccgacaacttcctgatgggcctgggcaagaagggcaacctggtgtacatcatcgacttcggcctggccaagaagtacagagacgccagaacccaccagcacatcccctacagagagaacaagaacctgaccggcaccgccagatacgccagcatcaacacccacctgggcatcgagcagagcagaagagacgacctggagagcctgggctacgtgctgatgtacttcaacctgggcagcctgccctggcagggcctgaaggccgccaccaagagacagaagtactag

SEQ ID NO: 75564 - DNA, 435 bp, Artificial Sequence
  Description of Artificial Sequence: Synthetic coding sequence
tgaagaaacctgttccacagacagggcttcagctacgactacgtgttcgactggaacatgctgaagttcggcgccgccagaaaccccgaggacgtggacagagagagaagagagcacgagagagaggagagaatgggccagctgagaggcagcgccaccagagccctgccccccggcccccccaccggcgccaccgccaacagactgagaagcgccgccgagcccgtggccagcacccccgccagcagaatccagcccgccggcaacaccagccccagagccatcagcagagtggacagagagagaaaggtgagcatgagactgcacagaggcgcccccgccaacgtgagcagcagcgacctgaccggcagacaggaggtgagcagaatccccgccagccagaccagcgtgcccttcgaccacctgggcaagtag

SEQ ID NO: 75565 - DNA, 1182 bp, Artificial Sequence
  Description of Artificial Sequence: Synthetic coding sequence
atggaccaccccagcagagagaaggacgagagacagagaaccaccaagcccatggcccagagaagcgcccactgcagcagacccagcggcagcagcagcagcagcggcgtgctgatggtgggccccaacttcagagtgggcaagaagatcggctgcggcaacttcggcgagctgagactgggcaagaacctgtacaccaacgagtacgtggccatcaagctggagcccatcaagagcagagccccccagctgcacctggagtacagattctacaagcagctgggcagcgccggcgagggcctgccccaggtgtactacttcggcccctgcggcaagtacaacgccatggtgctggagctgctgggccccagcctggaggacctgttcgacctgtgcgacagaaccttcaccctgaagaccgtgctgatgatcgccatccagctgctgagcagaatggagtacgtgcacagcaagaacctgatctacagagacgtgaagcccgagaacttcctgatcggcagacagggcaacaagaaggagcacgtgatccacatcatcgacttcggcctggccaaggagtacatcgaccccgagaccaagaagcacatcccctacagagagcacaagagcctgaccggcaccgccagatacatgagcatcaacacccacctgggcaaggagcagagcagaagagacgacctggaggccctgggccacatgttcatgtacttcctgagaggcagcctgccctggcagggcctgaaggccgacaccctgaaggagagataccagaagatcggcgacaccaagagaaacacccccatcgaggccctgtgcgagaacttccccgaggagatggccacctacctgagatacgtgagaagactggacttcttcgagaagcccgactacgagtacctgagaaccctgttcaccgacctgttcgagaagaagggctacaccttcgactacgcctacgactgggtgggcagacccatccccacccccgtgggcagcgtgcacgtggacagcggcgccagcgccatcaccagagagagccacacccacagagacagacccagccagcagcagcccctgagaaaccagagcctgagaaccgtgaccgccgagcactacgacgtgaacaacagcgccatctggcacagaggcagaggcacctag

SEQ ID NO: 75566 - DNA, 1269 bp, Artificial Sequence
  Description of Artificial Sequence: Synthetic coding sequence
atggaccaccccagcagagagaaggacgagagacagagaaccaccaagcccatggcccagagaagcgcccactgcagcagacccagcggcagcagcagcagcagcggcgtgctgatggtgggccccaacttcagagtgggcaagaagatcggctgcggcaacttcggcgagctgagactgggcaagaacctgtacaccaacgagtacgtggccatcaagctggagcccatcaagagcagagccccccagctgcacctggagtacagattctacaagcagctgggcagcgccggcgagggcctgccccaggtgtactacttcggcccctgcggcaagtacaacgccatggtgctggagctgctgggccccagcctggaggacctgttcgacctgtgcgacagaaccttcaccctgaagaccgtgctgatgatcgccatccagctgctgagcagaatggagtacgtgcacagcaagaacctgatctacagagacgtgaagcccgagaacttcctgatcggcagacagggcaacaagaaggagcacgtgatccacatcatcgacttcggcctggccaaggagtacatcgaccccgagaccaagaagcacatcccctacagagagcacaagagcctgaccggcaccgccagatacatgagcatcaacacccacctgggcaaggagcagagcagaagagacgacctggaggccctgggccacatgttcatgtacttcctgagaggcagcctgccctggcagggcctgaaggccgacaccctgaaggagagataccagaagatcggcgacaccaagagaaacacccccatcgaggccctgtgcgagaacttccccgaggagatggccacctacctgagatacgtgagaagactggacttcttcgagaagcccgactacgagtacctgagaaccctgttcaccgacctgttcgagaagaagggctacaccttcgactacgcctacgactgggtgggcagacccatccccacccccgtgggcagcgtgcacgtggacagcggcgccagcgccatcaccagagagagccacacccacagagacagacccagccagcagcagcccctgagaaaccaggtggtgagcagcaccaacggcgagctgaacgtggacgaccccaccggcgcccacagcaacgcccccatcaccgcccacgccgaggtggaggtggtggaggaggccaagtgctgctgcttcttcaagagaaagagaaagaagaccgcccagagacacaagtag

SEQ ID NO: 75567 - DNA, 1137 bp, Artificial Sequence
  Description of Artificial Sequence: Synthetic coding sequence
atggaccaccccagcagagagaaggacgagagacagagaaccaccaagcccatggcccagagaagcgcccactgcagcagacccagcggcagcagcagcagcagcggcgtgctgatggtgggccccaacttcagagtgggcaagaagatcggctgcggcaacttcggcgagctgagactgggcaagaacctgtacaccaacgagtacgtggccatcaagctggagctgctgggccccagcctggaggacctgttcgacctgtgcgacagaaccttcaccctgaagaccgtgctgatgatcgccatccagctgctgagcagaatggagtacgtgcacagcaagaacctgatctacagagacgtgaagcccgagaacttcctgatcggcagacagggcaacaagaaggagcacgtgatccacatcatcgacttcggcctggccaaggagtacatcgaccccgagaccaagaagcacatcccctacagagagcacaagagcctgaccggcaccgccagatacatgagcatcaacacccacctgggcaaggagcagagcagaagagacgacctggaggccctgggccacatgttcatgtacttcctgagaggcagcctgccctggcagggcctgaaggccgacaccctgaaggagagataccagaagatcggcgacaccaagagaaacacccccatcgaggccctgtgcgagaacttccccgaggagatggccacctacctgagatacgtgagaagactggacttcttcgagaagcccgactacgagtacctgagaaccctgttcaccgacctgttcgagaagaagggctacaccttcgactacgcctacgactgggtgggcagacccatccccacccccgtgggcagcgtgcacgtggacagcggcgccagcgccatcaccagagagagccacacccacagagacagacccagccagcagcagcccctgagaaaccaggtggtgagcagcaccaacggcgagctgaacgtggacgaccccaccggcgcccacagcaacgcccccatcaccgcccacgccgaggtggaggtggtggaggaggccaagtgctgctgcttcttcaagagaaagagaaagaagaccgcccagagacacaagtag

SEQ ID NO: 75568 - DNA, 1248 bp, Artificial Sequence
  Description of Artificial Sequence: Synthetic coding sequence
atggacttcgacaagaagggcggcaagggcgagaccgaggagggcagaagaatgagcaaggccggcggcggcagaagcagccacggcatcagaagcagcggcaccagcagcggcgtgctgatggtgggccccaacttcagagtgggcaagaagatcggctgcggcaacttcggcgagctgagactgggcaagaacctgtacaccaacgagtacgtggccatcaagctggagcccatcaagagcagagccccccagctgcacctggagtacagattctacaagcagctgagcgccaccgagggcgtgccccaggtgtactacttcggcccctgcggcaagtacaacgccatggtgctggagctgctgggccccagcctggaggacctgttcgacctgtgcgacagaaccttcaccctgaagaccgtgctgatgatcgccatccagctgatcaccagaatggagtacgtgcacaccaagagcctgatctacagagacgtgaagcccgagaacttcctggtgggcagacccggcaccaagagacagcacgccatccacatcatcgacttcggcctggccaaggagtacatcgaccccgagaccaagaagcacatcccctacagagagcacaagagcctgaccggcaccgccagatacatgagcatcaacacccacctgggcaaggagcagagcagaagagacgacctggaggccctgggccacatgttcatgtacttcctgagaggcagcctgccctggcagggcctgaaggccgacaccctgaaggagagataccagaagatcggcgacaccaagagagccacccccatcgaggtgctgtgcgagaacttccccgaggagatggccacctacctgagatacgtgagaagactggacttcttcgagaagcccgactacgactacctgagaaagctgttcaccgacctgttcgacagaagcggcttcgtgttcgactacgagtacgactgggccggcaagcccctgcccacccccatcggcaccgtgcacaccgacctgcccagccagccccagctgagagacaagacccagccccacagcaagaaccaggccctgaacagcaccaacggcgagctgaacgccgacgaccccaccgccggccacagcaacgcccccatcaccgcccccgccgaggtggaggtggccgacgagaccaagtgctgctgcttcttcaagagaagaaagagaaagagcctgcagagacacaagtag

SEQ ID NO: 75569 - DNA, 645 bp, Artificial Sequence
  Description of Artificial Sequence: Synthetic coding sequence
atgagcatcaacacccacctgggcaaggagcagagcagaagagacgacctggaggccctgggccacatgttcatgtacttcctgagaggcagcctgccctggcagggcctgaaggccgacaccctgaaggagagataccagaagatcggcgacaccaagagagccacccccatcgaggtgctgtgcgagaacttccccgaggagatggccacctacctgagatacgtgagaagactggacttcttcgagaagcccgactacgactacctgagaaagctgttcaccgacctgttcgacagaagcggcttcgtgttcgactacgagtacgactgggccggcaagcccctgcccacccccatcggcaccgtgcacaccgacctgcccagccagccccagctgagagacaagacccagccccccgagagcagcccctgcagccccctgggcagagacctggtgagaggccccagaggcccccccaccgccgcccagggccagaccctggccggcagccagaacgccgactgcagaggcagagcctggctgagaagaccccaccccagagacgtgggcagcctgcccagctgcaagaccctggccgagatcagcacccccgtgagcagcccccccctgcaggagcactag

SEQ ID NO: 75570 - DNA, 1272 bp, Artificial Sequence
  Description of Artificial Sequence: Synthetic coding sequence
atggagaacaagaagaaggacaaggacaagagcgacgacagaatggccagacccagcggcagaagcggccacaacaccagaggcaccggcagcagcagcagcggcgtgctgatggtgggccccaacttcagagtgggcaagaagatcggctgcggcaacttcggcgagctgagactgggcaagaacctgtacaccaacgagtacgtggccatcaagctggagcccatgaagagcagagccccccagctgcacctggagtacagattctacaagcagctgggcagcggcgacggcatcccccaggtgtactacttcggcccctgcggcaagtacaacgccatggtgctggagctgctgggccccagcctggaggacctgttcgacctgtgcgacagaaccttcagcctgaagaccgtgctgatgatcgccatccagctgatcagcagaatggagtacgtgcacagcaagaacctgatctacagagacgtgaagcccgagaacttcctgatcggcagacccggcaacaagacccagcaggtgatccacatcatcgacttcggcctggccaaggagtacatcgaccccgagaccaagaagcacatcccctacagagagcacaagagcctgaccggcaccgccagatacatgagcatcaacacccacctgggcaaggagcagagcagaagagacgacctggaggccctgggccacatgttcatgtacttcctgagaggcagcctgccctggcagggcctgaaggccgacaccctgaaggagagataccagaagatcggcgacaccaagagagccacccccatcgaggtgctgtgcgagaacttccccgagatggccacctacctgagatacgtgagaagactggacttcttcgagaagcccgactacgactacctgagaaagctgttcaccgacctgttcgacagaaagggctacatgttcgactacgagtacgactggatcggcaagcagctgcccacccccgtgggcgccgtgcagcaggaccccgccctgagcagcaacagagaggcccaccagcacagagacaagatgcagcagagcaagaaccaggtggtgagcagcaccaacggcgagctgaacaccgacgaccccaccgccggcagaagcaacgcccccatcaccgcccccaccgaggtggaggtgatggacgagaccaactgccagaaggtgctgaacatgtggtgctgctgcttcttcaagagaagaaagagaaagaccatccagagacacaagtag

SEQ ID NO: 75571 - DNA, 1368 bp, Artificial Sequence
  Description of Artificial Sequence: Synthetic coding sequence
atggagaacaagaagaaggacaaggacaagagcgacgacagaatggccagacccagcggcagaagcggccacaacaccagaggcaccggcagcagcagcagcggcgtgctgatggtgggccccaacttcagagtgggcaagaagatcggctgcggcaacttcggcgagctgagactgggcaagaacctgtacaccaacgagtacgtggccatcaagctggagcccatgaagagcagagccccccagctgcacctggagtacagattctacaagcagctgggcagcggcgacggcatcccccaggtgtactacttcggcccctgcggcaagtacaacgccatggtgctggagctgctgggccccagcctggaggacctgttcgacctgtgcgacagaaccttcagcctgaagaccgtgctgatgatcgccatccagctgatcagcagaatggagtacgtgcacagcaagaacctgatctacagagacgtgaagcccgagaacttcctgatcggcagacccggcaacaagacccagcaggtgatccacatcatcgacttcggcctggccaaggagtacatcgaccccgagaccaagaagcacatcccctacagagagcacaagagcctgaccggcaccgccagatacatgagcatcaacacccacctgggcaaggagcagagcagaagagacgacctggaggccctgggccacatgttcatgtacttcctgagaggcagcctgccctggcagggcctgaaggccgacaccctgaaggagagataccagaagatcggcgacaccaagagagccacccccatcgaggtgctgtgcgagaacttccccgagatggccacctacctgagatacgtgagaagactggacttcttcgagaagcccgactacgactacctgagaaagctgttcaccgacctgttcgacagaaagggctacatgttcgactacgagtacgactggatcggcaagcagctgcccacccccgtgggcgccgtgcagcaggaccccgccctgagcagcaacagagaggcccaccagcacagagacaagatgcagcagagcaagaaccagagcgccgaccacagagccgcctgggacagccagcaggccaacccccaccacctgagagcccacctggccgccgacagacacggcggcagcgtgcaggtggtgagcagcaccaacggcgagctgaacaccgacgaccccaccgccggcagaagcaacgcccccatcaccgcccccaccgaggtggaggtgatggacgagaccaactgccagaaggtgctgaacatgtggtgctgctgcttcttcaagagaagaaagagaaagaccatccagagacacaagtag

SEQ ID NO: 75572 - DNA, 1344 bp, Artificial Sequence
  Description of Artificial Sequence: Synthetic coding sequence
atggagaacaagaagaaggacaaggacaagagcgacgacagaatggccagacccagcggcagaagcggccacaacaccagaggcaccggcagcagcagcagcggcgtgctgatggtgggccccaacttcagagtgggcaagaagatcggctgcggcaacttcggcgagctgagactgggcaagaacctgtacaccaacgagtacgtggccatcaagctggagcccatgaagagcagagccccccagctgcacctggagtacagattctacaagcagctgggcagcggcgacggcatcccccaggtgtactacttcggcccctgcggcaagtacaacgccatggtgctggagctgctgggccccagcctggaggacctgttcgacctgtgcgacagaaccttcagcctgaagaccgtgctgatgatcgccatccagctgatcagcagaatggagtacgtgcacagcaagaacctgatctacagagacgtgaagcccgagaacttcctgatcggcagacccggcaacaagacccagcaggtgatccacatcatcgacttcggcctggccaaggagtacatcgaccccgagaccaagaagcacatcccctacagagagcacaagagcctgaccggcaccgccagatacatgagcatcaacacccacctgggcaaggagcagagcagaagagacgacctggaggccctgggccacatgttcatgtacttcctgagaggcagcctgccctggcagggcctgaaggccgacaccctgaaggagagataccagaagatcggcgacaccaagagagccacccccatcgaggtgctgtgcgagaacttccccgagatggccacctacctgagatacgtgagaagactggacttcttcgagaagcccgactacgactacctgagaaagctgttcaccgacctgttcgacagaaagggctacatgttcgactacgagtacgactggatcggcaagcagctgcccacccccgtgggcgccgtgcagcaggaccccgccctgagcagcaacagagaggcccaccagcacagagacaagatgcagcagagcaagaaccagagcgccgaccacagagccgcctgggacagccagcaggccaacccccaccacctgagagcccacctggccgccgacagacacggcggcagcgtgcaggtggtgagcagcaccaacggcgagctgaacaccgacgaccccaccgccggcagaagcaacgcccccatcaccgcccccaccgaggtggaggtgatggacgagaccaagtgctgctgcttcttcaagagaagaaagagaaagaccatccagagacacaagtag

SEQ ID NO: 75573 - DNA, 1344 bp, Artificial Sequence; identical to SEQ ID NO: 75572
  Description of Artificial Sequence: Synthetic coding sequence

SEQ ID NO: 75574 - DNA, 1368 bp, Artificial Sequence; identical to SEQ ID NO: 75571
  Description of Artificial Sequence: Synthetic coding sequence

SEQ ID NO: 75575 - DNA, 1275 bp, Artificial Sequence
  Description of Artificial Sequence: Synthetic coding sequence
atggagaacaagaagaaggacaaggacaagagcgacgacagaatggccagacccagcggcagaagcggccacaacaccagaggcaccggcagcagcagcagcggcgtgctgatggtgggccccaacttcagagtgggcaagaagatcggctgcggcaacttcggcgagctgagactgggcaagaacctgtacaccaacgagtacgtggccatcaagctggagcccatgaagagcagagccccccagctgcacctggagtacagattctacaagcagctgggcagcggcgacggcatcccccaggtgtactacttcggcccctgcggcaagtacaacgccatggtgctggagctgctgggccccagcctggaggacctgttcgacctgtgcgacagaaccttcagcctgaagaccgtgctgatgatcgccatccagctgatcagcagaatggagtacgtgcacagcaagaacctgatctacagagacgtgaagcccgagaacttcctgatcggcagacccggcaacaagacccagcaggtgatccacatcatcgacttcggcctggccaaggagtacatcgaccccgagaccaagaagcacatcccctacagagagcacaagagcctgaccggcaccgccagatacatgagcatcaacacccacctgggcaaggagcagagcagaagagacgacctggaggccctgggccacatgttcatgtacttcctgagaggcagcctgccctggcagggcctgaaggccgacaccctgaaggagagataccagaagatcggcgacaccaagagagccacccccatcgaggtgctgtgcgagaacttccccgaggagatggccacctacctgagatacgtgagaagactggacttcttcgagaagcccgactacgactacctgagaaagctgttcaccgacctgttcgacagaaagggctacatgttcgactacgagtacgactggatcggcaagcagctgcccacccccgtgggcgccgtgcagcaggaccccgccctgagcagcaacagagaggcccaccagcacagagacaagatgcagcagagcaagaaccaggtggtgagcagcaccaacggcgagctgaacaccgacgaccccaccgccggcagaagcaacgcccccatcaccgcccccaccgaggtggaggtgatggacgagaccaactgccagaaggtgctgaacatgtggtgctgctgcttcttcaagagaagaaagagaaagaccatccagagacacaagtag

SEQ ID NO: 75576 - DNA, 1272 bp, Artificial Sequence; identical to SEQ ID NO: 75570
  Description of Artificial Sequence: Synthetic coding sequence

SEQ ID NO: 75577 - DNA, 648 bp, Artificial Sequence
  Description of Artificial Sequence: Synthetic coding sequence
atgagcagcagcgaggaggtgagctggatcagctggttctgcggcctgagaggcaacgagttcttctgcgaggtggacgaggactacatccaggacaagttcaacctgaccggcctgaacgagcaggtgccccactacagacaggccctggacatgatcctggacctggagcccgacgaggagctggaggacaaccccaaccagagcgacctgatcgagcaggccgccgagatgctgtacggcctgatccacgccagatacatcctgaccaacagaggcatcgcccagatgctggagaagtaccagcagggcgacttcggctactgccccagagtgtactgcgagaaccagcccatgctgcccatcggcctgagcgacatccccggcgaggccatggtgaagctgtactgccccaagtgcatggacgtgtacacccccaagagcagcagacaccaccacaccgacggcgcctacttcggcaccggcttcccccacatgctgttcatggtgcaccccgagtacagacccaagagacccgccaaccagttcgtgcccagactgtacggcttcaagatccaccccatggcctaccagctgcagctgcaggccgccagcaacttcaagagccccgtgaagaccatcagatag

SEQ ID NO: 75578 - DNA, 648 bp, Artificial Sequence; identical to SEQ ID NO: 75577
  Description of Artificial Sequence: Synthetic coding sequence

SEQ ID NO: 75579 - DNA, 648 bp, Artificial Sequence; identical to SEQ ID NO: 75577
  Description of Artificial Sequence: Synthetic coding sequence

SEQ ID NO: 75580 - DNA, 648 bp, Artificial Sequence; identical to SEQ ID NO: 75577
  Description of Artificial Sequence: Synthetic coding sequence

SEQ ID NO: 75581 - DNA, 687 bp, Artificial Sequence
  Description of Artificial Sequence: Synthetic coding sequence
atgagcagcagcgaggaggtgagctggatcagctggttctgcggcctgagaggcaacgagttcttctgcgaggtggacgaggactacatccaggacaagttcaacctgaccggcctgaacgagcaggtgccccactacagacaggccctggacatgatcctggacctggagcccgacgaggagctggaggacaaccccaaccagagcgacctgatcgagcaggccgccgagatgctgtacggcctgatccacgccagatacatcctgaccaacagaggcatcgcccagatgctggagaagtaccagcagggcgacttcggctactgccccagagtgtactgcgagaaccagcccatgctgcccatcggcctgagcgacatccccggcgaggccatggtgaagctgtactgccccaagtgcatggacgtgtacacccccaagagcagcagacaccaccacaccgacggcgcctacttcggcaccggcttcccccacatgctgttcatggtgcaccccgagtacagacccaagagacccgccaaccagttcgtgcccagcagctgcagcagacaccccgacgtgcccctgctgcccagaagaagacccttctgcagaatgcacttcagactgagagaggtgtaccaccagcagctgatccccgtgcacggcgaccaccacctgctgtag

SEQ ID NO: 75582 - DNA, 648 bp, Artificial Sequence; identical to SEQ ID NO: 75577
  Description of Artificial Sequence: Synthetic coding sequence

SEQ ID NO: 75583 - DNA, 648 bp, Artificial Sequence; identical to SEQ ID NO: 75577
  Description of Artificial Sequence: Synthetic coding sequence

SEQ ID NO: 75584 - DNA, 705 bp, Artificial Sequence
  Description of Artificial Sequence: Synthetic coding sequence
atggagaagtgcaagggcaccagcagaatggccggcaccaccagcgccgacgtgaagatgagcagcagcgaggaggtgagctggatcagctggttctgcggcctgagaggcaacgagttcttctgcgaggtggacgaggactacatccaggacaagttcaacctgaccggcctgaacgagcaggtgccccactacagacaggccctggacatgatcctggacctggagcccgacgaggagctggaggacaaccccaaccagagcgacctgatcgagcaggccgccgagatgctgtacggcctgatccacgccagatacatcctgaccaacagaggcatcgcccagatgctggagaagtaccagcagggcgacttcggctactgccccagagtgtactgcgagaaccagcccatgctgcccatcggcctgagcgacatccccggcgaggccatggtgaagctgtactgccccaagtgcatggacgtgtacacccccaagagcagcagacaccaccacaccgacggcgcctacttcggcaccggcttcccccacatgctgttcatggtgcaccccgagtacagacccaagagacccgccaaccagttcgtgcccagactgtacggcttcaagatccaccccatggcctaccagctgcagctgcaggccgccagcaacttcaagagccccgtgaagaccatcagatag

SEQ ID NO: 75585 - DNA, 648 bp, Artificial Sequence; identical to SEQ ID NO: 75577
  Description of Artificial Sequence: Synthetic coding sequence

SEQ ID NO: 75586 - DNA, 687 bp, Artificial Sequence; identical to SEQ ID NO: 75581
  Description of Artificial Sequence: Synthetic coding sequence

SEQ ID NO: 75587 - DNA, 687 bp, Artificial Sequence; identical to SEQ ID NO: 75581
  Description of Artificial Sequence: Synthetic coding sequence

SEQ ID NO: 75588 - DNA, 648 bp, Artificial Sequence; identical to SEQ ID NO: 75577
  Description of Artificial Sequence: Synthetic coding sequence

SEQ ID NO: 75589 - DNA, 705 bp, Artificial Sequence; identical to SEQ ID NO: 75584
  Description of Artificial Sequence: Synthetic coding sequence

SEQ ID NO: 75590 - DNA, 648 bp, Artificial Sequence; identical to SEQ ID NO: 75577
  Description of Artificial Sequence: Synthetic coding sequence

SEQ ID NO: 75591 - DNA, 705 bp, Artificial Sequence; identical to SEQ ID NO: 75584
  Description of Artificial Sequence: Synthetic coding sequence

SEQ ID NO: 75592 - DNA, 705 bp, Artificial Sequence; identical to SEQ ID NO: 75584
  Description of Artificial Sequence: Synthetic coding sequence

SEQ ID NO: 75593 - DNA, 648 bp, Artificial Sequence; identical to SEQ ID NO: 75577
  Description of Artificial Sequence: Synthetic coding sequence

SEQ ID NO: 75594 - DNA, 648 bp, Artificial Sequence; identical to SEQ ID NO: 75577
  Description of Artificial Sequence: Synthetic coding sequence

SEQ ID NO: 75595 - DNA, 705 bp, Artificial Sequence; identical to SEQ ID NO: 75584
  Description of Artificial Sequence: Synthetic coding sequence

SEQ ID NO: 75596 - DNA, 648 bp, Artificial Sequence; identical to SEQ ID NO: 75577
  Description of Artificial Sequence: Synthetic coding sequence

SEQ ID NO: 75597 - DNA, 687 bp, Artificial Sequence; identical to SEQ ID NO: 75581
  Description of Artificial Sequence: Synthetic coding sequence

SEQ ID NO: 75598 - DNA, 705 bp, Artificial Sequence; identical to SEQ ID NO: 75584
  Description of Artificial Sequence: Synthetic coding sequence

SEQ ID NO: 75599 - DNA, 648 bp, Artificial Sequence; identical to SEQ ID NO: 75577
  Description of Artificial Sequence: Synthetic coding sequence

SEQ ID NO: 75600 - DNA, 648 bp, Artificial Sequence; identical to SEQ ID NO: 75577
  Description of Artificial Sequence: Synthetic coding sequence

SEQ ID NO: 75601 - DNA, 648 bp, Artificial Sequence; identical to SEQ ID NO: 75577
  Description of Artificial Sequence: Synthetic coding sequence

SEQ ID NO: 75602 - DNA, 648 bp, Artificial Sequence; identical to SEQ ID NO: 75577
  Description of Artificial Sequence: Synthetic coding sequence

SEQ ID NO: 75603 - DNA, 648 bp, Artificial Sequence; identical to SEQ ID NO: 75577
  Description of Artificial Sequence: Synthetic coding sequence

SEQ ID NO: 75604 - DNA, 648 bp, Artificial Sequence; identical to SEQ ID NO: 75577
  Description of Artificial Sequence: Synthetic coding sequence

SEQ ID NO: 75605 - DNA, 648 bp, Artificial Sequence; identical to SEQ ID NO: 75577
  Description of Artificial Sequence: Synthetic coding sequence

SEQ ID NO: 75606 - DNA, 648 bp, Artificial Sequence; identical to SEQ ID NO: 75577
  Description of Artificial Sequence: Synthetic coding sequence

SEQ ID NO: 75607 - DNA, 648 bp, Artificial Sequence; identical to SEQ ID NO: 75577
  Description of Artificial Sequence: Synthetic coding sequence

SEQ ID NO: 75608 - DNA, 4296 bp, Artificial Sequence
  Description of Artificial Sequence: Synthetic coding sequence
atgggcaaggagcaggagctggtgcaggccgtgaaggccgaggacgtgggcaccgcccagagactgctgcagagacccagacccggcaaggccaagctgctgggcagcaccaagaagatcaacgtgaacttccaggaccccgacggcttcagcgccctgcaccacgccgccctgaacggcaacaccgagctgatcagcctgctgctggaggcccaggccgccgtggacatcaaggacaacaagggcatgagacccctgcactacgccgcctggcagggcagaaaggagcccatgaagctggtgctgaaggccggcagcgccgtgaacatccccagcgacgagggccacatccccctgcacctggccgcccagcacggccactacgacgtgagcgagatgctgctgcagcaccagagcaacccctgcatggtggacaacagcggcaagacccccctggacctggcctgcgagttcggcagagtgggcgtggtgcagctgctgctgagcagcaacatgtgcgccgccctgctggagcccagacccggcgacgccaccgaccccaacggcaccagccccctgcacctggccgccaagaacggccacatcgacatcatcagactgctgctgcaggccggcatcgacatcaacagacagaccaagagcggcaccgccctgcacgaggccgccctgtgcggcaagaccgaggtggtgagactgctgctggacagcggcatcaacgcccacgtgagaaacacctacagccagaccgccctggacatcgtgcaccagttcaccaccagccaggccagcagagagatcaagcagctgctgagagaggccagcgccgccctgcaggtgagagccaccaaggactactgcaacaactacgacctgaccagcctgaacgtgaaggccggcgacatcatcaccgtgctggagcagcaccccgacggcagatggaagggctgcatccacgacaacagaaccggcaacgacagagtgggctacttccccagcagcctgggcgaggccatcgtgaagagagccggcagcagagccggcaccgagcccagcctgccccagggcagcagcagcagcggccccagcgccccccccgaggagatctgggtgctgagaaagcccttcgccggcggcgacagaagcggcagcatcagcggcatggccggcggcagaggcagcggcggccacgccctgcacgccggcagcgagggcgtgaagctgctggccaccgtgctgagccagaagagcgtgagcgagagcggccccggcgacagccccgccaagccccccgagggcagcgccggcgtggccagaagccagccccccgtggcccacgccggccaggtgtacggcgagcagccccccaagaagctggagcccgccagcgagggcaagagcagcgaggccgtgagccagtggctgaccgccttccagctgcagctgtacgcccccaacttcatcagcgccggctacgacctgcccaccatcagcagaatgacccccgaggacctgaccgccatcggcgtgaccaagcccggccacagaaagaagatcgccgccgagatcagcggcctgagcatccccgactggctgcccgagcacaagcccgccaacctggccgtgtggctgagcatgatcggcctggcccagtactacaaggtgctggtggacaacggctacgagaacatcgacttcatcaccgacatcacctgggaggacctgcaggagatcggcatcaccaagctgggccaccagaagaagctgatgctggccgtgagaaagctggccgagctgcagaaggccgagtacgccaagtacgagggcggccccctgagaagaaaggccccccagagcctggaggtgatggccatcgagagcccccccccccccgagcccacccccgccgactgccagagccccaagatgaccaccttccaggacagcgagctgagcgacgagctgcaggccgccatgaccggccccgccgaggtgggccccaccaccgagaagcccagcagccacctgccccccacccccagagccaccaccagacaggacagcagcctgggcggcagagccagacacatgagcagcagccaggagctgctgggcgacggcccccccggccccagcagccccatgagcagaagccaggagtacctgctggacgagggccccgcccccggcaccccccccagagaggccagacccggcagacacggccacagcatcaagagagccagcgtgccccccgtgcccggcaagcccagacaggtgctgccccccggcaccagccacttcacccccccccagacccccaccaagaccagacccggcagcccccaggccctgggcggcccccacggccccgcccccgccaccgccaaggtgaagcccaccccccagctgctgccccccaccgagagacccatgagccccagaagcctgccccagagccccacccacagaggcttcgcctacgtgctgccccagcccgtggagggcgaggtgggccccgccgcccccggccccgcccccccccccgtgcccaccgccgtgcccaccctgtgcctgccccccgaggccgacgccgagcccggcagacccaagaagagagcccacagcctgaacagatacgccgccagcgacagcgagcccgagagagacgagctgctggtgcccgccgccgccggcccctacgccaccgtgcagagaagagtgggcagaagccacagcgtgagagcccccgccggcgccgacaagaacgtgaacagaagccagagcttcgccgtgagacccagaaagaagggcccccccccccccccccccaagagaagcagcagcgccctggccagcgccaacctggccgacgagcccgtgcccgacgccgagcccgaggacggcctgctgggcgtgagagcccagtgcagaagagccagcgacctggccggcagcgtggacaccggcagcgccggcagcgtgaagagcatcgccgccatgctggagctgagcagcatcggcggcggcggcagagccgccagaagaccccccgagggccaccccacccccagacccgccagccccgagcccggcagagtggccaccgtgctggccagcgtgaagcacaaggaggccatcggccccggcggcgaggtggtgaacagaagaagaaccctgagcggccccgtgaccggcctgctggccaccgccagaagaggccccggcgagagcgccgaccccggccccttcgtggaggacggcaccggcagacagagacccagaggccccagcaagggcgaggccggcgtggagggcccccccctggccaaggtggaggccagcgccaccctgaagagaagaatcagagccaagcagaaccagcaggagaacgtgaagttcatcctgaccgagagcgacaccgtgaagagaagacccaaggccaaggagagagaggccggccccgagccccccccccccctgagcgtgtaccacaacggcaccggcaccgtgagaagaagacccgccagcgagcaggccggcccccccgagctgccccccccccccccccccgccgagcccccccccaccgacctggcccacctgccccccctgcccccccccgagggcgaggccagaaagcccgccaagccccccgtgagccccaagcccgtgctgacccagcccgtgcccaagctgcagggcagccccacccccaccagcaagaaggtgcccctgcccggccccggcagccccgaggtgaagagagcccacggcacccccccccccgtgagccccaagcccccccccccccccaccgcccccaagcccgtgaaggccgtggccggcctgcccagcggcagcgccggccccagccccgcccccagccccgccagacagccccccgccgccctggccaagccccccggcaccccccccagcctgggcgccagccccgccaagccccccagccccggcgcccccgccctgcacgtgcccgccaagccccccagagccgccgccgccgccgccgccgccgccgccgccccccccgccccccccgagggcgccagccccggcgacagcgccagacagaagctggaggagaccagcgcctgcctggccgccgccctgcaggccgtggaggagaagatcagacaggaggacgcccagggccccagagacagcgccgccgagaagagcaccggcagcatcctggacgacatcggcagcatgttcgacgacctggccgaccagctggacgccatgctggagtag

SEQ ID NO: 75609 - DNA, 2115 bp, Artificial Sequence
  Description of Artificial Sequence: Synthetic coding sequence
atgtgcgccgccctgctggagcccagacccggcgacgccaccgaccccaacggcaccagccccctgcacctggccgccaagaacggccacatcgacatcatcagactgctgctgcaggccggcatcgacatcaacagacagaccaagagcggcaccgccctgcacgaggccgccctgtgcggcaagaccgaggtggtgagactgctgctggacagcggcatcaacgcccacgtgagaaacacctacagccagaccgccctggacatcgtgcaccagttcaccaccagccaggccagcagagagatcaagcagctgctgagagaggccagcgccgccctgcaggtgagagccaccaaggactactgcaacaactacgacctgaccagcctgaacgtgaaggccggcgacatcatcaccgtgctggagcagcaccccgacggcagatggaagggctgcatccacgacaacagaaccggcaacgacagagtgggctacttccccagcagcctgggcgaggccatcgtgaagagagccggcagcagagccggcaccgagcccagcctgccccagggcagcagcagcagcggccccagcgccccccccgaggagatctgggtgctgagaaagcccttcgccggcggcgacagaagcggcagcatcagcggcatggccggcggcagaggcagcggcggccacgccctgcacgccggcagcgagggcgtgaagctgctggccaccgtgctgagccagaagagcgtgagcgagagcggccccggcgacagccccgccaagccccccgagggcagcgccggcgtggccagaagccagccccccgtggcccacgccggccaggtgtacggcgagcagccccccaagaagctggagcccgccagcgagggcaagagcagcgaggccgtgagccagtggctgaccgccttccagctgcagctgtacgcccccaacttcatcagcgccggctacgacctgcccaccatcagcagaatgacccccgaggacctgaccgccatcggcgtgaccaagcccggccacagaaagaagatcgccgccgagatcagcggcctgagcatccccgactggctgcccgagcacaagcccgccaacctggccgtgtggctgagcatgatcggcctggcccagtactacaaggtgctggtggacaacggctacgagaacatcgacttcatcaccgacatcacctgggaggacctgcaggagatcggcatcaccaagctgggccaccagaagaagctgatgctggccgtgagaaagctggccgagctgcagaaggccgagtacgccaagtacgagggcggccccctgagaagaaaggccccccagagcctggaggtgatggccatcgagagcccccccccccccgagcccacccccgccgactgccagagccccaagatgaccaccttccaggacagcgagctgagcgacgagctgcaggccgccatgaccggccccgccgaggtgggccccaccaccgagaagcccagcagccacctgccccccacccccagagccaccaccagacaggacagcagcctgggcggcagagccagacacatgagcagcagccaggagctgctgggcgacggcccccccggccccagcagccccatgagcagaagccaggagtacctgctggacgagggccccgcccccggcaccccccccagagaggccagacccggcagacacggccacagcatcaagagagccagcgtgccccccgtgcccggcaagcccagacaggtgctgccccccggcaccagccacttcacccccccccagacccccaccaagaccagacccggcagcccccaggccctgggcggcccccacggccccgcccccgccaccgccaaggtgaagcccaccccccagctgctgccccccaccgagagacccatgagccccagaagcctgccccagagccccacccagagaaccggccccggccccgcccagaactgccccagcggcagacccgccagcagaagcggcgccgcccagggcaccggcgaccagggccagggcccccccgcccccccccacccccagaacatcagctaccaggagtactag

SEQ ID NO: 75610 - DNA, 3609 bp, Artificial Sequence
  Description of Artificial Sequence: Synthetic coding sequence
atgggcagagagcaggacctgatcctggccgtgaagaacggcgacgtgaccggcgtgcagaagctggtggccaaggtgaaggccaccaagaccaagctgctgggcagcaccaagagactgaacgtgaactaccaggacgccgacggcttcagcgccctgcaccacgccgccctgggcggcagcctggagctgatcgccctgctgctggaggcccaggccaccgtggacatcaaggacagcaacggcatgagacccctgcactacgccgcctggcagggcagactggagcccgtgagactgctgctgagagccagcgccgccgtgaacgccgccagcctggacggccagatccccctgcacctggccgcccagtacggccactacgaggtgagcgagatgctgctgcagcaccagagcaacccctgcctggtgaacaaggccaagaagacccccctggacctggcctgcgagttcggcagactgaaggtggcccagctgctgctgaacagccacctgtgcgtggccctgctggagggcgaggccaaggacccctgcgaccccaactacaccacccccctgcacctggccgccaagaacggccacagagaggtgatcagacagctgctgagagccggcatcgagatcaacagacagaccaagaccggcaccgccctgcacgaggccgccctgtacggcaagaccgaggtggtgagactgctgctggagggcggcgtggacgtgaacatcagaaacacctacaaccagaccgccctggacatcgtgaaccagttcaccaccagccaggccagcagagagatcaagcagctgctgagagaggccagcggcatcctgaaggtgagagccctgaaggacttctggaacctgcacgaccccaccgccctgaacgtgagagccggcgacgtgatcaccgtgctggagcagcaccccgacggcagatggaagggccacatccacgagagccagagaggcaccgacagaatcggctacttcccccccggcatcgtggaggtggtgagcaagagagtgggcatccccgccgccagactgcccagcgcccccacccccctgagacccggcttcagcagaaccccccagccccccgccgaggagcccccccaccccctgacctacagccagctgcccagagtgggcctgagccccgacagccccgccggcgacagaaacagcgtgggcagcgagggcagcgtgggcagcatcagaagcgccggcagcggccagagcagcgagggcaccaacggccacggccccggcctgctgatcgagaacgcccagcccctgcccagcgccggcgaggaccaggtgctgcccggcctgcacccccccagcctggccgacaacctgagccacagacccctggccaactgcagaagcggcgagcagatcttcacccaggacgtgagacccgagcagctgctggagggcaaggacgcccaggccatccacaactggctgagcgagttccagctggagggctacaccgcccacttcctgcaggccggctacgacgtgcccaccatcagcagaatgacccccgaggacctgaccgccatcggcgtgaccaagcccggccacagaaagaagatcgccagcgagatcgcccagctgagcatcgccgagtggctgcccagctacatccccaccgacctgctggagtggctgtgcgccctgggcctgccccagtaccacaagcagctggtgagcagcggctacgacagcatgggcctggtggccgacctgacctgggaggagctgcaggagatcggcgtgaacaagctgggccaccagaagaagctgatgctgggcgtgaagagactggccgagctgagaagaggcctgctgcagggcgaggccctgagcgagggcggcagaagactggccaagggccccgagctgatggccatcgagggcctggagaacggcgagggccccgccaccgccggccccagactgctgaccttccagggcagcgagctgagccccgagctgcaggccgccatggccggcggcggccccgagcccctgcccctgccccccgccagaagccccagccaggagagcatcggcgccagaagcagaggcagcggccacagccaggagcagcccgccccccagcccagcggcggcgaccccagccccccccaggagagaaacctgcccgagggcaccgagagaccccccaagctgtgcagcagcctgcccggccagggcccccccccctacgtgttcatgtacccccagggcagccccagcagccccgcccccggccccccccccggcgccccctgggccttcagctacctggccggcccccccgccaccccccccgacccccccagacccaagagaagaagccacagcctgagcagacccggccccaccgagggcgacgccgagggcgaggccgagggccccgtgggcagcaccctgggcagctacgccaccctgaccagaagacccggcagaagcgccctggtgagaaccagccccagcgtgacccccacccccgccagaggcacccccagaagccagagcttcgccctgagagccagaagaaagggcccccccccccccccccccaagagactgagcagcgtgagcggccccagccccgagcccccccccctggacgagagccccggccccaaggagggcgccaccggccccagaagaagaaccctgagcgagcccgccggccccagcgagccccccggcccccccgcccccgccggccccgccagcgacaccgaggaggaggagcccggccccgagggcaccccccccagcagaggcagcagcggcgagggcctgcccttcgccgaggagggcaacctgaccatcaagcagagacccaagcccgccggccccccccccagagagacccccgtgccccccggcctggacttcaacctgaccgagagcgacaccgtgaagagaagacccaagtgcagagagagagagcccctgcagaccgccctgctggccttcggcgtggccagcgccacccccggccccgccgcccccctgcccagccccacccccggcgagagcccccccgccagcagcctgccccagcccgagcccagcagcctgcccgcccagggcgtgcccacccccctggcccccagccccgccatgcagccccccgtgcccccctgccccggccccggcctggagagcagcgccgccagcagatggaacggcgagaccgagccccccgccgcccccgccgccctgctgaaggtgcccggcgccggcaccgcccccaagcccgtgagcgtggcctgcacccagctggccttcagcggccccaagctggcccccagactgggccccagacccgtgcccccccccagacccgagagcaccggcaccgtgggccccggccaggcccagcagagactggagcagaccagcagcagcctggccgccgccctgagagccgccgagaagagcatcggcaccaaggagcaggagggcacccccagcgccagcaccaagcacatcctggacgacatcagcaccatgttcgacgccctggccgaccagctggacgccatgctggactag

SEQ ID NO: 75611 - DNA, 3363 bp, Artificial Sequence
  Description of Artificial Sequence: Synthetic coding sequence
atgagacccctgcactacgccgcctggcagggcagactggagcccgtgagactgctgctgagagccagcgccgccgtgaacgccgccagcctggacggccagatccccctgcacctggccgcccagtacggccactacgaggtgagcgagatgctgctgcagcaccagagcaacccctgcctggtgaacaaggccaagaagacccccctggacctggcctgcgagttcggcagactgaaggtggcccagctgctgctgaacagccacctgtgcgtggccctgctggagggcgaggccaaggacccctgcgaccccaactacaccacccccctgcacctggccgccaagaacggccacagagaggtgatcagacagctgctgagagccggcatcgagatcaacagacagaccaagaccggcaccgccctgcacgaggccgccctgtacggcaagaccgaggtggtgagactgctgctggagggcggcgtggacgtgaacatcagaaacacctacaaccagaccgccctggacatcgtgaaccagttcaccaccagccaggccagcagagagatcaagcagctgctgagagaggccagcggcatcctgaaggtgagagccctgaaggacttctggaacctgcacgaccccaccgccctgaacgtgagagccggcgacgtgatcaccgtgctggagcagcaccccgacggcagatggaagggccacatccacgagagccagagaggcaccgacagaatcggctacttcccccccggcatcgtggaggtggtgagcaagagagtgggcatccccgccgccagactgcccagcgcccccacccccctgagacccggcttcagcagaaccccccagccccccgccgaggagcccccccaccccctgacctacagccagctgcccagagtgggcctgagccccgacagccccgccggcgacagaaacagcgtgggcagcgagggcagcgtgggcagcatcagaagcgccggcagcggccagagcagcgagggcaccaacggccacggccccggcctgctgatcgagaacgcccagcccctgcccagcgccggcgaggaccaggtgctgcccggcctgcacccccccagcctggccgacaacctgagccacagacccctggccaactgcagaagcggcgagcagatcttcacccaggacgtgagacccgagcagctgctggagggcaaggacgcccaggccatccacaactggctgagcgagttccagctggagggctacaccgcccacttcctgcaggccggctacgacgtgcccaccatcagcagaatgacccccgaggacctgaccgccatcggcgtgaccaagcccggccacagaaagaagatcgccagcgagatcgcccagctgagcatcgccgagtggctgcccagctacatccccaccgacctgctggagtggctgtgcgccctgggcctgccccagtaccacaagcagctggtgagcagcggctacgacagcatgggcctggtggccgacctgacctgggaggagctgcaggagatcggcgtgaacaagctgggccaccagaagaagctgatgctgggcgtgaagagactggccgagctgagaagaggcctgctgcagggcgaggccctgagcgagggcggcagaagactggccaagggccccgagctgatggccatcgagggcctggagaacggcgagggccccgccaccgccggccccagactgctgaccttccagggcagcgagctgagccccgagctgcaggccgccatggccggcggcggccccgagcccctgcccctgccccccgccagaagccccagccaggagagcatcggcgccagaagcagaggcagcggccacagccaggagcagcccgccccccagcccagcggcggcgaccccagccccccccaggagagaaacctgcccgagggcaccgagagaccccccaagctgtgcagcagcctgcccggccagggcccccccccctacgtgttcatgtacccccagggcagccccagcagccccgcccccggccccccccccggcgccccctgggccttcagctacctggccggcccccccgccaccccccccgacccccccagacccaagagaagaagccacagcctgagcagacccggccccaccgagggcgacgccgagggcgaggccgagggccccgtgggcagcaccctgggcagctacgccaccctgaccagaagacccggcagaagcgccctggtgagaaccagccccagcgtgacccccacccccgccagaggcacccccagaagccagagcttcgccctgagagccagaagaaagggcccccccccccccccccccaagagactgagcagcgtgagcggccccagccccgagcccccccccctggacgagagccccggccccaaggagggcgccaccggccccagaagaagaaccctgagcgagcccgccggccccagcgagccccccggcccccccgcccccgccggccccgccagcgacaccgaggaggaggagcccggccccgagggcaccccccccagcagaggcagcagcggcgagggcctgcccttcgccgaggagggcaacctgaccatcaagcagagacccaagcccgccggccccccccccagagagacccccgtgccccccggcctggacttcaacctgaccgagagcgacaccgtgaagagaagacccaagtgcagagagagagagcccctgcagaccgccctgctggccttcggcgtggccagcgccacccccggccccgccgcccccctgcccagccccacccccggcgagagcccccccgccagcagcctgccccagcccgagcccagcagcctgcccgcccagggcgtgcccacccccctggcccccagccccgccatgcagccccccgtgcccccctgccccggccccggcctggagagcagcgccgccagcagatggaacggcgagaccgagccccccgccgcccccgccgccctgctgaaggtgcccggcgccggcaccgcccccaagcccgtgagcgtggcctgcacccagctggccttcagcggccccaagctggcccccagactgggccccagacccgtgcccccccccagacccgagagcaccggcaccgtgggccccggccaggcccagcagagactggagcagaccagcagcagcctggccgccgccctgagagccgccgagaagagcatcggcaccaaggagcaggagggcacccccagcgccagcaccaagcacatcctggacgacatcagcaccatgttcgacgccctggccgaccagctggacgccatgctggactag

SEQ ID NO: 75612 - DNA, 1026 bp, Artificial Sequence
  Description of Artificial Sequence: Synthetic coding sequence
atggccgacgagaagcccagcaacggcgtgctggtgcacatggtgaagctgctgatcaagaccttcctggacggcatcttcgacgacctgatggagaacaacgtgctgaacaccgacgagatccacctgatcggcaagtgcctgaagttcgtggtgagcaacgccgagaacctggtggacgacatcaccgagaccgcccagaccgccggcaagatcttcagagagcacctgtggaacagcaagaagcagctgagcagcgacatcagcagcgacggcgagagagaggccaacatgcccggcctgaacatcagaaacaaggagttcaactacctgcacaacagaaacggcagcgagctggacctgctgggcatgagagacctgctggagaacctgggctacagcgtggtgatcaaggagaacctgaccgcccaggagatggagaccgccctgagacagttcgccgcccaccccgagcaccagagcagcgacagcaccttcctggtgttcatgagccacagcatcctgaacggcatctgcggcaccaagcactgggaccaggagcccgacgtgctgcacgacgacaccatcttcgagatcttcaacaacagaaactgccagagcctgaaggacaagcccaaggtgatcatcatgcaggcctgcagaggcaacggcgccggcatcgtgtggttcaccaccgacagcggcaaggccggcgccgacacccacggcagactgctgcagggcaacatctgcaacgacgccgtgaccaaggcccacgtggagaaggacttcatcgccttcaagagcagcaccccccacaacgtgagctggagacacgagaccaacggcagcgtgttcatcagccagatcatctactacttcagagagtacagctggagccaccacctggaggagatcttccagaaggtgcagcacagcttcgagacccccaacatcctgacccagctgcccaccatcgagagactgagcatgaccagatacttctacctgttccccggcaactag

SEQ ID NO: 75613 - DNA, 1026 bp, Artificial Sequence; identical to SEQ ID NO: 75612
  Description of Artificial Sequence: Synthetic coding sequence

SEQ ID NO: 75614 - DNA, 834 bp, Artificial Sequence
  Description of Artificial Sequence: Synthetic coding sequence
atggagaacaccgagaacagcgtggacagcaagagcatcaagaacctggagcccaagatcatccacggcagcgagagcatggacagcggcatcagcctggacaacagctacaagatggactaccccgagatgggcctgtgcatcatcatcaacaacaagaacttccacaagagcaccggcatgaccagcagaagcggcaccgacgtggacgccgccaacctgagagagaccttcagaaacctgaagtacgaggtgagaaacaagaacgacctgaccagagaggagatcgtggagctgatgagagacgtgagcaaggaggaccacagcaagagaagcagcttcgtgtgcgtgctgctgagccacggcgaggagggcatcatcttcggcaccaacggccccgtggacctgaagaagatcaccaacttcttcagaggcgacagatgcagaagcctgaccggcaagcccaagctgttcatcatccaggcctgcagaggcaccgagctggactgcggcatcgagaccgacagcggcgtggacgacgacatggcctgccacaagatccccgtggaggccgacttcctgtacgcctacagcaccgcccccggctactacagctggagaaacagcaaggacggcagctggttcatccagagcctgtgcgccatgctgaagcagtacgccgacaagctggagttcatgcacatcctgaccagagtgaacagaaaggtggccaccgagttcgagagcttcagcttcgacgccaccttccacgccaagaagcagatcccctgcatcgtgagcatgctgaccaaggagctgtacttctaccactag

SEQ ID NO: 75615 - DNA, 471 bp, Artificial Sequence
  Description of Artificial Sequence: Synthetic coding sequence
atgagcgacgccctgatcaaggtgagcatggagaacaccgagaacagcgtggacagcaagagcatcaagaacctggagcccaagatcatccacggcagcgagagcatggacagcggcatcagcctggacaacagctacaagatggactaccccgagatgggcctgtgcatcatcatcaacaacaagaacttccacaagagcaccggcatgaccagcagaagcggcaccgacgtggacgccgccaacctgagagagaccttcagaaacctgaagtacgaggtgagaaacaagaacgacctgaccagagaggagatcgtggagctgatgagagacgtgagcaaggaggaccacagcaagagaagcagcttcgtgtgcgtgctgctgagccacggcgaggagggcatcatcttcggcaccaacggccccgtggacctgaagaacaacaagctgttccagagaggcagcctgtag

SEQ ID NO: 75616 - DNA, 354 bp, Artificial Sequence
  Description of Artificial Sequence: Synthetic coding sequence
atggagaacaccgagaacagcgtggacagcaagagcatcaagaacctggagcccaagatcatccacggcagcgagagcatggacagcggcatcagcctggacaacagctacaagatggactaccccgagatgggcctgtgcatcatcatcaacaacaagaacttccacaagagcaccggcatgaccagcagaagcggcaccgacgtggacgccgccaacctgagagagaccttcagaaacctgaagtacgaggtgagaaacaagaacgacctgaccagagaggagatcgtggagctgatgagagacgtgagcaaggaggaccacagcaagagaagcagcttcgtgtgcgtgtag

SEQ ID NO: 75617 - DNA, 834 bp, Artificial Sequence; identical to SEQ ID NO: 75614
  Description of Artificial Sequence: Synthetic coding sequence

SEQ ID NO: 75618 - DNA, 966 bp, Artificial Sequence
  Description of Artificial Sequence: Synthetic coding sequence
atggccgacagcatgcaggagaagcagagaatggccggccagatgctgctgcagaccttcttcaacatcgaccagatcagccccaacaagaaggcccaccccaacatggaggccggcccccccgagagcggcgagagcaccgacgccctgaagctgtgcccccacgaggagttcctgagactgtgcaaggagagagccgaggagatctaccccatcaaggagagaaacaacagaaccagactggccctgatcatctgcaacaccgagttcgaccacctgccccccagaaacggcgccgacttcgacatcaccggcatgaaggagctgctggagggcctggactacagcgtggacgtggaggagaacctgaccgccagagacatggagagcgccctgagagccttcgccaccagacccgagcacaagagcagcgacagcaccttcctggtgctgatgagccacggcatcctggagggcatctgcggcaccgtgcacgacgagaagaagcccgacgtgctgctgtacgacaccatcttccagatcttcaacaacagaaactgcctgagcctgaaggacaagcccaaggtgatcatcgtgcaggcctgcagaggcgccaacagaggcgagctgtgggtgagagacagccccgccagcctggaggtggccagcagccagagcagcgagaacctggaggaggacgccgtgtacaagacccacgtggagaaggacttcatcgccttctgcagcagcaccccccacaacgtgagctggagagacagcaccatgggcagcatcttcatcacccagctgatcacctgcttccagaagtacagctggtgctgccacctggaggaggtgttcagaaaggtgcagcagagcttcgagacccccagagccaaggcccagatgcccaccatcgagagactgagcatgaccagatacttctacctgttccccggcaactag

SEQ ID NO: 75619 - DNA, 213 bp, Artificial Sequence
  Description of Artificial Sequence: Synthetic coding sequence
atggagaagaaggagtgccccgagaagagcagcagcagcgaggaggagctgcccagaagagacagcggcagcagcagaaacatcgacgccagcaagctgatcagactgcagggcagcagaaagctgctggtggacaacagcatcagagagctgcagtacaccaagaccggcatcttcttccaggccgaggcctgcgtgaccaacgacacctag

SEQ ID NO: 75620 - DNA, 3099 bp, Artificial Sequence
  Description of Artificial Sequence: Synthetic coding sequence
atgcccggcagagccgaggccggcgaggccgaggaggaggccggcgccggcagcggcagcgaggccgaggaggacgccctgtgggagagaatcgagggcgtgagacacagactggccagagccctgaaccccgccaagctgaccccctacctgagacagtgcagagtgatcgacgagcaggacgaggaggaggtgctgagcacctacagattcccctgcagagtgaacagaaccggcagactgatggacatcctgagatgcagaggcaagagaggctacgaggccttcctggaggccctggagttctactaccccgagcacttcaccctgctgaccggccaggagcccgcccagagatgcagcatgatcctggacgaggagggccccgagggcctgacccagttcctgatgaccgaggtgagaagactgagagaggccagaaagagccagctgcagagagagcagcagctgcaggccagaggcagagtgctggaggaggagagagccggcctggagcagagactgagagaccagcagcaggcccaggagagatgccagagactgagagaggactgggaggccggcagcctggagctgctgagactgaaggacgagaactacatgatcgccatgagactggcccagctgagcgaggagaagaacagcgccgtgctgagaagcagagacctgcagctggccgtggaccagctgaagctgaaggtgagcagactggaggaggagtgcgccctgctgagaagagccagaggccccccccccggcgccgaggagaaggagaaggagaaggagaaggagaaggagcccgacaacgtggacctggtgagcgagctgagagccgagaaccagagactgaccgccagcctgagagagctgcaggagggcctgcagcaggaggccagcagacccggcgcccccggcagcgagagaatcctgctggacatcctggagcacgactggagagaggcccaggacagcagacaggagctgtgccagaagctgcacgccgtgcagggcgagctgcagtgggccgaggagctgagagaccagtacctgcaggagatggaggacctgagactgaagcacagaaccctgcagaaggactgcgacctgtacaagcacagaatggccaccgtgctggcccagctggaggagatcgagaaggagagagaccaggccatccagagcagagacagaatccagctgcagtacagccagagcctgatcgagaaggaccagtacagaaagcaggtgagaggcctggaggccgagagagacgagctgctgaccaccctgaccagcctggagggcaccaaggccctgctggaggtgcagctgcagagagcccagggcggcacctgcctgaaggcctgcgccagcagccacagcctgtgcagcaacctgagcagcacctggagcctgagcgagttccccagccccctgggcggccccgaggccaccggcgaggccgccgtgatgggcggccccgagccccacaacagcgaggaggccaccgacagcgagaaggagatcaacagactgagcatcctgcccttcccccccagcgccggcagcatcctgagaagacagagagaggaggaccccgccccccccaagagaagcttcagcagcatgagcgacatcaccggcagcgtgaccctgaagccctggagccccggcctgagcagcagcagcagcagcgacagcgtgtggcccctgggcaagcccgagggcctgctggccagaggctgcggcctggacttcctgaacagaagcctggccatcagagtgagcggcagaagcccccccggcggccccgagccccaggacaagggccccgacggcctgagcttctacggcgacagatggagcggcgccgtggtgagaagagtgctgagcggccccggcagcgccagaatggagcccagagagcagagagtggaggccgccggcctggagggcgcctgcctggaggccgaggcccagcagagaaccctgctgtggaaccagggcagcaccctgcccagcctgatggacagcaaggcctgccagagcttccacgaggccctggaggcctgggccaagggccccggcgccgagcccttctacatcagagccaacctgaccctgcccgagagagccgacccccacgccctgtgcgtgaaggcccaggagatcctgagactggtggacagcgcctacaagagaagacaggagtggttctgcaccagagtggaccccctgaccctgagagacctggacagaggcaccgtgcccaactaccagagagcccagcagctgctggaggtgcaggagaagtgcctgcccagcagcagacacagaggccccagaagcaacctgaagaagagagccctggaccagctgagactggtgagacccaagcccgtgggcgcccccgccggcgacagccccgaccagctgctgctggagccctgcgccgagcccgagagaagcctgagaccctacagcctggtgagacccctgctggtgagcgccctgagacccgtggtgctgctgcccgagtgcctggcccccagactgatcagaaacctgctggacctgcccagcagcagactggacttccaggtgtgccccgccgagagcctgagcggcgaggagctgtgccccagcagcgcccccggcgcccccaaggcccagcccgccacccccggcctgggcagcagaatcagagccatccaggagagcgtgggcaagaagcactgcctgctggagctgggcgccagaggcgtgagagagctggtgcagaacgagatctaccccatcgtgatccacgtggaggtgaccgagaagaacgtgagagaggtgagaggcctgctgggcagacccggctggagagacagcgagctgctgagacagtgcagaggcagcgagcaggtgctgtggggcctgccctgcagctgggtgcaggtgcccgcccacgagtggggccacgccgaggagctggccaaggtggtgagaggcagaatcctgcaggagcaggccagactggtgtgggtggagtgcggcagcagcagaggctgccccagcagcagcgaggcctag

SEQ ID NO: 75621 - DNA, 3099 bp, Artificial Sequence; identical to SEQ ID NO: 75620
  Description of Artificial Sequence: Synthetic coding sequence

SEQ ID NO: 75622 - DNA, 2241 bp, Artificial Sequence
  Description of Artificial Sequence: Synthetic coding sequence
atgggcgtgggcgtgggcctgggcaacggcctgagactgctgccctggatggaggccagcagacccggcgcccccggcagcgagagaatcctgctggacatcctggagcacgactggagagaggcccaggacagcagacaggagctgtgccagaagctgcacgccgtgcagggcgagctgcagtgggccgaggagctgagagaccagtacctgcaggagatggaggacctgagactgaagcacagaaccctgcagaaggactgcgacctgtacaagcacagaatggccaccgtgctggcccagctggaggagatcgagaaggagagagaccaggccatccagagcagagacagaatccagctgcagtacagccagagcctgatcgagaaggaccagtacagaaagcaggtgagaggcctggaggccgagagagacgagctgctgaccaccctgaccagcctggagggcaccaaggccctgctggaggtgcagctgcagagagcccagggcggcacctgcctgaaggcctgcgccagcagccacagcctgtgcagcaacctgagcagcacctggagcctgagcgagttccccagccccctgggcggccccgaggccaccggcgaggccgccgtgatgggcggccccgagccccacaacagcgaggaggccaccgacagcgagaaggagatcaacagactgagcatcctgcccttcccccccagcgccggcagcatcctgagaagacagagagaggaggaccccgccccccccaagagaagcttcagcagcatgagcgacatcaccggcagcgtgaccctgaagccctggagccccggcctgagcagcagcagcagcagcgacagcgtgtggcccctgggcaagcccgagggcctgctggccagaggctgcggcctggacttcctgaacagaagcctggccatcagagtgagcggcagaagcccccccggcggccccgagccccaggacaagggccccgacggcctgagcttctacggcgacagatggagcggcgccgtggtgagaagagtgctgagcggccccggcagcgccagaatggagcccagagagcagagagtggaggccgccggcctggagggcgcctgcctggaggccgaggcccagcagagaaccctgctgtggaaccagggcagcaccctgcccagcctgatggacagcaaggcctgccagagcttccacgaggccctggaggcctgggccaagggccccggcgccgagcccttctacatcagagccaacctgaccctgcccgagagagccgacccccacgccctgtgcgtgaaggcccaggagatcctgagactggtggacagcgcctacaagagaagacaggagtggttctgcaccagagtggaccccctgaccctgagagacctggacagaggcaccgtgcccaactaccagagagcccagcagctgctggaggtgcaggagaagtgcctgcccagcagcagacacagaggccccagaagcaacctgaagaagagagccctggaccagctgagactggtgagacccaagcccgtgggcgcccccgccggcgacagccccgaccagctgctgctggagccctgcgccgagcccgagagaagcctgagaccctacagcctggtgagacccctgctggtgagcgccctgagacccgtggtgctgctgcccgagtgcctggcccccagactgatcagaaacctgctggacctgcccagcagcagactggacttccaggtgtgccccgccgagagcctgagcggcgaggagctgtgccccagcagcgcccccggcgcccccaaggcccagcccgccacccccggcctgggcagcagaatcagagccatccaggagagcgtgggcaagaagcactgcctgctggagctgggcgccagaggcgtgagagagctggtgcagaacgagatctaccccatcgtgatccacgtggaggtgaccgagaagaacgtgagagaggtgagaggcctgctgggcagacccggctggagagacagcgagctgctgagacagtgcagaggcagcgagcaggtgctgtggggcctgccctgcagctgggtgcaggtgcccgcccacgagtggggccacgccgaggagctggccaaggtggtgagaggcagaatcctgcaggagcaggccagactggtgtgggtggagtgcggcagcagcagaggctgccccagcagcagcgaggcctag

SEQ ID NO: 75623 - DNA, 1443 bp, Artificial Sequence
  Description of Artificial Sequence: Synthetic coding sequence
atggaggacctgagactgaagcacagaaccctgcagaaggactgcgacctgtacaagcacagaatggccaccgtgctggcccagctggaggagatcgagaaggagagagaccaggccatccagagcagagacagaatccagctgcagtacagccagagcctgatcgagaaggaccagtacagaaagcaggtgagaggcctggaggccgagagagacgagctgctgaccaccctgaccagcctggagggcaccaaggccctgctggaggtgcagctgcagagagcccagggcggcacctgcctgaaggcctgcgccagcagccacagcctgtgcagcaacctgagcagcacctggagcctgagcgagttccccagccccctgggcggccccgaggccaccggcgaggccgccgtgatgggcggccccgagccccacaacagcgaggaggccaccgacagcgagaaggagatcaacagactgagcatcctgcccttcccccccagcgccggcagcatcctgagaagacagagagaggaggaccccgccccccccaagagaagcttcagcagcatgagcgacatcaccggcagcgtgaccctgaagccctggagccccggcctgagcagcagcagcagcagcgacagcgtgtggcccctgggcaagcccgagggcctgctggccagaggctgcggcctggacttcctgaacagaagcctggccatcagagtgagcggcagaagcccccccggcggccccgagccccaggacaagggccccgacggcctgagcttctacggcgacagatggagcggcgccgtggtgagaagagtgctgagcggccccggcagcgccagaatggagcccagagagcagagagtggaggccgccggcctggagggcgcctgcctggaggccgaggcccagcagagaaccctgctgtggaaccagggcagcaccctgcccagcctgatggacagcaaggcctgccagagcttccacgaggccctggaggcctgggccaagggccccggcgccgagcccttctacatcagagccaacctgaccctgcccgagagagccgacccccacgccctgtgcgtgaaggcccaggagatcctgagactggtggacagcgcctacaagagaagacaggagtggttctgcaccagagtggaccccctgaccctgagagacctggacagaggcaccgtgcccaactaccagagagcccagcagctgctggaggtgcaggagaagtgcctgcccagcagcagacacagaggccccagaagcaacctgaagaagagagccctggaccagctgagactggtgagacccaagcccgtgggcgcccccgccggcgacagccccgaccagctgctgctggagccctgcgccgagcccgagagaagcctgagaccctacagcctggtgagaccctag

SEQ ID NO: 75624 - DNA, 222 bp, Artificial Sequence
  Description of Artificial Sequence: Synthetic coding sequence
atgcccggcggcggccccgagatggacgactacatggagaccctgaaggacgaggaggacgccctgtgggagaacgtggagtgcaacagacacatgctgagcagatacatcaaccccgccaagctgaccccctacctgagacagtgcaaggtgatcgacgagcaggacgaggacgaggtgctgaacgcccccatgctgcccagcaagatcaacagagcctag

SEQ ID NO: 75625 - DNA, 3465 bp, Artificial Sequence
  Description of Artificial Sequence: Synthetic coding sequence
atgcccggcggcggccccgagatggacgactacatggagaccctgaaggacgaggaggacgccctgtgggagaacgtggagtgcaacagacacatgctgagcagatacatcaaccccgccaagctgaccccctacctgagacagtgcaaggtgatcgacgagcaggacgaggacgaggtgctgaacgcccccatgctgcccagcaagatcaacagagccggcagactgctggacatcctgcacaccaagggccagagaggctacgtggtgttcctggagagcctggagttctactaccccgagctgtacaagctggtgaccggcaaggagcccaccagaagattcagcaccatcgtggtggaggagggccacgagggcctgacccacttcctgatgaacgaggtgatcaagctgcagcagcagatgaaggccaaggacctgcagagatgcgagctgctggccagactgagacagctggaggacgagaagaagcagatgaccctgaccagagtggagctgctgaccttccaggagagatactacaagatgaaggaggagagagacagctacaacgacgagctggtgaaggtgaaggacgacaactacaacctggccatgagatacgcccagctgagcgaggagaagaacatggccgtgatgagaagcagagacctgcagctggagatcgaccagctgaagcacagactgaacaagatggaggaggagtgcaagctggagagaaaccagagcctgaagctgaagaacgacatcgagaacagacccaagaaggagcaggtgctggagctggagagagagaacgagatgctgaagaccaagaaccaggagctgcagagcatcatccaggccggcaagagaagcctgcccgacagcgacaaggccatcctggacatcctggagcacgacagaaaggaggccctggaggacagacaggagctggtgaacagaatctacaacctgcaggaggaggccagacaggccgaggagctgagagacaagtacctggaggagaaggaggacctggagctgaagtgcagcaccctgggcaaggactgcgagatgtacaagcacagaatgaacaccgtgatgctgcagctggaggaggtggagagagagagagaccaggccttccacagcagagacgaggcccagacccagtacagccagtgcctgatcgagaaggacaagtacagaaagcagatcagagagctggaggagaagaacgacgagatgagaatcgagatggtgagaagagaggcctgcatcgtgaacctggagagcaagctgagaagactgagcaaggacagcaacaacctggaccagagcctgcccagaaacctgcccgtgaccatcatcagccaggacttcggcgacgccagccccagaaccaacggccaggaggccgacgacagcagcaccagcgaggagagccccgaggacagcaagtacttcctgccctaccaccccccccagagaagaatgaacctgaagggcatccagctgcagagagccaagagccccatcagcctgaagagaaccagcgacttccaggccaagggccacgaggaggagggcaccgacgccagccccagcagctgcggcagcctgcccatcaccaacagcttcaccaagatgcagccccccagaagcagaagcagcatcatgagcatcaccgccgagccccccggcaacgacagcatcgtgagaagatacaaggaggacgccccccacagaagcaccgtggaggaggacaacgacagcggcggcttcgacgccctggacctggacgacgacagccacgagagatacagcttcggccccagcagcatccacagcagcagcagcagccaccagagcgagggcctggacgcctacgacctggagcaggtgaacctgatgttcagaaagttcagcctggagagacccttcagacccagcgtgaccagcgtgggccacgtgagaggccccggccccagcgtgcagcacaccaccctgaacggcgacagcctgaccagccagctgaccctgctgggcggcaacgccagaggcagcttcgtgcacagcgtgaagcccggcagcctggccgagaaggccggcctgagagagggccaccagctgctgctgctggagggctgcatcagaggcgagagacagagcgtgcccctggacacctgcaccaaggaggaggcccactggaccatccagagatgcagcggccccgtgaccctgcactacaaggtgaaccacgagggctacagaaagctggtgaaggacatggaggacggcctgatcaccagcggcgacagcttctacatcagactgaacctgaacatcagcagccagctggacgcctgcaccatgagcctgaagtgcgacgacgtggtgcacgtgagagacaccatgtaccaggacagacacgagtggctgtgcgccagagtggaccccttcaccgaccacgacctggacatgggcaccatccccagctacagcagagcccagcagctgctgctggtgaagctgcagagactgatgcacagaggcagcagagaggaggtggacggcacccaccacaccctgagagccctgagaaacaccctgcagcccgaggaggccctgagcaccagcgaccccagagtgagccccagactgagcagagccagcttcctgttcggccagctgctgcagttcgtgagcagaagcgagaacaagtacaagagaatgaacagcaacgagagagtgagaatcatcagcggcagccccctgggcagcctggccagaagcagcctggacgccaccaagctgctgaccgagaagcaggaggagctggaccccgagagcgagctgggcaagaacctgagcctgatcccctacagcctggtgagagccttctactgcgagagaagaagacccgtgctgttcacccccaccgtgctggccaagaccctggtgcagagactgctgaacagcggcggcgccatggagttcaccatctgcaagagcgacatcgtgaccagagacgagttcctgagaagacagaagaccgagaccatcatctacagcagagagaagaaccccaacgccttcgagtgcatcgcccccgccaacatcgaggccgtggccgccaagaacaagcactgcctgctggaggccggcatcggctgcaccagagacctgatcaagagcaacatctaccccatcgtgctgttcatcagagtgtgcgagaagaacatcaagagattcagaaagctgctgcccagacccgagaccgaggaggagttcctgagagtgtgcagactgaaggagaaggagctggaggccctgccctgcctgtacgccaccgtggagcccgacatgtggggcagcgtggaggagctgctgagagtggtgaaggacaagatcggcgaggagcagagaaagaccatctgggtggacgaggaccagctgtag

SEQ ID NO: 75626 - DNA, 3114 bp, Artificial Sequence
  Description of Artificial Sequence: Synthetic coding sequence
atggccaccgagagcacccccagcgagatcatcgagagagagagaaagaagctgctggagatcctgcagcacgaccccgacagcatcctggacaccctgaccagcagaagactgatcagcgaggaggagtacgagaccctggagaacgtgaccgacctgctgaagaagagcagaaagctgctgatcctggtgcagaagaagggcgaggccacctgccagcacttcctgaagtgcctgttcagcaccttcccccagagcgccgccatctgcggcctgagacacgaggtgctgaagcacgagaacaccgtgcccccccagagcatgggcgccagcagcaacagcgaggacgccttcagccccggcatcaagcagcccgaggcccccgagatcaccgtgttcttcagcgagaaggagcacctggacctggagaccagcgagttcttcagagacaagaagaccagctacagagagaccgccctgagcgccagaaagaacgagaaggagtacgacacccccgaggtgaccctgagctacagcgtggagaaggtgggctgcgaggtgcccgccaccatcacctacatcaaggacggccagagatacgaggagctggacgacagcctgtacctgggcaaggaggagtacctgggcagcgtggacacccccgaggacgccgaggccaccgtggaggaggaggtgtacgacgaccccgagcacgtgggctacgacggcgaggaggacttcgagaacagcgagaccaccgagttcagcggcgaggagcccagctacgagggcagcgagaccagcctgagcctggaggaggagcaggagaagagcatcgaggagagaaagaaggtgttcaaggacgtgctgctgtgcctgaacatggacagaagcagaaaggtgctgcccgacttcgtgaagcagttcagcctggacagaggctgcaagtggacccccgagagccccggcgacctggcctggaacttcctgatgaaggtgcaggccagagacgtgaccgccagagacagcatcctgagccacaaggtgctggacgaggacagcaaggaggacctgctggccggcgtggagaacctggagatcagagacatccagaccatcaaccccctggacgtgctgtgcgccaccatgctgtgcagcgacagcagcctgcagagacaggtgatgagcaacatgtaccagtgccagttcgccctgcccctgctgctgcccgacgccgagaacaacaagagcatcctgatgctgggcgccatgaaggacatcgtgaagaagcagagcacccagttcagcggcggccccaccgaggacaccgagaagttcctgaccctgatgaagatgcccgtgatcagcttcgtgagactgggctactgcagcttcagcaagagcagaatcctgaacaccctgctgagccccgcccagctgaagctgcacaagatcttcctgcaccaggacctgcccctgctggtgctgcccagacagatcagcgacggcctggtggagatcacctggtgcttccccgacagcgacgacagaaaggagaaccccttcttccagaagcccgtggccctggccaacctgagaggcaacctggagagcttctggacccagttcggcttcctgatggaggtgagcagcgccgtgttcttcttcaccgactgcctgggcgagaaggagtgggacctgctgatgttcctgggcgaggccgccatcgagagatgctacttcgtgctgagcagccaggccagagagagcgaggaggcccagatcttccagagaatcctgaacctgaagcccgcccagctgctgttctgggagagaggcgacgccggcgacagaagaaagaacatggagggcctgcaggccgccctgcaggaggtgatgttcagcagctgcctgagatgcgtgagcgtggaggacatggccgccctggccagagagctgggcatccaggtggacgaggacttcgagaacacccagagaatccaggtgagcagcggcgagaacatggccggcaccgccgagggcgagggccagcagagacacagccagctgaagagcagcagcaagagccaggccctgatgcccatccaggagcccggcacccagtgcgagctgagccagaacctgcagaacctgtacggcacccccgtgttcagacccgtgctggagaacagctggctgttccccaccagaatcggcggcaacttcaaccacgtgagcctgaaggccagctgggtgatgggcagacccttcggcagcgagcagagacccaagtggttccaccccctgcccttccagaacgccggcgcccagggcagaggcaagagcttcggcatccagagcttccacccccagatcttctacagcggcgagagattcatgaagttcagcagagtggccagaggctgccacagcaacggcaccttcggcagactgcccagacccatctgccagcacgtgcaggcctgccccgagagaccccagatgatgggcaccctggagagaagcagagccgtggccagcaagatcggccacagctacagcctggacagccagcccgccagagccgtgggcaagccctggccccagcaggcctgcaccagagtgaccgagctgaccgaggccaccggcaagctgatcagaaccagccacatcggcaagccccacccccagagcttccagcccgccgccgccacccagaagctgagacccgccagccagcagggcgtgcagatgaagacccagggcggcgccagcaaccccgccctgcagatcggcagccaccccatgtgcaagagcagccagttcaagagcgaccagagcaaccccagcaccgtgaagcacagccagcccaagcccttccacagcgtgcccagccagcccaagagcagccagaccaagagctgccagagccagcccagccagaccaagcccagcccctgcaagagcacccagcccaagcccagccagccctggcccccccagagcaagcccagccagcccagacccccccagcccaagagcagcagcaccaaccccagccaggccaaggcccaccacagcaaggccggccagaagagaggcggcaagcactag

SEQ ID NO: 75627 - DNA, 933 bp, Artificial Sequence
  Description of Artificial Sequence: Synthetic coding sequence
atggccaccgagagcacccccagcgagatcatcgagagagagagaaagaagctgctggagatcctgcagcacgaccccgacagcatcctggacaccctgaccagcagaagactgatcagcgaggaggagtacgagaccctggagaacgtgaccgacctgctgaagaagagcagaaagctgctgatcctggtgcagaagaagggcgaggccacctgccagcacttcctgaagtgcctgttcagcaccttcccccagagcgccgccatctgcggcctgagacccgaggtgctgaagcacgagaacaccgtgcccccccagagcatgggcgccagcagcaacagcgaggacgccttcagccccggcatcaagcagcccgaggcccccgagatcaccgtgttcttcagcgagaaggagcacctggacctggagaccagcgagttcttcagagacaagaagaccagctacagagagaccgccctgagcgccagaaagaacgagaaggagtacgacacccccgaggtgaccctgagctacagcgtggagaaggtgggctgcgaggtgcccgccaccatcacctacatcaaggacggccagagatacgaggagctggacgacagcctgtacctgggcaaggaggagtacctgggcagcgtggacacccccgaggacgccgaggccaccgtggaggaggaggtgtacgacgaccccgagcacgtgggctacgacggcgaggaggacttcgagaacagcgagaccaccgagttcagcggcgaggagcccagctacgagggcagcgagaccagcctgagcctggaggaggagcaggagaagagcatcgagggctggagcagaacccacggcctgaagagaagcagccacgtgggcctgcccaagtgctgggactacagaagagagcccccctgcctggcctag

SEQ ID NO: 75628 - DNA, 1446 bp, Artificial Sequence
  Description of Artificial Sequence: Synthetic coding sequence
atggccaccgagagcacccccagcgagatcatcgagagagagagaaagaagctgctggagatcctgcagcacgaccccgacagcatcctggacaccctgaccagcagaagactgatcagcgaggaggagtacgagaccctggagaacgtgaccgacctgctgaagaagagcagaaagctgctgatcctggtgcagaagaagggcgaggccacctgccagcacttcctgaagtgcctgttcagcaccttcccccagagcgccgccatctgcggcctgagacacgaggtgctgaagcacgagaacaccgtgcccccccagagcatgggcgccagcagcaacagcgaggacgccttcagccccggcatcaagcagcccgaggcccccgagatcaccgtgttcttcagcgagaaggagcacctggacctggagaccagcgagttcttcagagacaagaagaccagctacagagagaccgccctgagcgccagaaagaacgagaaggagtacgacacccccgaggtgaccctgagctacagcgtggagaaggtgggctgcgaggtgcccgccaccatcacctacatcaaggacggccagagatacgaggagctggacgacagcctgtacctgggcaaggaggagtacctgggcagcgtggacacccccgaggacgccgaggccaccgtggaggaggaggtgtacgacgaccccgagcacgtgggctacgacggcgaggaggacttcgagaacagcgagaccaccgagttcagcggcgaggagcccagctacgagggcagcgagaccagcctgagcctggaggaggagcaggagaagagcatcgaggagagaaagaaggtgttcaaggacgtgctgctgtgcctgaacatggacagaagcagaaaggtgctgcccgacttcgtgaagcagttcagcctggacagaggctgcaagtggacccccgagagccccggcgacctggcctggaacttcctgatgaaggtgcaggccagagacgtgaccgccagagacagcatcctgagccacaaggtgctggacgaggacagcaaggaggacctgctggccggcgtggagaacctggagatcagagacatccagaccatcaaccccctggacgtgctgtgcgccaccatgctgtgcagcgacagcagcctgcagagacaggtgatgagcaacatgtaccagtgccagttcgccctgcccctgctgctgcccgacgccgagaacaacaagagcatcctgatgctgggcgccatgaaggacatcgtgaagaagcagagcacccagttcagcggcggccccaccgaggacaccgagaagttcctgaccctgatgaagaccctgaagaccctgagagagttcaagttccccctggagaagacctggctgggccagctgaaggtgagagtgagcaaggacaccgtgagctag

SEQ ID NO: 75629 - DNA, 570 bp, Artificial Sequence
  Description of Artificial Sequence: Synthetic coding sequence
atggtgctggagcaccccgccagagtggagcccttctacgccgtgctggagagccccagcttcagcctgatgggcatcctgctgagaatcgccagcggcaccagactgagcatccccatcaccagcaacaccctgatctactaccacccccaccccgaggacatcaagttccacctgtacctggtgcccagcgacgccctgctgaccaaggccatcgacgacgaggaggacagattccacggcgtgagactgcagaccagcccccccatggagcccctgaacttcggcagcagctacatcgtgagcaacagcgccaacctgaaggtgatgcccaaggagctgaagctgagctacagaagccccggcgagatccagcacttcagcaagttctacgccggccagatgaaggagcccatccagctggagatcaccgagaagagacacggcaccctggtgtgggacaccgaggtgaagcccgtggacctgcagctggtggccgccagcgcccccccccccttcagcggcctgctgtggcagagacagcccctgaaccccccccccgccagatag

SEQ ID NO: 75630 - DNA, 1296 bp, Artificial Sequence
  Description of Artificial Sequence: Synthetic coding sequence
atgatgagacagagacagagccactactgcagcgtgctgttcctgagcgtgaactacctgggcggcaccttccccggcgacatctgcagcgaggagaaccagatcgtgagcagctacgccagcaaggtgtgcttcgagatcgaggaggactacaagaacagacagttcctgggccccgagggcaacgtggacgtggagctgatcgacaagagcaccaacagatacagcgtgtggttccccaccgccggctggtacctgtggagcgccaccggcctgggcttcctggtgagagacgaggtgaccgtgaccatcgccttcggcagctggagccagcacctggccctggacctgcagcaccacgagcagtggctggtgggcggccccctgttcgacgtgaccgccgagcccgaggaggccgtggccgagatccacctgccccacttcatcagcctgcagggcgaggtggacgtgagctggttcctggtggcccacttcaagaacgagggcatggtgctggagcaccccgccagagtggagcccttctacgccgtgctggagagccccagcttcagcctgatgggcatcctgctgagaatcgccagcggcaccagactgagcatccccatcaccagcaacaccctgatctactaccacccccaccccgaggacatcaagttccacctgtacctggtgcccagcgacgccctgctgaccaaggccatcgacgacgaggaggacagattccacggcgtgagactgcagaccagcccccccatggagcccctgaacttcggcagcagctacatcgtgagcaacagcgccaacctgaaggtgatgcccaaggagctgaagctgagctacagaagccccggcgagatccagcacttcagcaagttctacgccggccagatgaaggagcccatccagctggagatcaccgagaagagacacggcaccctggtgtgggacaccgaggtgaagcccgtggacctgcagctggtggccgccagcgcccccccccccttcagcggcgccgccttcgtgaaggagaaccacagacagctgcaggccagaatgggcgacctgaagggcgtgctggacgacctgcaggacaacgaggtgctgaccgagaacgagaaggagctggtggagcaggagaagaccagacagagcaagaacgaggccctgctgagcatggtggagaagaagggcgacctggccctggacgtgctgttcagaagcatcagcgagagagacccctacctggtgagctacctgagacagcagaacctgtag

SEQ ID NO: 75631 - DNA, 1614 bp, Artificial Sequence
  Description of Artificial Sequence: Synthetic coding sequence
atggagaagaaggagtgccccgagaagagcagcagcagcgaggaggagctgcccagaagagacagcggcagcagcagaaacatcgacgccagcaagctgatcagactgcagggcagcagaaagctgctggtggacaacagcatcagagagctgcagtacaccaagaccggcatcttcttccaggccgaggcctgcgtgaccaacgacaccgtgtacagagagctgccctgcgtgagcgagaccctgtgcgacatcagccacttcttccaggaggacgacgagaccgaggccgagcccctgctgttcagagccgtgcccgagtgccagctgagcggcggcgacatccccagcgtgagcgaggagcaggagagcagcgagggccaggacagcggcgacatctgcagcgaggagaaccagatcgtgagcagctacgccagcaaggtgtgcttcgagatcgaggaggactacaagaacagacagttcctgggccccgagggcaacgtggacgtggagctgatcgacaagagcaccaacagatacagcgtgtggttccccaccgccggctggtacctgtggagcgccaccggcctgggcttcctggtgagagacgaggtgaccgtgaccatcgccttcggcagctggagccagcacctggccctggacctgcagcaccacgagcagtggctggtgggcggccccctgttcgacgtgaccgccgagcccgaggaggccgtggccgagatccacctgccccacttcatcagcctgcaggccggcgaggtggacgtgagctggttcctggtggcccacttcaagaacgagggcatggtgctggagcaccccgccagagtggagcccttctacgccgtgctggagagccccagcttcagcctgatgggcatcctgctgagaatcgccagcggcaccagactgagcatccccatcaccagcaacaccctgatctactaccacccccaccccgaggacatcaagttccacctgtacctggtgcccagcgacgccctgctgaccaaggccatcgacgacgaggaggacagattccacggcgtgagactgcagaccagcccccccatggagcccctgaacttcggcagcagctacatcgtgagcaacagcgccaacctgaaggtgatgcccaaggagctgaagctgagctacagaagccccggcgagatccagcacttcagcaagttctacgccggccagatgaaggagcccatccagctggagatcaccgagaagagacacggcaccctggtgtgggacaccgaggtgaagcccgtggacctgcagctggtggccgccagcgcccccccccccttcagcggcgccgccttcgtgaaggagaaccacagacagctgcaggccagaatgggcgacctgaagggcgtgctggacgacctgcaggacaacgaggtgctgaccgagaacgagaaggagctggtggagcaggagaagaccagacagagcaagaacgaggccctgctgagcatggtggagaagaagggcgacctggccctggacgtgctgttcagaagcatcagcgagagagacccctacctggtgagctacctgagacagcagaacctgtag

SEQ ID NO: 75632 - DNA, 1464 bp, Artificial Sequence
  Description of Artificial Sequence: Synthetic coding sequence
atggagaagaaggagtgccccgagaagagcagcagcagcgaggaggagctgcccagaagagtgtacagagagctgccctgcgtgagcgagaccctgtgcgacatcagccacttcttccaggaggacgacgagaccgaggccgagcccctgctgttcagagccgtgcccgagtgccagctgagcggcggcgacatccccagcgtgagcgaggagcaggagagcagcgagggccaggacagcggcgacatctgcagcgaggagaaccagatcgtgagcagctacgccagcaaggtgtgcttcgagatcgaggaggactacaagaacagacagttcctgggccccgagggcaacgtggacgtggagctgatcgacaagagcaccaacagatacagcgtgtggttccccaccgccggctggtacctgtggagcgccaccggcctgggcttcctggtgagagacgaggtgaccgtgaccatcgccttcggcagctggagccagcacctggccctggacctgcagcaccacgagcagtggctggtgggcggccccctgttcgacgtgaccgccgagcccgaggaggccgtggccgagatccacctgccccacttcatcagcctgcaggccggcgaggtggacgtgagctggttcctggtggcccacttcaagaacgagggcatggtgctggagcaccccgccagagtggagcccttctacgccgtgctggagagccccagcttcagcctgatgggcatcctgctgagaatcgccagcggcaccagactgagcatccccatcaccagcaacaccctgatctactaccacccccaccccgaggacatcaagttccacctgtacctggtgcccagcgacgccctgctgaccaaggccatcgacgacgaggaggacagattccacggcgtgagactgcagaccagcccccccatggagcccctgaacttcggcagcagctacatcgtgagcaacagcgccaacctgaaggtgatgcccaaggagctgaagctgagctacagaagccccggcgagatccagcacttcagcaagttctacgccggccagatgaaggagcccatccagctggagatcaccgagaagagacacggcaccctggtgtgggacaccgaggtgaagcccgtggacctgcagctggtggccgccagcgcccccccccccttcagcggcgccgccttcgtgaaggagaaccacagacagctgcaggccagaatgggcgacctgaagggcgtgctggacgacctgcaggacaacgaggtgctgaccgagaacgagaaggagctggtggagcaggagaagaccagacagagcaagaacgaggccctgctgagcatggtggagaagaagggcgacctggccctggacgtgctgttcagaagcatcagcgagagagacccctacctggtgagctacctgagacagcagaacctgtag

SEQ ID NO: 75633 - DNA, 1101 bp, Artificial Sequence
  Description of Artificial Sequence: Synthetic coding sequence
atgagcgactacgagaacgacgacgagtgctggagcgtgctggagggcttcagagtgaccctgaccagcgtgatcgaccccagcagaatcaccccctacctgagacagtgcaaggtgctgaaccccgacgacgaggagcaggtgctgagcgaccccaacctggtgatcagaaagagaaaggtgggcgtgctgctggacatcctgcagagaaccggccacaagggctacgtggccttcctggagagcctggagctgtactacccccagctgtacaagaaggtgaccggcaaggagcccgccagagtgttcagcatgatcatcgacgccagcggcgagagcggcctgacccagctgctgatgaccgaggtgatgaagctgcagaagaaggtgcaggacctgaccgccctgctgagcagcaaggacgacttcatcaaggagctgagagtgaaggacagcctgctgagaaagcaccaggagagagtgcagagactgaaggaggagtgcgaggccggcagcagagagctgaagagatgcaaggaggagaactacgacctggccatgagactggcccaccagagcgaggagaagggcgccgccctgatgagaaacagagacctgcagctggagatcgaccagctgaagcacagcctgatgaaggccgaggacgactgcaaggtggagagaaagcacaccctgaagctgagacacgccatggagcagagacccagccaggagctgctgtgggagctgcagcaggagaaggccctgctgcaggccagagtgcaggagctggaggccagcgtgcaggagggcaagctggacagaagcagcccctacatccaggtgctggaggaggactggagacaggccctgagagaccaccaggagcaggccaacaccatcttcagcctgagaaaggacctgagacagggcgaggccagaagactgagatgcatggaggagaaggagatgttcgagctgcagtgcctggccctgagaaaggacagcaagatgtacaaggacagaatcgaggccatcctgctgcagatggaggaggtggccatcgagagagaccagagcacccagatggagggcctgtag

SEQ ID NO: 75634 - DNA, 1611 bp, Artificial Sequence
  Description of Artificial Sequence: Synthetic coding sequence
atgagcgactacgagaacgacgacgagtgctggagcgtgctggagggcttcagagtgaccctgaccagcgtgatcgaccccagcagaatcaccccctacctgagacagtgcaaggtgctgaaccccgacgacgaggagcaggtgctgagcgaccccaacctggtgatcagaaagagaaaggtgggcgtgctgctggacatcctgcagagaaccggccacaagggctacgtggccttcctggagagcctggagctgtactacccccagctgtacaagaaggtgaccggcaaggagcccgccagagtgttcagcatgatcatcgacgccagcggcgagagcggcctgacccagctgctgatgaccgaggtgatgaagctgcagaagaaggtgcaggacctgaccgccctgctgagcagcaaggacgacttcatcaaggagctgagagtgaaggacagcctgctgagaaagcaccaggagagagtgcagagactgaaggaggagtgcgaggccggcagcagagagctgaagagatgcaaggaggagaactacgacctggccatgagactggcccaccagagcgaggagaagggcgccgccctgatgagaaacagagacctgcagctggagatcgaccagctgaagcacagcctgatgaaggccgaggacgactgcaaggtggagagaaagcacaccctgaagctgagacacgccatggagcagagacccagccaggagctgctgtgggagctgcagcaggagaaggccctgctgcaggccagagtgcaggagctggaggccagcgtgcaggagggcaagctggacagaagcagcccctacatccaggtgctggaggaggactggagacaggccctgagagaccaccaggagcaggccaacaccatcttcagcctgagaaaggacctgagacagggcgaggccagaagactgagatgcatggaggagaaggagatgttcgagctgcagtgcctggccctgagaaaggacagcaagatgtacaaggacagaatcgaggccatcctgctgcagatggaggaggtggccatcgagagagaccaggccatcgccaccagagaggagctgcacgcccagcacgccagaggcctgcaggagaaggacgccctgagaaagcaggtgagagagctgggcgagaaggccgacgagctgcagctgcaggtgttccagtgcgaggcccagctgctggccgtggagggcagactgagaagacagcagctggagaccctggtgctgagcagcgacctggaggacggcagccccagaagaagccaggagctgagcctgccccaggacctggaggacacccagctgagcgacaagggctgcctggccggcggcggcagccccaagcagcccttcgccgccctgcaccaggagcaggtgctgagaaacccccacgacgccggcctgagcagcggcgagccccccgagaaggagagaagaagactgaaggagagcttcgagaactacagaagaaagagagccctgagaaagatgcagaagggctggagacagggcgaggaggacagagagaacaccaccggcagcgacaacaccgacaccgagggcagctag

SEQ ID NO: 75635 - DNA, 1479 bp, Artificial Sequence
  Description of Artificial Sequence: Synthetic coding sequence
atgagcgactacgagaacgacgacgagtgctggagcgtgctggagggcttcagagtgaccctgaccagcgtgatcgaccccagcagaatcaccccctacctgagacagtgcaaggtgctgaaccccgacgacgaggagcaggtgctgagcgaccccaacctggtgatcagaaagagaaaggtgggcgtgctgctggacatcctgcagagaaccggccacaagggctacgtggccttcctggagagcctggagctgtactacccccagctgtacaagaaggtgaccggcaaggagcccgccagagtgttcagcatgatcatcgacgccagcggcgagagcggcctgacccagctgctgatgaccgaggtgatgaagctgcagaagaaggtgcaggacctgaccgccctgctgagcagcaaggacgacttcatcaaggagctgagagtgaaggacagcctgctgagaaagcaccaggagagagtgcagagactgaaggaggagtgcgaggccggcagcagagagctgaagagatgcaaggaggagaactacgacctggccatgagactggcccaccagagcgaggagaagggcgccgccctgatgagaaacagagacctgcagctggagatcgaccagctgaagcacagcctgatgaaggccgaggacgactgcaaggtggagagaaagcacaccctgaagctgagacacgccatggagcagagacccagccaggagctgctgtgggagctgcagcaggagaaggccctgctgcaggccagagtgcaggagctggaggccagcgtgcaggagggcaagctggacagaagcagcccctacatccaggtgctggaggaggactggagacaggccctgagagaccaccaggagcaggccaacaccatcttcagcctgagaaaggacctgagacagggcgaggccagaagactgagatgcatggaggagaaggagatgttcgagctgcagtgcctggccctgagaaaggacagcaagatgtacaaggacagaatcgaggccatcctgctgcagatggaggaggtggccatcgagagagaccaggccatcgccaccagagaggagctgcacgcccagcacgccagaggcctgcaggagaaggacgccctgagaaagcaggtgagagagctgggcgagaaggccgacgagctgcagctgcaggtgttccagtgcgaggcccagctgctggccgtggagggcagactgagaagacagcagctggagaccctggtgctgagcagcgacctggaggacggcagccccagaagaagccaggagctgagcctgccccaggacctggaggacacccagctgagcgacaagggctgcctggccggcggcggcagccccaagcagcccttcgccgccctgcaccaggagcaggtgctgagaaacccccacgacgccggccccgccggcctgcccggcatcggcgccgtgtgctag

SEQ ID NO: 75636 - DNA, 3501 bp, Artificial Sequence
  Description of Artificial Sequence: Synthetic coding sequence
atggacctgggcaccgccgagggcaccagatgcaccgacccccccgccggcaagcccgccatggcccccaagagaaagggcggcctgaagctgaacgccatctgcgccaagctgagcagacaggtggtggtggagaagagagccgacgccggcagccacaccgagggcagccccagccagcccagagaccaggagagaagcggccccgagagcggcgccgccagagcccccagaagcgaggaggacaagagaagagccgtgatcgagaagtgggtgaacggcgagtacagcgaggagcccgcccccacccccgtgctgggcagaatcgccagagagggcctggagctgccccccgagggcgtgtacatggtgcagccccagggctgcagcgacgaggaggaccacgccgaggagcccagcaaggacggcggcgccctggaggagaaggacagcgacggcgccgccagcaaggaggacagcggccccagcaccagacaggccagcggcgaggccagcagcctgagagactacgccgccagcaccatgaccgagttcctgggcatgttcggctacgacgaccagaacaccagagacgagctggccagaaagatcagcttcgagaagctgcacgccggcagcacccccgaggccgccaccagcagcatgctgcccaccagcgaggacaccctgagcaagagagccagattcagcaagtacgaggagtacatcagaaagctgaaggccggcgagcagctgagctggcccgcccccagcaccaagaccgaggagagagtgggcaaggaggtggtgggcaccctgcccggcctgagactgcccagcagcaccgcccacctggagaccaaggccaccatcctgcccctgcccagccacagcagcgtgcagatgcagaacctggtggccagagccagcaagtacgacttcttcatccagaagctgaagaccggcgagaacctgagaccccagaacggcagcacctacaagaagcccagcaagtacgacctggagaacgtgaagtacctgcacctgttcaagcccggcgagggcagccccgacatgggcggcgccatcgccttcaagaccggcaaggtgggcagacccagcaagtacgacgtgagaggcatccagaagcccggccccgccaaggtgccccccacccccagcctggcccccgcccccctggccagcgtgcccagcgcccccagcgcccccggccccggccccgagccccccgccagcctgagcttcaacacccccgagtacctgaagagcaccttcagcaagaccgacagcatcaccaccggcaccgtgagcaccgtgaagaacggcctgcccaccgacaagcccgccgtgaccgaggacgtgaacatctaccagaagtacatcgccagattcagcggcagccagcactgcggccacatccactgcgcctaccagtacagagagcactaccactgcctggaccccgagtgcaactaccagagattcaccagcaagcaggacgtgatcagacactacaacatgcacaagaagagagacaacagcctgcagcacggcttcatgagattcagccccctggacgactgcagcgtgtactaccacggctgccacctgaacggcaagagcacccactaccactgcatgcaggtgggctgcaacaaggtgtacaccagcaccagcgacgtgatgacccacgagaacttccacaagaagaacacccagctgatcaacgacggcttccagagattcagagccaccgaggactgcggcaccgccgactgccagttctacggccagaagaccacccacttccactgcagaagacccggctgcaccttcaccttcaagaacaagtgcgacatcgagaagcacaagagctaccacatcaaggacgacgcctacgccaaggacggcttcaagaagttctacaagtacgaggagtgcaagtacgagggctgcgtgtacagcaaggccaccaaccacttccactgcatcagagccggctgcggcttcaccttcaccagcaccagccagatgaccagccacaagagaaagcacgagagaagacacatcagaagcagcggcgccctgggcctgccccccagcctgctgggcgccaaggacaccgagcacgaggagagcagcaacgacgacctggtggacttcagcgccctgagcagcaagaacagcagcctgagcgccagccccaccagccagcagagcagcgccagcctggccgccgccaccgccgccaccgaggccggccccagcgccaccaagccccccaacagcaagatcagcggcctgctgccccagggcctgcccggcagcatccccctggccctggccctgagcaacagcggcctgcccacccccaccccctacttccccatcctggccggcagaggcagcaccagcctgcccgtgggcacccccagcctgctgggcgccgtgagcagcggcagcgccgccagcgccacccccgacacccccaccctggtggccagcggcgccggcgacagcgcccccgtggccgccgccagcgtgcccgccccccccgccagcatcatggagagaatcagcgccagcaagggcctgatcagccccatgatggccagactggccgccgccgccctgaagcccagcgccaccttcgaccccggcagcggccagcaggtgacccccgccagattcccccccgcccaggtgaagcccgagcccggcgagagcaccggcgcccccggcccccacgaggccagccaggacagaagcctggacctgaccgtgaaggagcccagcaacgagagcaacggccacgccgtgcccgccaacagcagcctgctgagcagcctgatgaacaagatgagccagggcaaccccggcctgggcagcctgctgaacatcaaggccgaggccgagggcagccccgccgccgagcccagccccttcctgggcaaggccgtgaaggccctggtgcaggagaagctggccgagccctggaaggtgtacctgagaagattcggcaccaaggacttctgcgacggccagtgcgacttcctgcacaaggcccacttccactgcgtggtggaggagtgcggcgccctgttcagcaccctggacggcgccatcaagcacgccaacttccacttcagaaccgagggcggcgccgccaagggcaacaccgaggccgccttccccgccagcgccgccgagaccaagccccccatggcccccagcagcccccccgtgccccccgtgaccaccgccaccgtgagcagcctggagggccccgcccccagccccgccagcgtgcccagcacccccaccctgctggcctggaagcagctggccagcaccatcccccagatgccccagatccccgccagcgtgccccacctgcccgccagccccctggccaccaccagcctggagaacgccaagccccaggtgaagcccggcttcctgcagttccaggagaagtag

SEQ ID NO: 75637 - DNA, 5280 bp, Artificial Sequence
  Description of Artificial Sequence: Synthetic coding sequence
atggacctgggcaccgccgagggcaccagatgcaccgacccccccgccggcaagcccgccatggcccccaagagaaagggcggcctgaagctgaacgccatctgcgccaagctgagcagacaggtggtggtggagaagagagccgacgccggcagccacaccgagggcagccccagccagcccagagaccaggagagaagcggccccgagagcggcgccgccagagcccccagaagcgaggaggacaagagaagagccgtgatcgagaagtgggtgaacggcgagtacagcgaggagcccgcccccacccccgtgctgggcagaatcgccagagagggcctggagctgccccccgagggcgtgtacatggtgcagccccagggctgcagcgacgaggaggaccacgccgaggagcccagcaaggacggcggcgccctggaggagaaggacagcgacggcgccgccagcaaggaggacagcggccccagcaccagacaggccagcggcgaggccagcagcctgagagactacgccgccagcaccatgaccgagttcctgggcatgttcggctacgacgaccagaacaccagagacgagctggccagaaagatcagcttcgagaagctgcacgccggcagcacccccgaggccgccaccagcagcatgctgcccaccagcgaggacaccctgagcaagagagccagattcagcaagtacgaggagtacatcagaaagctgaaggccggcgagcagctgagctggcccgcccccagcaccaagaccgaggagagagtgggcaaggaggtggtgggcaccctgcccggcctgagactgcccagcagcaccgcccacctggagaccaaggccaccatcctgcccctgcccagccacagcagcgtgcagatgcagaacctggtggccagagccagcaagtacgacttcttcatccagaagctgaagaccggcgagaacctgagaccccagaacggcagcacctacaagaagcccagcaagtacgacctggagaacgtgaagtacctgcacctgttcaagcccggcgagggcagccccgacatgggcggcgccatcgccttcaagaccggcaaggtgggcagacccagcaagtacgacgtgagaggcatccagaagcccggccccgccaaggtgccccccacccccagcctggcccccgcccccctggccagcgtgcccagcgcccccagcgcccccggccccggccccgagccccccgccagcctgagcttcaacacccccgagtacctgaagagcaccttcagcaagaccgacagcatcaccaccggcaccgtgagcaccgtgaagaacggcctgcccaccgacaagcccgccgtgaccgaggacgtgaacatctaccagaagtacatcgccagattcagcggcagccagcactgcggccacatccactgcgcctaccagtacagagagcactaccactgcctggaccccgagtgcaactaccagagattcaccagcaagcaggacgtgatcagacactacaacatgcacaagaagagagacaacagcctgcagcacggcttcatgagattcagccccctggacgactgcagcgtgtactaccacggctgccacctgaacggcaagagcacccactaccactgcatgcaggtgggctgcaacaaggtgtacaccagcaccagcgacgtgatgacccacgagaacttccacaagaagaacacccagctgatcaacgacggcttccagagattcagagccaccgaggactgcggcaccgccgactgccagttctacggccagaagaccacccacttccactgcagaagacccggctgcaccttcaccttcaagaacaagtgcgacatcgagaagcacaagagctaccacatcaaggacgacgcctacgccaaggacggcttcaagaagttctacaagtacgaggagtgcaagtacgagggctgcgtgtacagcaaggccaccaaccacttccactgcatcagagccggctgcggcttcaccttcaccagcaccagccagatgaccagccacaagagaaagcacgagagaagacacatcagaagcagcggcgccctgggcctgccccccagcctgctgggcgccaaggacaccgagcacgaggagagcagcaacgacgacctggtggacttcagcgccctgagcagcaagaacagcagcctgagcgccagccccaccagccagcagagcagcgccagcctggccgccgccaccgccgccaccgaggccggccccagcgccaccaagccccccaacagcaagatcagcggcctgctgccccagggcctgcccggcagcatccccctggccctggccctgagcaacagcggcctgcccacccccaccccctacttccccatcctggccggcagaggcagcaccagcctgcccgtgggcacccccagcctgctgggcgccgtgagcagcggcagcgccgccagcgccacccccgacacccccaccctggtggccagcggcgccggcgacagcgcccccgtggccgccgccagcgtgcccgccccccccgccagcatcatggagagaatcagcgccagcaagggcctgatcagccccatgatggccagactggccgccgccgccctgaagcccagcgccaccttcgaccccggcagcggccagcaggtgacccccgccagattcccccccgcccaggtgaagcccgagcccggcgagagcaccggcgcccccggcccccacgaggccagccaggacagaagcctggacctgaccgtgaaggagcccagcaacgagagcaacggccacgccgtgcccgccaacagcagcctgctgagcagcctgatgaacaagatgagccagggcaaccccggcctgggcagcctgctgaacatcaaggccgaggccgagggcagccccgccgccgagcccagccccttcctgggcaaggccgtgaaggccctggtgcaggagaagctggccgagccctggaaggtgtacctgagaagattcggcaccaaggacttctgcgacggccagtgcgacttcctgcacaaggcccacttccactgcgtggtggaggagtgcggcgccctgttcagcaccctggacggcgccatcaagcacgccaacttccacttcagaaccgagggcggcgccgccaagggcaacaccgaggccgccttccccgccagcgccgccgagaccaagccccccatggcccccagcagcccccccgtgccccccgtgaccaccgccaccgtgagcagcctggagggccccgcccccagccccgccagcgtgcccagcacccccaccctgctggcctggaagcagctggccagcaccatcccccagatgccccagatccccgccagcgtgccccacctgcccgccagccccctggccaccaccagcctggagaacgccaagccccaggtgaagcccggcttcctgcagttccaggagaacgacccctgcctggccaccgactgcaagtacgccaacaagttccacttccactgcctgttcggcaactgcaagtacgtgtgcaagaccagcggcaaggccgagagccactgcctggaccacatcaaccccaacaacaacctggtgaacgtgagagaccagttcgcctactacagcctgcagtgcctgtgccccaaccagcactgcgagttcagaatgagaggccactaccactgcctgagaaccggctgctacttcgtgaccaacatcaccaccaagctgccctggcacatcaagaagcacgagaaggccgagagaagagccgccaacggcttcaagtacttcaccaagagagaggagtgcggcagactgggctgcaagtacaaccaggtgaacagccacttccactgcatcagagagggctgccagttcagcttcctgctgaagcaccagatgaccagccacgccagaaagcacatgagaagaatgctgggcaagaacttcgacagagtgccccccagccagggcccccccggcctgatggacgccgagaccgacgagtgcatggactacaccggctgcagccccggcgccatgagcagcgagagcagcaccatggacagaagctgcagcagcacccccgtgggcaacgagagcaccgccgccggcaacaccatcagcatgcccaccgccagcggcgccaagaagagattctggatcatcgaggacatgagccccttcggcaagagaagaaagaccgccagcagcagaaagatgctggacgagggcatgatgctggagggcttcagaagattcgacctgtacgaggactgcaaggacgccgcctgccagttcagcctgaaggtgacccactaccactgcaccagagagaactgcggctacaagttctgcggcagaacccacatgtacaagcacgcccagcaccacgacagagtggacaacctggtgctggacgacttcaagagattcaaggccagcctgagctgccacttcgccgactgccccttcagcggcaccagcacccacttccactgcctgagatgcagattcagatgcaccgacagcaccaaggtgaccgcccacagaaagcaccacggcaagcaggacgtgatcagcgccgccggcttctgccagttcagcagcagcgccgactgcgccgtgcccgactgcaagtacaagctgaagtgcagccacttccactgcaccttccccggctgcagacacaccgtggtgggcatgagccagatggacagccacaagagaaagcacgagaagcaggagagaggcgagcccgccgccgagggccccgcccccggcccccccatcagcctggacggcagcctgagcctgggcgccgagcccggcagcctgctgttcctgcagagcgccgccgccggcctgggcctggccctgggcgacgccggcgaccccggcccccccgacgccgccgcccccggccccagagagggcgccgccgccgccgccgccgccgccggcgagagcagccaggaggacgaggaggaggagctggagctgcccgaggaggaggccgaggacgacgaggacgaggacgacgacgaggacgacgacgacgaggacgacgacgaggacgacgacgacgaggacctgagaaccgacagcgaggagagcctgcccgaggccgccgccgaggccgccggcgccggcgccagaacccccgccctggccgccctggccgccctgggcgcccccggccccgcccccaccgccgccagcagcccctag

SEQ ID NO: 75638 - DNA, 4332 bp, Artificial Sequence
  Description of Artificial Sequence: Synthetic coding sequence
caggagctggaggccgccctgcacagagacgacgtggagttcatcagcgacctgatcgcctgcctgctgcagggctgctaccagagaagagacatcaccccccagaccttccacagctacctggaggacatcatcaactacagatgggagctggaggagggcaagcccaaccccctgagagaggccagcttccaggacctgcccctgagaaccagagtggagatcctgcacagactgtgcgactacagactggacgccgacgacgtgttcgacctgctgaagggcctggacgccgacagcctgagagtggagcccctgggcgaggacaacagcggcgccctgtactggtacttctacggcaccagaatgtacaaggaggaccccgtgcagggcaagagcaacggcgagctgagcctgagcagagagagcgagggccagaagaacgtgagcagcatccccggcaagaccggcaagagaagaggcagaccccccaagagaaagaagctgcaggaggagatcctgctgagcgagaagcaggaggagaacagcctggccagcgagccccagaccagacacggcagccagggccccggccagggcacctggtggctgctgtgccagaccgaggaggagtggagacaggtgaccgagagcttcagagagagaaccagcctgagagagagacagctgtacaagctgctgagcgaggacttcctgcccgagatctgcaacatgatcgcccagaagggcaagagaccccagagaaccaaggccgagctgcaccccagatggatgagcgaccacctgagcatcaagcccgtgaagcaggaggagacccccgtgctgaccagaatcgagaagcagaagagaaaggaggaggaggaggagagacagatcctgctggccgtgcagaagaaggagcaggagcagatgctgaaggaggagagaaagagagagctggaggagaaggtgaaggccgtggagggcatgtgcagcgtgagagtggtgtggagaggcgcctgcctgagcaccagcagacccgtggacagagccaagagaagaaagctgagagaggagagagcctggctgctggcccagggcaaggagctgccccccgagctgagccacctggaccccaacagccccatgagagaggagaagaagaccaaggacctgttcgagctggacgacgacttcaccgccatgtacaaggtgctggacgtggtgaaggcccacaaggacagctggcccttcctggagcccgtggacgagagctacgcccccaactactaccagatcatcaaggcccccatggacatcagcagcatggagaagaagctgaacggcggcctgtactgcaccaaggaggagttcgtgaacgacatgaagaccatgttcagaaactgcagaaagtacaacggcgagagcagcgagtacaccaagatgagcgacaacctggagagatgcttccacagagccatgatgaagcacttccccggcgaggacggcgacaccgacgaggagttctggatcagagaggacgagaagagagagaagagaagaagcagagccggcagaagcggcggcagccacgtgtggaccagaagcagagaccccgagggcagcagcagaaagcagcagcccatggagaacggcggcaagagcctgccccccaccagaagagcccccagcagcggcgacgaccagagcagcagcagcacccagccccccagagaggtgggcaccagcaacggcagaggcttcagccaccccctgcactgcggcggcacccccagccaggcccccttcctgaaccagatgagacccgccgtgcccggcaccttcggccccctgagaggcagcgaccccgccaccctgtacggcagcagcggcgtgcccgagccccaccccggcgagcccgtgcagcagagacagcccttcaccatgcagccccccgtgggcatcaacagcctgagaggccccagactgggcacccccgaggagaagcagatgtgcggcggcctgacccacctgagcaacatgggcccccaccccggcagcctgcagctgggccagatcagcggccccagccaggacggcagcatgtacgcccccgcccagttccagcccggcttcatcccccccagacacggcggcgcccccgccagaccccccgacttccccgagagcagcgagatcccccccagccacatgtacagaagctacaagtacctgaacagagtgcacagcgccgtgtggaacggcaaccacggcgccaccaaccagggccccctgggccccgacgagaagccccacctgggccccggccccagccaccagcccagaaccctgggccacgtgatggacagcagagtgatgagaccccccgtgccccccaaccagtggaccgagcagagcggcttcctgccccacggcgtgcccagcagcggctacatgagacccccctgcaagagcgccggccacagactgcagcccccccccgtgcccgcccccagcagcctgttcggcgcccccgcccaggccctgagaggcgtgcagggcggcgacagcatgatggacagccccgagatgatcgccatgcagcagctgagcagcagagtgtgcccccccggcgtgccctaccacccccaccagcccgcccaccccagactgcccggccccttcccccaggtggcccaccccatgagcgtgaccgtgagcgcccccaagcccgccctgggcaaccccggcagagcccccgagaacagcgaggcccaggagcccgagaacgaccaggccgagcccctgcccggcctggaggagaagccccccggcgtgggcaccagcgagggcgtgtacctgacccagctgccccaccccaccccccccctgcagaccgactgcaccagacagagcagcccccaggagagagagaccgtgggccccgagctgaagagcagcagcagcgagagcgccgacaactgcaaggccatgaagggcaagaacccctggcccagcgacagcagctaccccggccccgccgcccagggctgcgtgagagacctgagcaccgtggccgacagaggcgccctgagcgagaacggcgtgatcggcgaggccagcccctgcggcagcgagggcaagggcctgggcagcagcggcagcgagaagctgctgtgccccagaggcagaaccctgcaggagaccatgccctgcaccggccagaacgccgccaccccccccagcaccgaccccggcctgaccggcggcaccgtgagccagttcccccccctgtacatgcccggcctggagtaccccaacagcgccgcccactaccacatcagccccggcctgcagggcgtgggccccgtgatgggcggcaagagccccgccagccacccccagcacttcccccccagaggcttccagagcaaccacccccacagcggcggcttccccagatacagacccccccagggcatgagatacagctaccacccccccccccagcccagctaccaccactaccagagaaccccctactacgcctgcccccagagcttcagcgactggcagagacccctgcacccccagggcagccccagcggcccccccgccagccagccccccccccccagaagcctgttcagcgacaagaacgccatggccagcctgcagggctgcgagaccctgaacgccgccctgaccagccccaccagaatggacgccgtggccgccaaggtgcccaacgacggccagaaccccggccccgaggaggagaagctggacgagagcatggagagacccgagagccccaaggagttcctggacctggacaaccacaacgccgccaccaagagacagagcagcctgagcgccagcgagtacctgtacggcacccccccccccctgagcagcggcatgggcttcggcagcagcgccttccccccccacagcgtgatgctgcagaccggccccccctacaccccccagagacccgccagccacttccagcccagagcctacagcagccccgtggccgccctgcccccccaccaccccggcgccacccagcccaacggcctgagccaggagggccccatctacagatgccaggaggagggcctgggccacttccaggccgtgatgatggagcagatcggcaccagaagcggcatcagaggccccttccaggagatgtacagacccagcggcatgcagatgcaccccgtgcagagccaggccagcttccccaagacccccaccgccgccaccagccaggaggaggtgcccccccacaagccccccaccctgcccctggaccagagctag

SEQ ID NO: 75639 - DNA, 1371 bp, Artificial Sequence
  Description of Artificial Sequence: Synthetic coding sequence
gagctggaggccgccctgcacagagacgacgtggagttcatcagcgacctgatcgcctgcctgctgcagggctgctaccagagaagagacatcaccccccagaccttccacagctacctggaggacatcatcaactacagatgggagctggaggagggcaagcccaaccccctgagagaggccagcttccaggacctgcccctgagaaccagagtggagatcctgcacagactgtgcgactacagactggacgccgacgacgtgttcgacctgctgaagggcctggacgccgacagcctgagagtggagcccctgggcgaggacaacagcggcgccctgtactggtacttctacggcaccagaatgtacaaggaggaccccgtgcagggcaagagcaacggcgagctgagcctgagcagagagagcgagggccagaagaacgtgagcagcatccccggcaagaccggcaagagaagaggcagaccccccaagagaaagaagctgcaggaggagatcctgctgagcgagaagcaggaggagaacagcctggccagcgagccccagaccagacacggcagccagggccccggccagggcacctggtggctgctgtgccagaccgaggaggagtggagacaggtgaccgagagcttcagagagagaaccagcctgagagagagacagctgtacaagctgctgagcgaggacttcctgcccgagatctgcaacatgatcgcccagaaggagacccccgtgctgaccagaatcgagaagcagaagagaaaggaggaggaggaggagagacagatcctgctggccgtgcagaagaaggagcaggagcagatgctgaaggaggagagaaagagagagctggaggagaaggtgaaggccgtggagggcatgtgcagcgtgagagtggtgtggagaggcgcctgcctgagcaccagcagacccgtggacagagccaagagaagaaagctgagagaggagagagcctggctgctggcccagggcaaggagctgccccccgagctgagccacctggaccccaacagccccatgagagaggagaagaagaccaaggacctgttcgagctggacgacgacttcaccgccatgtacaaggtgctggacgtggtgaaggcccacaaggacagctggcccttcctggagcccgtggacgagagctacgcccccaactactaccagatcatcaaggcccccatggacatcagcagcatggagaagaagctgaacggcggcctgtactgcaccaaggaggagttcgtgaacgacatgaagaccatgttcagaaactgcagaaagtacaacggcgagagcagcggcaagcagggcagaagcctgtgctag

SEQ ID NO: 75640 - DNA, 1584 bp, Artificial Sequence
  Description of Artificial Sequence: Synthetic coding sequence
atggccgacagcagagaccccgccagcgaccagatgcagcactggaaggagcagagagccgcccagaaggccgacgtgctgaccaccggcgccggcaaccccgtgggcgacaagctgaacgtgatcaccgtgggccccagaggccccctgctggtgcaggacgtggtgttcaccgacgagatggcccacttcgacagagagagaatccccgagagagtggtgcacgccaagggcgccggcgccttcggctacttcgaggtgacccacgacatcaccaagtacagcaaggccaaggtgttcgagcacatcggcaagaagacccccatcgccgtgagattcagcaccgtggccggcgagagcggcagcgccgacaccgtgagagaccccagaggcttcgccgtgaagttctacaccgaggacggcaactgggacctggtgggcaacaacacccccatcttcttcatcagagaccccatcctgttccccagcttcatccacagccagaagagaaacccccagacccacctgaaggaccccgacatggtgtgggacttctggagcctgagacccgagagcctgcaccaggtgagcttcctgttcagcgacagaggcatccccgacggccacagacacatgaacggctacggcagccacaccttcaagctggtgaacgccaacggcgaggccgtgtactgcaagttccactacaagaccgaccagggcatcaagaacctgagcgtggaggacgccgccagactgagccaggaggaccccgactacggcatcagagacctgttcaacgccatcgccaccggcaagtaccccagctggaccttctacatccaggtgatgaccttcaaccaggccgagaccttccccttcaaccccttcgacctgaccaaggtgtggccccacaaggactaccccctgatccccgtgggcaagctggtgctgaacagaaaccccgtgaactacttcgccgaggtggagcagatcgccttcgaccccagcaacatgccccccggcatcgaggccagccccgacaagatgctgcagggcagactgttcgcctaccccgacacccacagacacagactgggccccaactacctgcacatccccgtgaactgcccctacagagccagagtggccaactaccagagagacggccccatgtgcatgcaggacaaccagggcggcgcccccaactactaccccaacagcttcggcgcccccgagcagcagcccagcgccctggagcacagcatccagtacagcggcgaggtgagaagattcaacaccgccaacgacgacaacgtgacccaggtgagagccttctacgtgaacgtgctgaacgaggagcagagaaagagactgtgcgagaacatcgccggccacctgaaggacgcccagatcttcatccagaagaaggccgtgaagaacttcaccgaggtgcaccccgactacggcagccacatccaggccctgctggacaagtacaacgccgagaagcccaagaacgccatccacaccttcgtgcagagcggcagccacctggccgccagagagaaggccaacctgtag

SEQ ID NO: 75641 - DNA, 816 bp, Artificial Sequence
  Description of Artificial Sequence: Synthetic coding sequence
atgcccgaggccccccccctgctgctggccgccgtgctgctgggcctggtgctgctggtggtgctgctgctgctgctgagacactggggctggggcctgtgcctgatcggctggaacgagttcatcctgcagcccatccacaacctgctgatgggcgacaccaaggagcagagaatcctgaaccacgtgctgcagcacgccgagcccggcaacgcccagagcgtgctggaggccatcgacacctactgcgagcagaaggagtgggccatgaacgtgggcgacaagaagggcaagatcgtggacgccgtgatccaggagcaccagcccagcgtgctgctggagctgggcgcctactgcggctacagcgccgtgagaatggccagactgctgagccccggcgccagactgatcaccatcgagatcaaccccgactgcgccgccatcacccagagaatggtggacttcgccggcgtgaaggacaaggtgaccctggtggtgggcgccagccaggacatcatcccccagctgaagaagaagtacgacgtggacaccctggacatggtgttcctggaccactggaaggacagatacctgcccgacaccctgctgctggaggagtgcggcctgctgagaaagggcaccgtgctgctggccgacaacgtgatctgccccggcgcccccgacttcctggcccacgtgagaggcagcagctgcttcgagtgcacccactaccagagcttcctggagtacagagaggtggtggacggcctggagaaggccatctacaagggccccggcagcgaggccggcccctag

SEQ ID NO: 75642 - DNA, 816 bp, Artificial Sequence; identical to SEQ ID NO: 75641
  Description of Artificial Sequence: Synthetic coding sequence

SEQ ID NO: 75643 - DNA, 816 bp, Artificial Sequence; identical to SEQ ID NO: 75641
  Description of Artificial Sequence: Synthetic coding sequence

SEQ ID NO: 75644 - DNA, 666 bp, Artificial Sequence
  Description of Artificial Sequence: Synthetic coding sequence
atgggcgacaccaaggagcagagaatcctgaaccacgtgctgcagcacgccgagcccggcaacgcccagagcgtgctggaggccatcgacacctactgcgagcagaaggagtgggccatgaacgtgggcgacaagaagggcaagatcgtggacgccgtgatccaggagcaccagcccagcgtgctgctggagctgggcgcctactgcggctacagcgccgtgagaatggccagactgctgagccccggcgccagactgatcaccatcgagatcaaccccgactgcgccgccatcacccagagaatggtggacttcgccggcgtgaaggacaaggtgaccctggtggtgggcgccagccaggacatcatcccccagctgaagaagaagtacgacgtggacaccctggacatggtgttcctggaccactggaaggacagatacctgcccgacaccctgctgctggaggagtgcggcctgctgagaaagggcaccgtgctgctggccgacaacgtgatctgccccggcgcccccgacttcctggcccacgtgagaggcagcagctgcttcgagtgcacccactaccagagcttcctggagtacagagaggtggtggacggcctggagaaggccatctacaagggccccggcagcgaggccggcccctag

SEQ ID NO: 75645 - DNA, 672 bp, Artificial Sequence
  Description of Artificial Sequence: Synthetic coding sequence
atgcccgaggccccccccctgctgctggccgccgtgctgctgggcctggtgctgctggtggtgctgctgctgctgctgagacactggggctggggcctgtgcctgatcggctggaacgagttcatcctgcagcccatccacaacctgctgatgggcgacaccaaggagcagagaatcctgaaccacgtgctgcagcacgccgagcccggcaacgcccagagcgtgctggaggccatcgacacctactgcgagcagaaggagtgggccatgaacgtgggcgacaagaagggcaagatcgtggacgccgtgatccaggagcaccagcccagcgtgctgctggagctgggcgcctactgcggctacagcgccgtgagaatggccagactgctgagccccggcgccagactgatcaccatcgagatcaaccccgactgcgccgccatcacccagagaatggtggacttcgccggcgtgaaggacaaggtgaccctggtggtgggcgccagccaggacatcatcccccagctgaagaagaagtacgacgtggacaccctggacatggtgttcctggaccactggaaggacagatacctgcccgacaccctgctgctggaggagtgcggcctgctgagaaagggcaccgtgctgctggccgacaacgtgatctgctag

SEQ ID NO: 75646 - DNA, 666 bp, Artificial Sequence; identical to SEQ ID NO: 75644
  Description of Artificial Sequence: Synthetic coding sequence

SEQ ID NO: 75647 - DNA, 2664 bp, Artificial Sequence
  Description of Artificial Sequence: Synthetic coding sequence
atggccaacggcaccctgaccagaagacaccagaacggcagattcgtgggcgacgccgacctggagagacagaagttcagcgacctgaagctgaacggcccccaggaccacagccacctgctgtacagcaccatccccagaatgcaggagcccggccagatcgtggagacctacaccgaggaggaccccgagggcgccatgagcgtggtgagcgtggagaccagcgacgacggcaccaccagaagaaccgagaccaccgtgaagaaggtggtgaagaccgtgaccaccagaaccgtgcagcccgtggccatgggccccgacggcctgcccgtggacgccagcagcgtgagcaacaactacatccagaccctgggcagagacttcagaaagaacggcaacggcggccccggcccctacgtgggccaggccggcaccgccaccctgcccagaaacttccactacccccccgacggctacagcagacactacgaggacggctaccccggcggcagcgacaactacggcagcctgagcagagtgaccagaatcgaggagagatacagacccagcatggagggctacagagcccccagcagacaggacgtgtacggcccccagccccaggtgagagtgggcggcagcagcgtggacctgcacagattccaccccgagccctacggcctggaggacgaccagagaagcatgggctacgacgacctggactacggcatgatgagcgactacggcaccgccagaagaaccggcacccccagcgaccccagaagaagactgagaagctacgaggacatgatcggcgaggaggtgcccagcgaccagtactactgggcccccctggcccagcacgagagaggcagcctggccagcctggacagcctgagaaagggcggcccccccccccccaactggagacagcccgagctgcccgaggtgatcgccatgctgggcttcagactggacgccgtgaagagcaacgccgccgcctacctgcagcacctgtgctacagaaacgacaaggtgaagaccgacgtgagaaagctgaagggcatccccgtgctggtgggcctgctggaccaccccaagaaggaggtgcacctgggcgcctgcggcgccctgaagaacatcagcttcggcagagaccaggacaacaagatcgccatcaagaactgcgacggcgtgcccgccctggtgagactgctgagaaaggccagagacatggacctgaccgaggtgatcaccggcaccctgtggaacctgagcagccacgacagcatcaagatggagatcgtggaccacgccctgcacgccctgaccgacgaggtgatcatcccccacagcggctgggagagagagcccaacgaggactgcaagcccagacacatcgagtgggagagcgtgctgaccaacaccgccggctgcctgagaaacgtgagcagcgagagaagcgaggccagaagaaagctgagagagtgcgacggcctggtggacgccctgatcttcatcgtgcaggccgagatcggccagaaggacagcgacagcaagctggtggagaactgcgtgtgcctgctgagaaacctgagctaccaggtgcacagagagatcccccaggccgagagataccaggaggccgcccccaacgtggccaacaacaccggcccccacgccgccagctgcttcggcgccaagaagggcaagggcaagaagcccatcgaggaccccgccaacgacaccgtggacttccccaagagaaccagccccgccagaggctacgagctgctgttccagcccgaggtggtgagaatctacatcagcctgctgaaggagagcaagacccccgccatcctggaggccagcgccggcgccatccagaacctgtgcgccggcagatggacctacggcagatacatcagaagcgccctgagacaggagaaggccctgagcgccatcgccgacctgctgaccaacgagcacgagagagtggtgaaggccgccagcggcgccctgagaaacctggccgtggacgccagaaacaaggagctgatcggcaagcacgccatccccaacctggtgaagaacctgcccggcggccagcagaacagcagctggaacttcagcgaggacaccgtgatcagcatcctgaacaccatcaacgaggtgatcgccgagaacctggaggccgccaagaagctgagagagacccagggcatcgagaagctggtgctgatcaacaagagcggcaacagaagcgagaaggaggtgagagccgccgccctggtgctgcagaccatctggggctacaaggagctgagaaagcccctggagaaggagggctggaagaagagcgacttccaggtgaacctgaacaacgccagcagaagccagagcagccacagctacgacgacagcaccctgcccctgatcgacagaaaccagaagagcgacaacaactacagcacccccaacgagagaggcgaccacaacagaaccctggacagaagcggcgacctgggcgacatggagcccctgaagggcaccacccccctgatgcaggacgagggccaggagagcctggaggaggagctggacgtgctggtgctggacgacgagggcggccaggtgagctaccccagcatgcagaagatctag

SEQ ID NO: 75648 - DNA, 1755 bp, Artificial Sequence
  Description of Artificial Sequence: Synthetic coding sequence
atggacggctggagaagacccctgcagagcgtgggcaaggtgtgcgagaagaacatgaagaccagcgagatgcacaccatgagcggcgcccagaccggcagaaaggagaagggcgaccccctgaacatcgccatcgacaagatgaccaagaagaccagagacctgagaagacagctgagaaaggccgtgatggaccacatcagcgacagcttcctggagaccaacgtgcccctgctggtgctgatcgaggccgccaagagcggcaacgagaaggaggtgaaggagtacgcccaggtgttcagagagcacgccaacaagctggtggaggtggccaacctggcctgcagcatcagcaacaacgaggagggcgtgaagctggtgagaatggccgccacccagatcgacagcctgtgcccccaggtgatcaacgccgccctgaccctggccgccagaccccagagcaaggtggcccaggacaacatggacgtgttcaaggaccagtgggagaagcaggtgagagtgctgaccgaggccgtggacgacatcaccagcgtggacgacttcctgagcgtgagcgagaaccacatcctggaggacgtgaacaagtgcgtgatcgccctgcaggagggcgacgtggacaccctggacagaaccgccggcgccatcagaggcagagccgccagagtgatccacatcatcaacgccgagatggagaactacgaggccggcgtgtacaccgagaaggtgctggaggccaccaagctgctgagcgagaccgtgatgcccagattcgccgagcaggtggaggtggccatcgaggccctgagcgccaacgtgccccagcccttcgaggagaacgagttcatcgacgccagcagactggtgtacgacggcgtgagagacatcagaaaggccgtgctgatgatcagaacccccgaggagctggaggacgacagcgacttcgagcaggaggactacgacgtgagaagcagaaccagcgtgcagaccgaggacgaccagctgatcgccggccagagcgccagagccatcatggcccagctgccccaggaggagaaggccaagatcgccgagcaggtggagatcttccaccaggagaagagcaagctggacgccgaggtggccaagtgggacgacagcggcaacgacatcatcgtgctggccaagcagatgtgcatgatcatgatggagatgaccgacttcaccagaggcaagggccccctgaagaacaccagcgacgtgatcaacgccgccaagaagatcgccgaggccggcagcagaatggacaagctggccagagccgtggccgaccagtgccccgacagcgcctgcaagcaggacctgctggcctacctgcagagaatcgccctgtactgccaccagctgaacatctgcagcaaggtgaaggccgaggtgcagaacctgggcggcgagctgatcgtgagcggcctggacagcgccaccagcctgatccaggccgccaagaacctgatgaacgccgtggtgctgaccgtgaaggccagctacgtggccagcaccaagtaccagaaggtgtacggcaccgccgccgtgaacagccccgtggtgagctggaagatgaaggcccccgagaagaagcccctggtgaagagagagaagcccgaggagttccagaccagagtgagaagaggcagccagaagaagcacatcagccccgtgcaggccctgagcgagttcaaggccatggacagcttctag

SEQ ID NO: 75649 - DNA, 2820 bp, Artificial Sequence
  Description of Artificial Sequence: Synthetic coding sequence
atgagcggcctgatctgcctgcagtacggcctgtggcacggccagaagatcgacttcggcggccccagaagactgctgcagagaaacagaggcgagggcagcatgaccagcgccaccagccccatcatcctgaagtgggaccccaagagcctggagatcagaaccctgaccgtggagagactgctggagcccctggtgacccaggtgaccaccctggtgaacaccagcaacaagggccccagcggcaagaagaagggcagaagcaagaaggcccacgtgctggccgccagcgtggagcaggccacccagaacttcctggagaagggcgagcagatcgccaaggagagccaggacctgaaggaggagctggtggccgccgtggaggacgtgagaaagcagggcgagaccatgagaatcgccagcagcgagttcgccgacgacccctgcagcagcgtgaagagaggcaccatggtgagagccgccagagccctgctgagcgccgtgaccagactgctgatcctggccgacatggccgacgtgatgagactgctgagccacctgaagatcgtggaggaggccctggaggccgtgaagaacgccaccaacgagcaggacctggccaacagattcaaggagttcggcaaggagatggtgaagctgaactacgtggccgccagaagacagcaggagctgaaggacccccactgcagagacgagatggccgccgccagaggcgccctgaagaagaacgccaccatgctgtacaccgccagccaggccttcctgagacaccccgacgtggccgccaccagagccaacagagactacgtgttcaagcaggtgcaggaggccatcgccggcatcagcaacgccgcccaggccaccagccccaccgacgaggccaagggccacaccggcatcggcgagctggccgccgccctgaacgagttcgacaacaagatcatcctggaccccatgaccttcagcgaggccagattcagacccagcctggaggagagactggagagcatcatcagcggcgccgccctgatggccgacagcagctgcaccagagacgacagaagagagagaatcgtggccgagtgcaacgccgtgagacaggccctgcaggacctgctgagcgagtacatgaacaacaccggcagaaaggagaagggcgaccccctgaacatcgccatcgacaagatgaccaagaagaccagagacctgagaagacagctgagaaaggccgtgatggaccacatcagcgacagcttcctggagaccaacgtgcccctgctggtgctgatcgaggccgccaagagcggcaacgagaaggaggtgaaggagtacgcccaggtgttcagagagcacgccaacaagctggtggaggtggccaacctggcctgcagcatcagcaacaacgaggagggcgtgaagctggtgagaatggccgccacccagatcgacagcctgtgcccccaggtgatcaacgccgccctgaccctggccgccagaccccagagcaaggtggcccaggacaacatggacgtgttcaaggaccagtgggagaagcaggtgagagtgctgaccgaggccgtggacgacatcaccagcgtggacgacttcctgagcgtgagcgagaaccacatcctggaggacgtgaacaagtgcgtgatcgccctgcaggagggcgacgtggacaccctggacagaaccgccggcgccatcagaggcagagccgccagagtgatccacatcatcaacgccgagatggagaactacgaggccggcgtgtacaccgagaaggtgctggaggccaccaagctgctgagcgagaccgtgatgcccagattcgccgagcaggtggaggtggccatcgaggccctgagcgccaacgtgccccagcccttcgaggagaacgagttcatcgacgccagcagactggtgtacgacggcgtgagagacatcagaaaggccgtgctgatgatcagaacccccgaggagctggaggacgacagcgacttcgagcaggaggactacgacgtgagaagcagaaccagcgtgcagaccgaggacgaccagctgatcgccggccagagcgccagagccatcatggcccagctgccccaggaggagaaggccaagatcgccgagcaggtggagatcttccaccaggagaagagcaagctggacgccgaggtggccaagtgggacgacagcggcaacgacatcatcgtgctggccaagcagatgtgcatgatcatgatggagatgaccgacttcaccagaggcaagggccccctgaagaacaccagcgacgtgatcaacgccgccaagaagatcgccgaggccggcagcagaatggacaagctggccagagccgtggccgaccagtgccccgacagcgcctgcaagcaggacctgctggcctacctgcagagaatcgccctgtactgccaccagctgaacatctgcagcaaggtgaaggccgaggtgcagaacctgggcggcgagctgatcgtgagcggcctggacagcgccaccagcctgatccaggccgccaagaacctgatgaacgccgtggtgctgaccgtgaaggccagctacgtggccagcaccaagtaccagaaggtgtacggcaccgccgccgtgaacagccccgtggtgagctggaagatgaaggcccccgagaagaagcccctggtgaagagagagaagcccgaggagttccagaccagagtgagaagaggcagccagaagaagcacatcagccccgtgcaggccctgagcgagttcaaggccatggacagcttctag

SEQ ID NO: 75650 - DNA, 2862 bp, Artificial Sequence
  Description of Artificial Sequence: Synthetic coding sequence
atgaccagcgccaccagccccatcatcctgaagtgggaccccaagagcctggagatcagaaccctgaccgtggagagactgctggagcccctggtgacccaggtgaccaccctggtgaacaccagcaacaagggccccagcggcaagaagaagggcagaagcaagaaggcccacgtgctggccgccagcgtggagcaggccacccagaacttcctggagaagggcgagcagatcgccaaggagagccaggacctgaaggaggagctggtggccgccgtggaggacgtgagaaagcagggcgagaccatgagaatcgccagcagcgagttcgccgacgacccctgcagcagcgtgaagagaggcaccatggtgagagccgccagagccctgctgagcgccgtgaccagactgctgatcctggccgacatggccgacgtgatgagactgctgagccacctgaagatcgtggaggaggccctggaggccgtgaagaacgccaccaacgagcaggacctggccaacagattcaaggagttcggcaaggagatggtgaagctgaactacgtggccgccagaagacagcaggagctgaaggacccccactgcagagacgagatggccgccgccagaggcgccctgaagaagaacgccaccatgctgtacaccgccagccaggccttcctgagacaccccgacgtggccgccaccagagccaacagagactacgtgttcaagcaggtgcaggaggccatcgccggcatcagcaacgccgcccaggccaccagccccaccgacgaggccaagggccacaccggcatcggcgagctggccgccgccctgaacgagttcgacaacaagatcatcctggaccccatgaccttcagcgaggccagattcagacccagcctggaggagagactggagagcatcatcagcggcgccgccctgatggccgacagcagctgcaccagagacgacagaagagagagaatcgtggccgagtgcaacgccgtgagacaggccctgcaggacctgctgagcgagtacatgaacaacaccggcagaaaggagaagggcgaccccctgaacatcgccatcgacaagatgaccaagaagaccagagacctgagaagacagctgagaaaggccgtgatggaccacatcagcgacagcttcctggagaccaacgtgcccctgctggtgctgatcgaggccgccaagagcggcaacgagaaggaggtgaaggagtacgcccaggtgttcagagagcacgccaacaagctggtggaggtggccaacctggcctgcagcatcagcaacaacgaggagggcgtgaagctggtgagaatggccgccacccagatcgacagcctgtgcccccaggtgatcaacgccgccctgaccctggccgccagaccccagagcaaggtggcccaggacaacatggacgtgttcaaggaccagtgggagaagcaggtgagagtgctgaccgaggccgtggacgacatcaccagcgtggacgacttcctgagcgtgagcgagaaccacatcctggaggacgtgaacaagtgcgtgatcgccctgcaggagggcgacgtggacaccctggacagaaccgccggcgccatcagaggcagagccgccagagtgatccacatcatcaacgccgagatggagaactacgaggccggcgtgtacaccgagaaggtgctggaggccaccaagctgctgagcgagaccgtgatgcccagattcgccgagcaggtggaggtggccatcgaggccctgagcgccaacgtgccccagcccttcgaggagaacgagttcatcgacgccagcagactggtgtacgacggcgtgagagacatcagaaaggccgtgctgatgatcagaacccccgaggagctggaggacgacagcgacttcgagcaggaggactacgacgtgagaagcagaaccagcgtgcagaccgaggacgaccagctgatcgccggccagagcgccagagccatcatggcccagctgccccaggaggagaaggccaagatcgccgagcaggtggagatcttccaccaggagaagagcaagctggacgccgaggtggccaagtgggacgacagcggcaacgacatcatcgtgctggccaagcagatgtgcatgatcatgatggagatgaccgacttcaccagaggcaagggccccctgaagaacaccagcgacgtgatcaacgccgccaagaagatcgccgaggccggcagcagaatggacaagctggccagagccgtggccgaccagtgccccgacagcgcctgcaagcaggacctgctggcctacctgcagagaatcgccctgtactgccaccagctgaacatctgcagcaaggtgaaggccgaggtgcagaacctgggcggcgagctgatcgtgagcggcaccggcgtgcagagcaccttcaccaccttctacgaggtggactgcgacgtgatcgacggcggcagagccagccagctgagcacccacctgcccacctgcgccgagggcgcccccatcggcagcggcagcagcgacagcagcatgctggacagcgccaccagcctgatccaggccgccaagaacctgatgaacgccgtggtgctgaccgtgaaggccagctacgtggccagcaccaagtaccagaaggtgtacggcaccgccgccgtgaacagccccgtggtgagctggaagatgaaggcccccgagaagaagcccctggtgaagagagagaagcccgaggagttccagaccagagtgagaagaggcagccagaagaagcacatcagccccgtgcaggccctgagcgagttcaaggccatggacagcttctag

SEQ ID NO: 75651 - DNA, 354 bp, Artificial Sequence
  Description of Artificial Sequence: Synthetic coding sequence
atgaccagcgccaccagccccatcatcctgaagtgggaccccaagagcctggagatcagaaccctgaccgtggagagactgctggagcccctggtgacccaggtgaccaccctggtgaacaccagcaacaagggccccagcggcaagaagaagggcagaagcaagaaggcccacgtgctggccgccagcgtggagcaggccacccagaacttcctggagaagggcgagcagatcgccaaggagagccaggacctgaaggaggagctggtggccgccgtggaggacgtgagaaagcagggcgagaccatgagaatcgccagcagcgagttcgccgacgacccctgcagcagctag

SEQ ID NO: 75652 - DNA, 201 bp, Artificial Sequence
  Description of Artificial Sequence: Synthetic coding sequence
atgaccagcgccaccagccccatcatcctgaagtgggaccccaagagcctggagatcagaaccctgaccgtggagagactgctggagcccctggtgacccaggtgaccaccctggtgaacaccagcaacaagggccccagcggcaagaagaagggcagaagcaagaaggcccacgtgctggccgccagcgtggagcagtag

SEQ ID NO: 75653 - DNA, 2718 bp, Artificial Sequence
  Description of Artificial Sequence: Synthetic coding sequence
atgaccagcgccaccagccccatcatcctgaagtgggaccccaagagcctggagatcagaaccctgaccgtggagagactgctggagcccctggtgacccaggtgaccaccctggtgaacaccagcaacaagggccccagcggcaagaagaagggcagaagcaagaaggcccacgtgctggccgccagcgtggagcaggccacccagaacttcctggagaagggcgagcagatcgccaaggagagccaggacctgaaggaggagctggtggccgccgtggaggacgtgagaaagcagggcgagaccatgagaatcgccagcagcgagttcgccgacgacccctgcagcagcgtgaagagaggcaccatggtgagagccgccagagccctgctgagcgccgtgaccagactgctgatcctggccgacatggccgacgtgatgagactgctgagccacctgaagatcgtggaggaggccctggaggccgtgaagaacgccaccaacgagcaggacctggccaacagattcaaggagttcggcaaggagatggtgaagctgaactacgtggccgccagaagacagcaggagctgaaggacccccactgcagagacgagatggccgccgccagaggcgccctgaagaagaacgccaccatgctgtacaccgccagccaggccttcctgagacaccccgacgtggccgccaccagagccaacagagactacgtgttcaagcaggtgcaggaggccatcgccggcatcagcaacgccgcccaggccaccagccccaccgacgaggccaagggccacaccggcatcggcgagctggccgccgccctgaacgagttcgacaacaagatcatcctggaccccatgaccttcagcgaggccagattcagacccagcctggaggagagactggagagcatcatcagcggcgccgccctgatggccgacagcagctgcaccagagacgacagaagagagagaatcgtggccgagtgcaacgccgtgagacaggccctgcaggacctgctgagcgagtacatgaacaacaccggcagaaaggagaagggcgaccccctgaacatcgccatcgacaagatgaccaagaagaccagagacctgagaagacagctgagaaaggccgtgatggaccacatcagcgacagcttcctggagaccaacgtgcccctgctggtgctgatcgaggccgccaagagcggcaacgagaaggaggtgaaggagtacgcccaggtgttcagagagcacgccaacaagctggtggaggtggccaacctggcctgcagcatcagcaacaacgaggagggcgtgaagctggtgagaatggccgccacccagatcgacagcctgtgcccccaggtgatcaacgccgccctgaccctggccgccagaccccagagcaaggtggcccaggacaacatggacgtgttcaaggaccagtgggagaagcaggtgagagtgctgaccgaggccgtggacgacatcaccagcgtggacgacttcctgagcgtgagcgagaaccacatcctggaggacgtgaacaagtgcgtgatcgccctgcaggagggcgacgtggacaccctggacagaaccgccggcgccatcagaggcagagccgccagagtgatccacatcatcaacgccgagatggagaactacgaggccggcgtgtacaccgagaaggtgctggaggccaccaagctgctgagcgagaccgtgatgcccagattcgccgagcaggtggaggtggccatcgaggccctgagcgccaacgtgccccagcccttcgaggagaacgagttcatcgacgccagcagactggtgtacgacggcgtgagagacatcagaaaggccgtgctgatgatcagaacccccgaggagctggaggacgacagcgacttcgagcaggaggactacgacgtgagaagcagaaccagcgtgcagaccgaggacgaccagctgatcgccggccagagcgccagagccatcatggcccagctgccccaggaggagaaggccaagatcgccgagcaggtggagatcttccaccaggagaagagcaagctggacgccgaggtggccaagtgggacgacagcggcaacgacatcatcgtgctggccaagcagatgtgcatgatcatgatggagatgaccgacttcaccagaggcaagggccccctgaagaacaccagcgacgtgatcaacgccgccaagaagatcgccgaggccggcagcagaatggacaagctggccagagccgtggccgaccagtgccccgacagcgcctgcaagcaggacctgctggcctacctgcagagaatcgccctgtactgccaccagctgaacatctgcagcaaggtgaaggccgaggtgcagaacctgggcggcgagctgatcgtgagcggcctggacagcgccaccagcctgatccaggccgccaagaacctgatgaacgccgtggtgctgaccgtgaaggccagctacgtggccagcaccaagtaccagaaggtgtacggcaccgccgccgtgaacagccccgtggtgagctggaagatgaaggcccccgagaagaagcccctggtgaagagagagaagcccgaggagttccagaccagagtgagaagaggcagccagaagaagcacatcagccccgtgcaggccctgagcgagttcaaggccatggacagcttctag

SEQ ID NO: 75654 - DNA, 2718 bp, Artificial Sequence; identical to SEQ ID NO: 75653
  Description of Artificial Sequence: Synthetic coding sequence

SEQ ID NO: 75655 - DNA, 2583 bp, Artificial Sequence
  Description of Artificial Sequence: Synthetic coding sequence
atgaccagcgccaccagccccatcatcctgaagtgggaccccaagagcctggagatcagaaccctgaccgtggagagactgctggagcccctggtgacccaggtgaccaccctggtgaacaccagcaacaagggccccagcggcaagaagaagggcagaagcaagaaggcccacgtgctggccgccagcgtggagcaggccacccagaacttcctggagaagggcgagcagatcgccaaggagagccaggacctgaaggaggagctggtggccgccgtggaggacgtgagaaagcagggcgagaccatgagaatcgccagcagcgagttcgccgacgacccctgcagcagcgtgaagagaggcaccatggtgagagccgccagagccctgctgagcgccgtgaccagactgctgatcctggccgacatggccgacgtgatgagactgctgagccacctgaagatcgtggaggaggccctggaggccgtgaagaacgccaccaacgagcaggacctggccaacagattcaaggagttcggcaaggagatggtgaagctgaactacgtggccgccagaagacagcaggagctgaaggacccccactgcagagacgagatggccgccgccagaggcgccctgaagaagaacgccaccatgctgtacaccgccagccaggccttcctgagacaccccgacgtggccgccaccagagccaacagagactacgtgttcaagcaggtgcaggaggccatcgccggcatcagcaacgccgcccaggccaccagccccaccgacgaggccaagggccacaccggcatcggcgagctggccgccgccctgaacgagttcgacaacaagatcatcctggaccccatgaccttcagcgaggccagattcagacccagcctggaggagagactggagagcatcatcagcggcgccgccctgatggccgacagcagctgcaccagagacgacagaagagagagaatcgtggccgagtgcaacgccgtgagacaggccctgcaggacctgctgagcgagtacatgaacaacaccggcagaaaggagaagggcgaccccctgaacatcgccatcgacaagatgaccaagaagaccagagacctgagaagacagctgagaaaggccgtgatggaccacatcagcgacagcttcctggagaccaacgtgcccctgctggtgctgatcgaggccgccaagagcggcaacgagaaggaggtgaaggagtacgcccaggtgttcagagagcacgccaacaagctggtggaggtggccaacctggcctgcagcatcagcaacaacgaggagggcgtgaagctggtgagaatggccgccacccagatcgacagcctgtgcccccaggtgatcaacgccgccctgaccctggccgccagaccccagagcaaggtggcccaggacaacatggacgtgttcaaggaccagtgggagaagcaggtgagagtgctgaccgaggccgtggacgacatcaccagcgtggacgacttcctgagcgtgagcgagaaccacatcctggaggacgtgaacaagtgcgtgatcgccctgcaggagggcgacgtggacaccctggacagaaccgccggcgccatcagaggcagagccgccagagtgatccacatcatcaacgccgagatggagaactacgaggccggcgtgtacaccgagaaggtgctggaggccaccaagctgctgagcgagaccgtgatgcccagattcgccgagcaggtggaggtggccatcgaggccctgagcgccaacgtgccccagcccttcgaggagaacgagttcatcgacgccagcagactggtgtacgacggcgtgagagacatcagaaaggccgtgctgatgatcagaacccccgaggagctggaggacgacagcgacttcgagcaggaggactacgacgtgagaagcagaaccagcgtgcagaccgaggacgaccagctgatcgccggccagagcgccagagccatcatggcccagctgccccaggaggagaaggccaagatcgccgagcaggtggagatcttccaccaggagaagagcaagctggacgccgaggtggccaagtgggacgacagcggcaacgacatcatcgtgctggccaagcagatgtgcatgatcatgatggagatgaccgacttcaccagaggcaagggccccctgaagaacaccagcgacgtgatcaacgccgccaagaagatcgccgaggccggcagcagaatggacaagctggccagagccgtggccgaccagctggacagcgccaccagcctgatccaggccgccaagaacctgatgaacgccgtggtgctgaccgtgaaggccagctacgtggccagcaccaagtaccagaaggtgtacggcaccgccgccgtgaacagccccgtggtgagctggaagatgaaggcccccgagaagaagcccctggtgaagagagagaagcccgaggagttccagaccagagtgagaagaggcagccagaagaagcacatcagccccgtgcaggccctgagcgagttcaaggccatggacagcttctag

SEQ ID NO: 75656 - DNA, 2718 bp, Artificial Sequence; identical to SEQ ID NO: 75653
  Description of Artificial Sequence: Synthetic coding sequence

SEQ ID NO: 75657 - DNA, 582 bp, Artificial Sequence
  Description of Artificial Sequence: Synthetic coding sequence
atgagcgccgagacccccatcaccctgaacatcgacccccaggacctgcaggtgcagaccttcaccgtggagaagctgctggagcccctgatcatccaggtgaccaccctggtgaactgcccccagaaccccagcagcagaaagaagggcagaagcaagagagccagcgtgctgctggccagcgtggaggaggccacctggaacctgctggacaagggcgagaagatcgcccaggaggccaccgtgctgaaggacgagctgaccgccagcctggaggaggtgagaaaggagagcgaggccctgaaggtgagcgccgagagattcaccgacgacccctgcttcctgcccaagagagaggccgtggtgcaggccgccagagccctgctggccgccgtgaccagactgctgatcctggccgacatgatcgacgtgatgtgcctgctgcagcacgtgagcgccttccagagaaccttcgagagcctgaagaacgtggccaacaagagcgacctgcagaagacctaccagaagctgggcaaggagctggagaacctggactacctggccttcaagagacagcagtag

SEQ ID NO: 75658 - DNA, 705 bp, Artificial Sequence
  Description of Artificial Sequence: Synthetic coding sequence
atgacccagctgcccgaggccgagaaggagaagatcgccgagcaggtggccgacttcaagaaggtgaagagcaagctggacgccgagatcgagatctgggacgacaccagcaacgacatcatcgtgctggccaagaacatgtgcatgatcatgatggagatgaccgacttcaccagaggcaagggccccctgaagcacaccaccgacgtgatctacgccgccaagatgatcagcgagagcggcagcagaatggacgtgctggccagacagatcgccaaccagtgccccgaccccagctgcaagcaggacctgctggcctacctggagcagatcaagttctacagccaccagctgaagatctgcagccaggtgaaggccgagatccagaacctgggcggcgagctgatcatgagcgccctggacagcgtgaccagcctgatccaggccgccaagaacctgatgaacgccgtggtgcagaccgtgaagatgagctacatcgccagcaccaagatcatcagaatccagagccccgccggccccagacaccccgtggtgatgtggagaatgaaggcccccgccaagaagcccctgatcaagagagagaagcccgaggagacctgcgccgccgtgagaagaggcagcgccaagaagaagatccaccccctgcaggtgatgagcgagttcagaggcagacagatctactag

SEQ ID NO: 75659 - DNA, 2688 bp, Artificial Sequence
  Description of Artificial Sequence: Synthetic coding sequence
atgagcgccgagacccccatcaccctgaacatcgacccccaggacctgcaggtgcagaccttcaccgtggagaagctgctggagcccctgatcatccaggtgaccaccctggtgaactgcccccagaaccccagcagcagaaagaagggcagaagcaagagagccagcgtgctgctggccagcgtggaggaggccacctggaacctgctggacaagggcgagaagatcgcccaggaggccaccgtgctgaaggacgagctgaccgccagcctggaggaggtgagaaaggagagcgaggccctgaaggtgagcgccgagagattcaccgacgacccctgcttcctgcccaagagagaggccgtggtgcaggccgccagagccctgctggccgccgtgaccagactgctgatcctggccgacatgatcgacgtgatgtgcctgctgcagcacgtgagcgccttccagagaaccttcgagagcctgaagaacgtggccaacaagagcgacctgcagaagacctaccagaagctgggcaaggagctggagaacctggactacctggccttcaagagacagcaggacctgaagagccccaaccagagagacgagatcgccggcgccagagccagcctgaaggagaacagccccctgctgcacagcatctgcagcgcctgcctggagcacagcgacgtggccagcctgaaggccagcaaggacaccgtgtgcgaggagatccagaacgccctgaacgtgatcagcaacgccagccagggcatccagaacatgaccaccccccccgagccccaggccgccaccctgggcagcgccctggacgagctggagaacctgatcgtgctgaaccccctgaccgtgaccgaggaggagatcagacccagcctggagaagagactggaggccatcatcagcggcgccgccctgctggccgacagcagctgcaccagagacctgcacagagagagaatcatcgccgagtgcaacgccatcagacaggccctgcaggacctgctgagcgagtacatgaacaacgccggcaagaaggagagaagcaacaccctgaacatcgccctggacaacatgtgcaagaagaccagagacctgagaagacagctgagaaaggccatcatcgaccacgtgagcgacagcttcctggacaccaccgtgcccctgctggtgctgatcgaggccgccaagaacggcagagagaaggagatcaaggagtacgccgccatcttccacgagcacaccagcagactggtggaggtggccaacctggcctgcagcatgagcaccaacgaggacggcatcaagatcgtgaagatcgccgccaaccacctggagaccctgtgcccccagatcatcaacgccgccctggccctggccgccagacccaagagccaggccgtgaagaacaccatggagatgtacaagagaacctgggagaaccacatccacgtgctgaccgaggccgtggacgacatcaccagcatcgacgacttcctggccgtgagcgagagccacatcctggaggacgtgaacaagtgcatcatcgccctgagagaccaggacgccgacaacctggacagagccgccggcgccatcagaggcagagccgccagagtggcccacatcgtgaccggcgagatggacagctacgagcccggcgcctacaccgagggcgtgatgagaaacgtgaacttcctgaccagcaccgtgatccccgagttcgtgacccaggtgaacgtggccctggaggccctgagcaagagcagcctgaacgtgctggacgacaaccagttcgtggacatcagcaagaagatctacgacaccatccacgacatcagatgcagcgtgatgatgatcagaacccccgaggagctggaggacgtgagcgacctggaggaggagcacgaggtgagaagccacaccagcatccagaccgagggcaagaccgacagagccaagatgacccagctgcccgaggccgagaaggagaagatcgccgagcaggtggccgacttcaagaaggtgaagagcaagctggacgccgagatcgagatctgggacgacaccagcaacgacatcatcgtgctggccaagaacatgtgcatgatcatgatggagatgaccgacttcaccagaggcaagggccccctgaagcacaccaccgacgtgatctacgccgccaagatgatcagcgagagcggcagcagaatggacgtgctggccagacagatcgccaaccagtgccccgaccccagctgcaagcaggacctgctggcctacctggagcagatcaagttctacagccaccagctgaagatctgcagccaggtgaaggccgagatccagaacctgggcggcgagctgatcatgagcgccctggacagcgtgaccagcctgatccaggccgccaagaacctgatgaacgccgtggtgcagaccgtgaagatgagctacatcgccagcaccaagatcatcagaatccagagccccgccggccccagacaccccgtggtgatgtggagaatgaaggcccccgccaagaagcccctgatcaagagagagaagcccgaggagacctgcgccgccgtgagaagaggcagcgccaagaagaagatccaccccctgcaggtgatgagcgagttcagaggcagacagatctactag

SEQ ID NO: 75660 - DNA, 2688 bp, Artificial Sequence; identical to SEQ ID NO: 75659
  Description of Artificial Sequence: Synthetic coding sequence

SEQ ID NO: 75661 - DNA, 1131 bp, Artificial Sequence
  Description of Artificial Sequence: Synthetic coding sequence
atgagcgccgagacccccatcaccctgaacatcgacccccaggacctgcaggtgcagaccttcaccgtggagaagctgctggagcccctgatcatccaggtgaccaccctggtgaactgcccccagaaccccagcagcagaaagaagggcagaagcaagagagccagcgtgctgctggccagcgtggaggaggccacctggaacctgctggacaagggcgagaagatcgcccaggaggccaccgtgctgaaggacgagctgaccgccagcctggaggaggtgagaaaggagagcgaggccctgaaggtgagcgccgagagattcaccgacgacccctgcttcctgcccaagagagaggccgtggtgcaggccgccagagccctgctggccgccgtgaccagactgctgatcctggccgacatgatcgacgtgatgtgcctgctgcagcacgtgagcgccttccagagaaccttcgagagcctgaagaacgtggccaacaagagcgacctgcagaagacctaccagaagctgggcaaggagctggagaacctggactacctggccttcaagagacagcaggacctgaagagccccaaccagagagacgagatcgccggcgccagagccagcctgaaggagaacagccccctgctgcacagcatctgcagcgcctgcctggagcacagcgacgtggccagcctgaaggccagcaaggacaccgtgtgcgaggagatccagaacgccctgaacgtgatcagcaacgccagccagggcatccagaacatgaccaccccccccgagccccaggccgccaccctgggcagcgccctggacgagctggagaacctgatcgtgctgaaccccctgaccgtgaccgaggaggagatcagacccagcctggagaagagactggaggccatcatcagcggcgccgccctgctggccgacagcagctgcaccagagacctgcacagagagagaatcatcgccgagtgcaacgccatcagacaggccctgcaggacctgctgagcgagtacatgaacaacctgtgcaaccagaagagcgacctgggcctgaccggcgtgaagatcaagctgctggaggagtgcatcatcttctggagcctgtag

SEQ ID NO: 75662 - DNA, 582 bp, Artificial Sequence; identical to SEQ ID NO: 75657
  Description of Artificial Sequence: Synthetic coding sequence

SEQ ID NO: 75663 - DNA, 1131 bp, Artificial Sequence; identical to SEQ ID NO: 75661
  Description of Artificial Sequence: Synthetic coding sequence

SEQ ID NO: 75664 - DNA, 2205 bp, Artificial Sequence
  Description of Artificial Sequence: Synthetic coding sequence
atggccgccagccccggccccgccggcgtgggcggcgccggcgccgtgtacggcagcggcagcagcggcttcgccctggacagcggcctggagatcaagaccagaagcgtggagcagaccctgctgcccctggtgagccagatcaccaccctgatcaaccacaaggacaacaccaagaagagcgacaagaccctgcaggccatccagagagtgggccaggccgtgaacctggccgtgggcagattcgtgaaggtgggcgaggccatcgccaacgagaactgggacctgaaggaggagatcaacatcgcctgcatcgaggccaagcaggccggcgagaccatcgccgccctgaccgacatcaccaacctgaaccacctggagagcgacggccagatcaccatcttcaccgacaagaccggcgtgatcaaggccgccagactgctgctgagcagcgtgaccaaggtgctgctgctggccgacagagtggtgatcaagcagatcatcaccagcagaaacaaggtgctggccaccatggagagactggagaaggtgaacagcttccaggagttcgtgcagatcttcagccagttcggcaacgagatggtggagttcgcccacctgagcggcgacagacagaacgacctgaaggacgagaagaagaaggccaagatggccgccgccagagccgtgctggagaagtgcaccatgatgctgctgaccgccagcaagacctgcctgagacaccccaactgcgagagcgcccacaagaacaaggagggcgtgttcgacagaatgaaggtggccctggacaaggtgatcgagatcgtgaccgactgcaagcccaacggcgagaccgacatcagcagcatcagcatcttcaccggcatcaaggagttcaagatgaacatcgaggccctgagagagaacctgtacttccagagcaaggagaacctgagcgtgaccctggaggtgatcctggagagaatggaggacttcaccgacagcgcctacaccagccacgagcacagagagagaatcctggagctgagcacccaggccagaatggagctgcagcagctgatcagcgtgtggatccaggcccagagcaagaagaccaagagcatcgccgaggagctggagctgagcatcctgaagatcagccacagcctgaacgagctgaagaaggagctgcacagcaccgccacccagctggccgccgacctgctgaagtaccacgccgaccacgtggtgctgaaggccctgaagctgaccggcgtggagggcaacctggaggccctggccgagtacgcctgcaagctgagcgagcagaaggagcagctggtggagacctgcagactgctgagacacatcagcggcaccgagcccctggagatcacctgcatccacgccgaggagaccttccaggtgaccggccagcagatcatcagcgccgccgagaccctgaccctgcaccccagcagcaagatcgccaaggagaacctggacgtgttctgcgaggcctgggagagccagatcagcgacatgagcaccctgctgagagagatcaacgacgtgttcgagggcagaagaggcgagaagtacggctacctgagcctgcccaagcccatgaagaacaacgccaacctgaagagcctgaagcccgacaagcccgacagcgaggagcaggccaagatcgccaagctgggcctgaagctgggcctgctgaccagcgacgccgactgcgagatcgagaagtgggaggaccaggagaacgagatcgtgcagtacggcagaaacatgagcagcatggcctacagcctgtacctgttcaccagaggcgagggccccctgaagaccagccaggacctgatccaccagctggaggtgttcgccgccgagggcctgaagctgaccagcagcgtgcaggccttcagcaagcagctgaaggacgacgacaagctgatgctgctgctggagatcaacaagctgatccccctgtgccaccagctgcagaccgtgaccaagaccagcctgcagaacaaggtgttcctgaaggtggacaagtgcatcaccaagaccagaagcatgatggccctgctggtgcagctgctgagcctgtgctacaagctgctgaagaagctgcagatggagaacaacggctgggtgagcgtgaccaacaaggacaccatggacagcaagacctag

SEQ ID NO: 75665 - DNA, 1953 bp, Artificial Sequence
  Description of Artificial Sequence: Synthetic coding sequence
atggccgccagccccggccccgccggcgtgggcggcgccggcgccgtgtacggcagcggcagcagcggcttcgccctggacagcggcctggagatcaagaccagaagcgtggagcagaccctgctgcccctggtgagccagatcaccaccctgatcaaccacaaggacaacaccaagaagagcgacaagaccctgcaggccatccagagagtgggccaggccgtgaacctggccgtgggcagattcgtgaaggtgggcgaggccatcgccaacgagaactgggacctgaaggaggagatcaacatcgcctgcatcgaggccaagcaggccggcgagaccatcgccgccctgaccgacatcaccaacctgaaccacctggagagcgacggccagatcaccatcttcaccgacaagaccggcgtgatcaaggccgccagactgctgctgagcagcgtgaccaaggtgctgctgctggccgacagagtggtgatcaagcagatcatcaccagcagaaacaaggtgctggccaccatggagagactggagaaggtgaacagcttccaggagttcgtgcagatcttcagccagttcggcaacgagatggtggagttcgcccacctgagcggcgacagacagaacgacctgaaggacgagaagaagaaggccaagatggccgccgccagagccgtgctggagaagtgcaccatgatgctgctgaccgccagcaagacctgcctgagacaccccaactgcgagagcgcccacaagaacaaggagggcgtgttcgacagaatgaaggtggccctggacaaggtgatcgagatcgtgaccgactgcaagcccaacggcgagaccgacatcagcagcatcagcatcttcaccggcatcaaggagttcaagatgaacatcgaggccctgagagagaacctgtacttccagagcaaggagaacctgagcgtgaccctggaggtgatcctggagagaatggaggacttcaccgacagcgcctacaccagccacgagcacagagagagaatcctggagctgagcacccaggccagaatggagctgcagcagctgatcagcgtgtggatccaggcccagagcaagaagaccaagagcatcgccgaggagctggagctgagcatcctgaagatcagccacagcctgaacgagctgaagaaggagatcatcagcgccgccgagaccctgaccctgcaccccagcagcaagatcgccaaggagaacctggacgtgttctgcgaggcctgggagagccagatcagcgacatgagcaccctgctgagagagatcaacgacgtgttcgagggcagaagaggcgagaagtacggctacctgagcctgcccaagcccatgaagaacaacgccaacctgaagagcctgaagcccgacaagcccgacagcgaggagcaggccaagatcgccaagctgggcctgaagctgggcctgctgaccagcgacgccgactgcgagatcgagaagtgggaggaccaggagaacgagatcgtgcagtacggcagaaacatgagcagcatggcctacagcctgtacctgttcaccagaggcgagggccccctgaagaccagccaggacctgatccaccagctggaggtgttcgccgccgagggcctgaagctgaccagcagcgtgcaggccttcagcaagcagctgaaggacgacgacaagctgatgctgctgctggagatcaacaagctgatccccctgtgccaccagctgcagaccgtgaccaagaccagcctgcagaacaaggtgttcctgaaggtggacaagtgcatcaccaagaccagaagcatgatggccctgctggtgcagctgctgagcctgtgctacaagctgctgaagaagctgcagatggagaacaacggctgggtgagcgtgaccaacaaggacaccatggacagcaagacctag

SEQ ID NO: 75666 - DNA, 552 bp, Artificial Sequence
  Description of Artificial Sequence: Synthetic coding sequence
atggccgccagccccggccccgccggcgtgggcggcgccggcgccgtgtacggcagcggcagcagcggcttcgccctggacagcggcctggagatcaagaccagaagcgtggagcagaccctgctgcccctggtgagccagatcaccaccctgatcaaccacaaggacaacaccaagaagagcgacaagaccctgcaggccatccagagagtgggccaggccgtgaacctggccgtgggcagattcgtgaaggtgggcgaggccatcgccaacgagaactgggacctgaaggaggagatcaacatcgcctgcatcgaggccaagcaggccggcgagaccatcgccgccctgaccgacatcaccaacctgaaccacctggagagcgacggccagatcaccatcttcaccgacaagaccggcgtgatcaaggccgccagactgctgctgagcagcgtgaccaaggtgctgctgctggccgacagagtggtgatcaagcagatcatcaccagcagaaacaagagactgaccatctacaacctgagacacagctag

SEQ ID NO: 75667 - DNA, 408 bp, Artificial Sequence
  Description of Artificial Sequence: Synthetic coding sequence
atgagcagcatggcctacagcctgtacctgttcaccagaggcgagggccccctgaagaccagccaggacctgatccaccagctggaggtgttcgccgccgagggcctgaagctgaccagcagcgtgcaggccttcagcaagcagctgaaggacgacgacaagctgatgctgctgctggagatcaacaagctgatccccctgtgccaccagctgcagaccgtgaccaagaccagcctgcagaacaaggtgttcctgaaggtggacaagtgcatcaccaagaccagaagcatgatggccctgctggtgcagctgctgagcctgtgctacaagctgctgaagaagctgcagatggagaacaacggctgggtgagcgtgaccaacaaggacaccatggacagcaagacctag

SEQ ID NO: 75668 - DNA, 2157 bp, Artificial Sequence
  Description of Artificial Sequence: Synthetic coding sequence
atggccgccagccccggccccgccggcgtgggcggcgccggcgccgtgtacggcagcggcagcagcggcttcgccctggacagcggcctggagatcaagaccagaagcgtggagcagaccctgctgcccctggtgagccagatcaccaccctgatcaaccacaaggacaacaccaagaagagcgacaagaccctgcaggccatccagagagtgggccaggccgtgaacctggccgtgggcagattcgtgaaggtgggcgaggccatcgccaacgagaactgggacctgaaggaggagatcaacatcgcctgcatcgaggccaagcaggccggcgagaccatcgccgccctgaccgacatcaccaacctgaaccacctggagagcgacggccagatcaccatcttcaccgacaagaccggcgtgatcaaggccgccagactgctgctgagcagcgtgaccaaggtgctgctgctggccgacagagtggtgatcaagcagatcatcaccagcagaaacaaggtgctggccaccatggagagactggagaaggtgaacagcttccaggagttcgtgcagatcttcagccagttcggcaacgagatggtggagttcgcccacctgagcggcgacagacagaacgacctgaaggacgagaagaagaaggccaagatggccgccgccagagccgtgctggagaagtgcaccatgatgctgctgaccgccagcaagacctgcctgagacaccccaactgcgagagcgcccacaagaacaaggagggcgtgttcgacagaatgaaggtggccctggacaaggtgatcgagatcgtgaccgactgcaagcccaacggcgagaccgacatcagcagcatcagcatcttcaccggcatcaaggagttcaagatgaacatcgaggccctgagagagaacctgtacttccagagcaaggagaacctgagcgtgaccctggaggtgatcctggagagaatggaggacttcaccgacagcgcctacaccagccacgagcacagagagagaatcctggagctgagcacccaggccagaatggagctgcagcagctgatcagcgtgtggatccaggcccagagcaagaagaccaagagcatcgccgaggagctggagctgagcatcctgaagatcagccacagcctgaacgagctgaagaaggagctgcacagcaccgccacccagctggccgccgacctgctgaagtaccacgccgaccacgtggtgctgaaggccctgaagctgaccggcgtggagggcaacctggaggccctggccgagtacgcctgcaagctgagcgagcagaaggagcagctggtggagacctgcagactgctgagacacatcagcggcaccgagcccctggagatcacctgcatccacgccgaggagaccttccaggtgaccggccagcagatcatcagcgccgccgagaccctgaccctgcaccccagcagcaagatcgccaaggagaacctggacgtgttctgcgaggcctgggagagccagatcagcgacatgagcaccctgctgagagagatcaacgacgtgttcgagggcagaagaggcgagaagtacggctacctgagcctgcccaagcccatgaagaacaacgccaacctgaagagcctgaagcccgacaagcccgacagcgaggagcaggccaagatcgccaagctgggcctgaagctgggcctgctgaccagcgacgccgactgcgagatcgagaagtgggaggaccaggagaacgagatcgtgcagtacggcagaaacatgagcagcatggcctacagcctgtacctgttcaccagaggcgagggccccctgaagaccagccaggacctgatccaccagctggaggtgttcgccgccgagggcctgaagctgaccagcagcgtgcaggccttcagcaagcagctgaaggacgacgacaagctgatgctgctgctggagatcaacaagctgatccccctgtgccaccagctgcagaccgtgaccaagaccagcctgcagaacaaggtgttcctgaaggtggacaagtgcatcaccaagaccagaagcatgatggccctgctggtgcagctgctgagcctgtgctacaagctgctgaagaagagcgagaccagatactag

SEQ ID NO: 75669 - DNA, 2802 bp, Artificial Sequence
  Description of Artificial Sequence: Synthetic coding sequence
atggacgacagcgaggtggagagcaccgccagcatcctggccagcgtgaaggagcaggaggcccagttcgagaagctgaccagagccctggaggaggagagaagacacgtgagcgcccagctggagagagtgagagtgagcccccaggacgccaaccccctgatggccaacggcaccctgaccagaagacaccagaacggcagattcgtgggcgacgccgacctggagagacagaagttcagcgacctgaagctgaacggcccccaggaccacagccacctgctgtacagcaccatccccagaatgcaggagcccggccagatcgtggagacctacaccgaggaggaccccgagggcgccatgagcgtggtgagcgtggagaccagcgacgacggcaccaccagaagaaccgagaccaccgtgaagaaggtggtgaagaccgtgaccaccagaaccgtgcagcccgtggccatgggccccgacggcctgcccgtggacgccagcagcgtgagcaacaactacatccagaccctgggcagagacttcagaaagaacggcaacggcggccccggcccctacgtgggccaggccggcaccgccaccctgcccagaaacttccactacccccccgacggctacagcagacactacgaggacggctaccccggcggcagcgacaactacggcagcctgagcagagtgaccagaatcgaggagagatacagacccagcatggagggctacagagcccccagcagacaggacgtgtacggcccccagccccaggtgagagtgggcggcagcagcgtggacctgcacagattccaccccgagccctacggcctggaggacgaccagagaagcatgggctacgacgacctggactacggcatgatgagcgactacggcaccgccagaagaaccggcacccccagcgaccccagaagaagactgagaagctacgaggacatgatcggcgaggaggtgcccagcgaccagtactactgggcccccctggcccagcacgagagaggcagcctggccagcctggacagcctgagaaagggcggcccccccccccccaactggagacagcccgagctgcccgaggtgatcgccatgctgggcttcagactggacgccgtgaagagcaacgccgccgcctacctgcagcacctgtgctacagaaacgacaaggtgaagaccgacgtgagaaagctgaagggcatccccgtgctggtgggcctgctggaccaccccaagaaggaggtgcacctgggcgcctgcggcgccctgaagaacatcagcttcggcagagaccaggacaacaagatcgccatcaagaactgcgacggcgtgcccgccctggtgagactgctgagaaaggccagagacatggacctgaccgaggtgatcaccggcaccctgtggaacctgagcagccacgacagcatcaagatggagatcgtggaccacgccctgcacgccctgaccgacgaggtgatcatcccccacagcggctgggagagagagcccaacgaggactgcaagcccagacacatcgagtgggagagcgtgctgaccaacaccgccggctgcctgagaaacgtgagcagcgagagaagcgaggccagaagaaagctgagagagtgcgacggcctggtggacgccctgatcttcatcgtgcaggccgagatcggccagaaggacagcgacagcaagctggtggagaactgcgtgtgcctgctgagaaacctgagctaccaggtgcacagagagatcccccaggccgagagataccaggaggccgcccccaacgtggccaacaacaccggcccccacgccgccagctgcttcggcgccaagaagggcaagggcaagaagcccatcgaggaccccgccaacgacaccgtggacttccccaagagaaccagccccgccagaggctacgagctgctgttccagcccgaggtggtgagaatctacatcagcctgctgaaggagagcaagacccccgccatcctggaggccagcgccggcgccatccagaacctgtgcgccggcagatggacctacggcagatacatcagaagcgccctgagacaggagaaggccctgagcgccatcgccgacctgctgaccaacgagcacgagagagtggtgaaggccgccagcggcgccctgagaaacctggccgtggacgccagaaacaaggagctgatcggcaagcacgccatccccaacctggtgaagaacctgcccggcggccagcagaacagcagctggaacttcagcgaggacaccgtgatcagcatcctgaacaccatcaacgaggtgatcgccgagaacctggaggccgccaagaagctgagagagacccagggcatcgagaagctggtgctgatcaacaagagcggcaacagaagcgagaaggaggtgagagccgccgccctggtgctgcagaccatctggggctacaaggagctgagaaagcccctggagaaggagggctggaagaagagcgacttccaggtgaacctgaacaacgccagcagaagccagagcagccacagctacgacgacagcaccctgcccctgatcgacagaaaccagaagagcgacaagaagcccgacagagaggagatccagatgagcaacatgggcagcaacaccaagagcctggacaacaactacagcacccccaacgagagaggcgaccacaacagaaccctggacagaagcggcgacctgggcgacatggagcccctgaagggcaccacccccctgatgcagaagatctag

SEQ ID NO: 75670 - DNA, 2844 bp, Artificial Sequence
  Description of Artificial Sequence: Synthetic coding sequence
atggacgacagcgaggtggagagcaccgccagcatcctggccagcgtgaaggagcaggaggcccagttcgagaagctgaccagagccctggaggaggagagaagacacgtgagcgcccagctggagagagtgagagtgagcccccaggacgccaaccccctgatggccaacggcaccctgaccagaagacaccagaacggcagattcgtgggcgacgccgacctggagagacagaagttcagcgacctgaagctgaacggcccccaggaccacagccacctgctgtacagcaccatccccagaatgcaggagcccggccagatcgtggagacctacaccgaggaggaccccgagggcgccatgagcgtggtgagcgtggagaccagcgacgacggcaccaccagaagaaccgagaccaccgtgaagaaggtggtgaagaccgtgaccaccagaaccgtgcagcccgtggccatgggccccgacggcctgcccgtggacgccagcagcgtgagcaacaactacatccagaccctgggcagagacttcagaaagaacggcaacggcggccccggcccctacgtgggccaggccggcaccgccaccctgcccagaaacttccactacccccccgacggctacagcagacactacgaggacggctaccccggcggcagcgacaactacggcagcctgagcagagtgaccagaatcgaggagagatacagacccagcatggagggctacagagcccccagcagacaggacgtgtacggcccccagccccaggtgagagtgggcggcagcagcgtggacctgcacagattccaccccgagccctacggcctggaggacgaccagagaagcatgggctacgacgacctggactacggcatgatgagcgactacggcaccgccagaagaaccggcacccccagcgaccccagaagaagactgagaagctacgaggacatgatcggcgaggaggtgcccagcgaccagtactactgggcccccctggcccagcacgagagaggcagcctggccagcctggacagcctgagaaagggcggcccccccccccccaactggagacagcccgagctgcccgaggtgatcgccatgctgggcttcagactggacgccgtgaagagcaacgccgccgcctacctgcagcacctgtgctacagaaacgacaaggtgaagaccgacgtgagaaagctgaagggcatccccgtgctggtgggcctgctggaccaccccaagaaggaggtgcacctgggcgcctgcggcgccctgaagaacatcagcttcggcagagaccaggacaacaagatcgccatcaagaactgcgacggcgtgcccgccctggtgagactgctgagaaaggccagagacatggacctgaccgaggtgatcaccggcaccctgtggaacctgagcagccacgacagcatcaagatggagatcgtggaccacgccctgcacgccctgaccgacgaggtgatcatcccccacagcggctgggagagagagcccaacgaggactgcaagcccagacacatcgagtgggagagcgtgctgaccaacaccgccggctgcctgagaaacgtgagcagcgagagaagcgaggccagaagaaagctgagagagtgcgacggcctggtggacgccctgatcttcatcgtgcaggccgagatcggccagaaggacagcgacagcaagctggtggagaactgcgtgtgcctgctgagaaacctgagctaccaggtgcacagagagatcccccaggccgagagataccaggaggccgcccccaacgtggccaacaacaccggcccccacgccgccagctgcttcggcgccaagaagggcaaggacgagtggttcagcagaggcaagaagcccatcgaggaccccgccaacgacaccgtggacttccccaagagaaccagccccgccagaggctacgagctgctgttccagcccgaggtggtgagaatctacatcagcctgctgaaggagagcaagacccccgccatcctggaggccagcgccggcgccatccagaacctgtgcgccggcagatggacctacggcagatacatcagaagcgccctgagacaggagaaggccctgagcgccatcgccgacctgctgaccaacgagcacgagagagtggtgaaggccgccagcggcgccctgagaaacctggccgtggacgccagaaacaaggagctgatcggcaagcacgccatccccaacctggtgaagaacctgcccggcggccagcagaacagcagctggaacttcagcgaggacaccgtgatcagcatcctgaacaccatcaacgaggtgatcgccgagaacctggaggccgccaagaagctgagagagacccagggcatcgagaagctggtgctgatcaacaagagcggcaacagaagcgagaaggaggtgagagccgccgccctggtgctgcagaccatctggggctacaaggagctgagaaagcccctggagaaggagggctggaagaagagcgacttccaggtgaacctgaacaacgccagcagaagccagagcagccacagctacgacgacagcaccctgcccctgatcgacagaaaccagaagagcgacaacaactacagcacccccaacgagagaggcgaccacaacagaaccctggacagaagcggcgacctgggcgacatggagcccctgaagggcaccacccccctgatgcaggacgagggccaggagagcctggaggaggagctggacgtgctggtgctggacgacgagggcggccaggtgagctaccccagcatgcagaagatctag

SEQ ID NO: 75671 - DNA, 2889 bp, Artificial Sequence
  Description of Artificial Sequence: Synthetic coding sequence
atggacgacagcgaggtggagagcaccgccagcatcctggccagcgtgaaggagcaggaggcccagttcgagaagctgaccagagccctggaggaggagagaagacacgtgagcgcccagctggagagagtgagagtgagcccccaggacgccaaccccctgatggccaacggcaccctgaccagaagacaccagaacggcagattcgtgggcgacgccgacctggagagacagaagttcagcgacctgaagctgaacggcccccaggaccacagccacctgctgtacagcaccatccccagaatgcaggagcccggccagatcgtggagacctacaccgaggaggaccccgagggcgccatgagcgtggtgagcgtggagaccagcgacgacggcaccaccagaagaaccgagaccaccgtgaagaaggtggtgaagaccgtgaccaccagaaccgtgcagcccgtggccatgggccccgacggcctgcccgtggacgccagcagcgtgagcaacaactacatccagaccctgggcagagacttcagaaagaacggcaacggcggccccggcccctacgtgggccaggccggcaccgccaccctgcccagaaacttccactacccccccgacggctacagcagacactacgaggacggctaccccggcggcagcgacaactacggcagcctgagcagagtgaccagaatcgaggagagatacagacccagcatggagggctacagagcccccagcagacaggacgtgtacggcccccagccccaggtgagagtgggcggcagcagcgtggacctgcacagattccaccccgagccctacggcctggaggacgaccagagaagcatgggctacgacgacctggactacggcatgatgagcgactacggcaccgccagaagaaccggcacccccagcgaccccagaagaagactgagaagctacgaggacatgatcggcgaggaggtgcccagcgaccagtactactgggcccccctggcccagcacgagagaggcagcctggccagcctggacagcctgagaaagggcggcccccccccccccaactggagacagcccgagctgcccgaggtgatcgccatgctgggcttcagactggacgccgtgaagagcaacgccgccgcctacctgcagcacctgtgctacagaaacgacaaggtgaagaccgacgtgagaaagctgaagggcatccccgtgctggtgggcctgctggaccaccccaagaaggaggtgcacctgggcgcctgcggcgccctgaagaacatcagcttcggcagagaccaggacaacaagatcgccatcaagaactgcgacggcgtgcccgccctggtgagactgctgagaaaggccagagacatggacctgaccgaggtgatcaccggcaccctgtggaacctgagcagccacgacagcatcaagatggagatcgtggaccacgccctgcacgccctgaccgacgaggtgatcatcccccacagcggctgggagagagagcccaacgaggactgcaagcccagacacatcgagtgggagagcgtgctgaccaacaccgccggctgcctgagaaacgtgagcagcgagagaagcgaggccagaagaaagctgagagagtgcgacggcctggtggacgccctgatcttcatcgtgcaggccgagatcggccagaaggacagcgacagcaagctggtggagaactgcgtgtgcctgctgagaaacctgagctaccaggtgcacagagagatcccccaggccgagagataccaggaggccgcccccaacgtggccaacaacaccggcccccacgccgccagctgcttcggcgccaagaagggcaagggcaagaagcccatcgaggaccccgccaacgacaccgtggacttccccaagagaaccagccccgccagaggctacgagctgctgttccagcccgaggtggtgagaatctacatcagcctgctgaaggagagcaagacccccgccatcctggaggccagcgccggcgccatccagaacctgtgcgccggcagatggacctacggcagatacatcagaagcgccctgagacaggagaaggccctgagcgccatcgccgacctgctgaccaacgagcacgagagagtggtgaaggccgccagcggcgccctgagaaacctggccgtggacgccagaaacaaggagctgatcggcaagcacgccatccccaacctggtgaagaacctgcccggcggccagcagaacagcagctggaacttcagcgaggacaccgtgatcagcatcctgaacaccatcaacgaggtgatcgccgagaacctggaggccgccaagaagctgagagagacccagggcatcgagaagctggtgctgatcaacaagagcggcaacagaagcgagaaggaggtgagagccgccgccctggtgctgcagaccatctggggctacaaggagctgagaaagcccctggagaaggagggctggaagaagagcgacttccaggtgaacctgaacaacgccagcagaagccagagcagccacagctacgacgacagcaccctgcccctgatcgacagaaaccagaagagcgacaagaagcccgacagagaggagatccagatgagcaacatgggcagcaacaccaagagcctggacaacaactacagcacccccaacgagagaggcgaccacaacagaaccctggacagaagcggcgacctgggcgacatggagcccctgaagggcaccacccccctgatgcaggacgagggccaggagagcctggaggaggagctggacgtgctggtgctggacgacgagggcggccaggtgagctaccccagcatgcagaagatctag

SEQ ID NO: 75672 - DNA, 2826 bp, Artificial Sequence
  Description of Artificial Sequence: Synthetic coding sequence
atggacgacagcgaggtggagagcaccgccagcatcctggccagcgtgaaggagcaggaggcccagttcgagaagctgaccagagccctggaggaggagagaagacacgtgagcgcccagctggagagagtgagagtgagcccccaggacgccaaccccctgatggccaacggcaccctgaccagaagacaccagaacggcagattcgtgggcgacgccgacctggagagacagaagttcagcgacctgaagctgaacggcccccaggaccacagccacctgctgtacagcaccatccccagaatgcaggagcccggccagatcgtggagacctacaccgaggaggaccccgagggcgccatgagcgtggtgagcgtggagaccagcgacgacggcaccaccagaagaaccgagaccaccgtgaagaaggtggtgaagaccgtgaccaccagaaccgtgcagcccgtggccatgggccccgacggcctgcccgtggacgccagcagcgtgagcaacaactacatccagaccctgggcagagacttcagaaagaacggcaacggcggccccggcccctacgtgggccaggccggcaccgccaccctgcccagaaacttccactacccccccgacggctacagcagacactacgaggacggctaccccggcggcagcgacaactacggcagcctgagcagagtgaccagaatcgaggagagatacagacccagcatggagggctacagagcccccagcagacaggacgtgtacggcccccagccccaggtgagagtgggcggcagcagcgtggacctgcacagattccaccccgagccctacggcctggaggacgaccagagaagcatgggctacgacgacctggactacggcatgatgagcgactacggcaccgccagaagaaccggcacccccagcgaccccagaagaagactgagaagctacgaggacatgatcggcgaggaggtgcccagcgaccagtactactgggcccccctggcccagcacgagagaggcagcctggccagcctggacagcctgagaaagggcggcccccccccccccaactggagacagcccgagctgcccgaggtgatcgccatgctgggcttcagactggacgccgtgaagagcaacgccgccgcctacctgcagcacctgtgctacagaaacgacaaggtgaagaccgacgtgagaaagctgaagggcatccccgtgctggtgggcctgctggaccaccccaagaaggaggtgcacctgggcgcctgcggcgccctgaagaacatcagcttcggcagagaccaggacaacaagatcgccatcaagaactgcgacggcgtgcccgccctggtgagactgctgagaaaggccagagacatggacctgaccgaggtgatcaccggcaccctgtggaacctgagcagccacgacagcatcaagatggagatcgtggaccacgccctgcacgccctgaccgacgaggtgatcatcccccacagcggctgggagagagagcccaacgaggactgcaagcccagacacatcgagtgggagagcgtgctgaccaacaccgccggctgcctgagaaacgtgagcagcgagagaagcgaggccagaagaaagctgagagagtgcgacggcctggtggacgccctgatcttcatcgtgcaggccgagatcggccagaaggacagcgacagcaagctggtggagaactgcgtgtgcctgctgagaaacctgagctaccaggtgcacagagagatcccccaggccgagagataccaggaggccgcccccaacgtggccaacaacaccggcccccacgccgccagctgcttcggcgccaagaagggcaagggcaagaagcccatcgaggaccccgccaacgacaccgtggacttccccaagagaaccagccccgccagaggctacgagctgctgttccagcccgaggtggtgagaatctacatcagcctgctgaaggagagcaagacccccgccatcctggaggccagcgccggcgccatccagaacctgtgcgccggcagatggacctacggcagatacatcagaagcgccctgagacaggagaaggccctgagcgccatcgccgacctgctgaccaacgagcacgagagagtggtgaaggccgccagcggcgccctgagaaacctggccgtggacgccagaaacaaggagctgatcggcaagcacgccatccccaacctggtgaagaacctgcccggcggccagcagaacagcagctggaacttcagcgaggacaccgtgatcagcatcctgaacaccatcaacgaggtgatcgccgagaacctggaggccgccaagaagctgagagagacccagggcatcgagaagctggtgctgatcaacaagagcggcaacagaagcgagaaggaggtgagagccgccgccctggtgctgcagaccatctggggctacaaggagctgagaaagcccctggagaaggagggctggaagaagagcgacttccaggtgaacctgaacaacgccagcagaagccagagcagccacagctacgacgacagcaccctgcccctgatcgacagaaaccagaagagcgacaacaactacagcacccccaacgagagaggcgaccacaacagaaccctggacagaagcggcgacctgggcgacatggagcccctgaagggcaccacccccctgatgcaggacgagggccaggagagcctggaggaggagctggacgtgctggtgctggacgacgagggcggccaggtgagctaccccagcatgcagaagatctag

SEQ ID NO: 75673 - DNA, 2802 bp, Artificial Sequence; identical to SEQ ID NO: 75669
  Description of Artificial Sequence: Synthetic coding sequence

SEQ ID NO: 75674 - DNA, 2817 bp, Artificial Sequence
  Description of Artificial Sequence: Synthetic coding sequence
atggacgacagcgaggtggagagcaccgccagcatcctggccagcgtgaaggagcaggaggcccagttcgagaagctgaccagagccctggaggaggagagaagacacgtgagcgcccagctggagagagtgagagtgagcccccaggacgccaaccccctgatggccaacggcaccctgaccagaagacaccagaacggcagattcgtgggcgacgccgacctggagagacagaagttcagcgacctgaagctgaacggcccccaggaccacagccacctgctgtacagcaccatccccagaatgcaggagcccggccagatcgtggagacctacaccgaggaggaccccgagggcgccatgagcgtggtgagcgtggagaccagcgacgacggcaccaccagaagaaccgagaccaccgtgaagaaggtggtgaagaccgtgaccaccagaaccgtgcagcccgtggccatgggccccgacggcctgcccgtggacgccagcagcgtgagcaacaactacatccagaccctgggcagagacttcagaaagaacggcaacggcggccccggcccctacgtgggccaggccggcaccgccaccctgcccagaaacttccactacccccccgacggctacagcagacactacgaggacggctaccccggcggcagcgacaactacggcagcctgagcagagtgaccagaatcgaggagagatacagacccagcatggagggctacagagcccccagcagacaggacgtgtacggcccccagccccaggtgagagtgggcggcagcagcgtggacctgcacagattccaccccgagccctacggcctggaggacgaccagagaagcatgggctacgacgacctggactacggcatgatgagcgactacggcaccgccagaagaaccggcacccccagcgaccccagaagaagactgagaagctacgaggacatgatcggcgaggaggtgcccagcgaccagtactactgggcccccctggcccagcacgagagaggcagcctggccagcctggacagcctgagaaagggcggcccccccccccccaactggagacagcccgagctgcccgaggtgatcgccatgctgggcttcagactggacgccgtgaagagcaacgccgccgcctacctgcagcacctgtgctacagaaacgacaaggtgaagaccgacgtgagaaagctgaagggcatccccgtgctggtgggcctgctggaccaccccaagaaggaggtgcacctgggcgcctgcggcgccctgaagaacatcagcttcggcagagaccaggacaacaagatcgccatcaagaactgcgacggcgtgcccgccctggtgagactgctgagaaaggccagagacatggacctgaccgaggtgatcaccggcaccctgtggaacctgagcagccacgacagcatcaagatggagatcgtggaccacgccctgcacgccctgaccgacgaggtgatcatcccccacagcggctgggagagagagcccaacgaggactgcaagcccagacacatcgagtgggagagcgtgctgaccaacaccgccggctgcctgagaaacgtgagcagcgagagaagcgaggccagaagaaagctgagagagtgcgacggcctggtggacgccctgatcttcatcgtgcaggccgagatcggccagaaggacagcgacagcaagctggtggagaactgcgtgtgcctgctgagaaacctgagctaccaggtgcacagagagatcccccaggccgagagataccaggaggccgcccccaacgtggccaacaacaccggcccccacgccgccagctgcttcggcgccaagaagggcaaggacgagtggttcagcagaggcaagaagcccatcgaggaccccgccaacgacaccgtggacttccccaagagaaccagccccgccagaggctacgagctgctgttccagcccgaggtggtgagaatctacatcagcctgctgaaggagagcaagacccccgccatcctggaggccagcgccggcgccatccagaacctgtgcgccggcagatggacctacggcagatacatcagaagcgccctgagacaggagaaggccctgagcgccatcgccgacctgctgaccaacgagcacgagagagtggtgaaggccgccagcggcgccctgagaaacctggccgtggacgccagaaacaaggagctgatcggcaagcacgccatccccaacctggtgaagaacctgcccggcggccagcagaacagcagctggaacttcagcgaggacaccgtgatcagcatcctgaacaccatcaacgaggtgatcgccgagaacctggaggccgccaagaagctgagagagacccagggcatcgagaagctggtgctgatcaacaagagcggcaacagaagcgagaaggaggtgagagccgccgccctggtgctgcagaccatctggggctacaaggagctgagaaagcccctggagaaggagggctggaagaagagcgacttccaggtgaacctgaacaacgccagcagaagccagagcagccacagctacgacgacagcaccctgcccctgatcgacagaaaccagaagagcgacaagaagcccgacagagaggagatccagatgagcaacatgggcagcaacaccaagagcctggacaacaactacagcacccccaacgagagaggcgaccacaacagaaccctggacagaagcggcgacctgggcgacatggagcccctgaagggcaccacccccctgatgaagatctag

SEQ ID NO: 75675 - DNA, 2907 bp, Artificial Sequence
  Description of Artificial Sequence: Synthetic coding sequence
atggacgacagcgaggtggagagcaccgccagcatcctggccagcgtgaaggagcaggaggcccagttcgagaagctgaccagagccctggaggaggagagaagacacgtgagcgcccagctggagagagtgagagtgagcccccaggacgccaaccccctgatggccaacggcaccctgaccagaagacaccagaacggcagattcgtgggcgacgccgacctggagagacagaagttcagcgacctgaagctgaacggcccccaggaccacagccacctgctgtacagcaccatccccagaatgcaggagcccggccagatcgtggagacctacaccgaggaggaccccgagggcgccatgagcgtggtgagcgtggagaccagcgacgacggcaccaccagaagaaccgagaccaccgtgaagaaggtggtgaagaccgtgaccaccagaaccgtgcagcccgtggccatgggccccgacggcctgcccgtggacgccagcagcgtgagcaacaactacatccagaccctgggcagagacttcagaaagaacggcaacggcggccccggcccctacgtgggccaggccggcaccgccaccctgcccagaaacttccactacccccccgacggctacagcagacactacgaggacggctaccccggcggcagcgacaactacggcagcctgagcagagtgaccagaatcgaggagagatacagacccagcatggagggctacagagcccccagcagacaggacgtgtacggcccccagccccaggtgagagtgggcggcagcagcgtggacctgcacagattccaccccgagccctacggcctggaggacgaccagagaagcatgggctacgacgacctggactacggcatgatgagcgactacggcaccgccagaagaaccggcacccccagcgaccccagaagaagactgagaagctacgaggacatgatcggcgaggaggtgcccagcgaccagtactactgggcccccctggcccagcacgagagaggcagcctggccagcctggacagcctgagaaagggcggcccccccccccccaactggagacagcccgagctgcccgaggtgatcgccatgctgggcttcagactggacgccgtgaagagcaacgccgccgcctacctgcagcacctgtgctacagaaacgacaaggtgaagaccgacgtgagaaagctgaagggcatccccgtgctggtgggcctgctggaccaccccaagaaggaggtgcacctgggcgcctgcggcgccctgaagaacatcagcttcggcagagaccaggacaacaagatcgccatcaagaactgcgacggcgtgcccgccctggtgagactgctgagaaaggccagagacatggacctgaccgaggtgatcaccggcaccctgtggaacctgagcagccacgacagcatcaagatggagatcgtggaccacgccctgcacgccctgaccgacgaggtgatcatcccccacagcggctgggagagagagcccaacgaggactgcaagcccagacacatcgagtgggagagcgtgctgaccaacaccgccggctgcctgagaaacgtgagcagcgagagaagcgaggccagaagaaagctgagagagtgcgacggcctggtggacgccctgatcttcatcgtgcaggccgagatcggccagaaggacagcgacagcaagctggtggagaactgcgtgtgcctgctgagaaacctgagctaccaggtgcacagagagatcccccaggccgagagataccaggaggccgcccccaacgtggccaacaacaccggcccccacgccgccagctgcttcggcgccaagaagggcaaggacgagtggttcagcagaggcaagaagcccatcgaggaccccgccaacgacaccgtggacttccccaagagaaccagccccgccagaggctacgagctgctgttccagcccgaggtggtgagaatctacatcagcctgctgaaggagagcaagacccccgccatcctggaggccagcgccggcgccatccagaacctgtgcgccggcagatggacctacggcagatacatcagaagcgccctgagacaggagaaggccctgagcgccatcgccgacctgctgaccaacgagcacgagagagtggtgaaggccgccagcggcgccctgagaaacctggccgtggacgccagaaacaaggagctgatcggcaagcacgccatccccaacctggtgaagaacctgcccggcggccagcagaacagcagctggaacttcagcgaggacaccgtgatcagcatcctgaacaccatcaacgaggtgatcgccgagaacctggaggccgccaagaagctgagagagacccagggcatcgagaagctggtgctgatcaacaagagcggcaacagaagcgagaaggaggtgagagccgccgccctggtgctgcagaccatctggggctacaaggagctgagaaagcccctggagaaggagggctggaagaagagcgacttccaggtgaacctgaacaacgccagcagaagccagagcagccacagctacgacgacagcaccctgcccctgatcgacagaaaccagaagagcgacaagaagcccgacagagaggagatccagatgagcaacatgggcagcaacaccaagagcctggacaacaactacagcacccccaacgagagaggcgaccacaacagaaccctggacagaagcggcgacctgggcgacatggagcccctgaagggcaccacccccctgatgcaggacgagggccaggagagcctggaggaggagctggacgtgctggtgctggacgacgagggcggccaggtgagctaccccagcatgcagaagatctag

SEQ ID NO: 75676 - DNA, 2604 bp, Artificial Sequence
  Description of Artificial Sequence: Synthetic coding sequence
atgcaggagcccggccagatcgtggagacctacaccgaggaggaccccgagggcgccatgagcgtggtgagcgtggagaccagcgacgacggcaccaccagaagaaccgagaccaccgtgaagaaggtggtgaagaccgtgaccaccagaaccgtgcagcccgtggccatgggccccgacggcctgcccgtggacgccagcagcgtgagcaacaactacatccagaccctgggcagagacttcagaaagaacggcaacggcggccccggcccctacgtgggccaggccggcaccgccaccctgcccagaaacttccactacccccccgacggctacagcagacactacgaggacggctaccccggcggcagcgacaactacggcagcctgagcagagtgaccagaatcgaggagagatacagacccagcatggagggctacagagcccccagcagacaggacgtgtacggcccccagccccaggtgagagtgggcggcagcagcgtggacctgcacagattccaccccgagccctacggcctggaggacgaccagagaagcatgggctacgacgacctggactacggcatgatgagcgactacggcaccgccagaagaaccggcacccccagcgaccccagaagaagactgagaagctacgaggacatgatcggcgaggaggtgcccagcgaccagtactactgggcccccctggcccagcacgagagaggcagcctggccagcctggacagcctgagaaagggcggcccccccccccccaactggagacagcccgagctgcccgaggtgatcgccatgctgggcttcagactggacgccgtgaagagcaacgccgccgcctacctgcagcacctgtgctacagaaacgacaaggtgaagaccgacgtgagaaagctgaagggcatccccgtgctggtgggcctgctggaccaccccaagaaggaggtgcacctgggcgcctgcggcgccctgaagaacatcagcttcggcagagaccaggacaacaagatcgccatcaagaactgcgacggcgtgcccgccctggtgagactgctgagaaaggccagagacatggacctgaccgaggtgatcaccggcaccctgtggaacctgagcagccacgacagcatcaagatggagatcgtggaccacgccctgcacgccctgaccgacgaggtgatcatcccccacagcggctgggagagagagcccaacgaggactgcaagcccagacacatcgagtgggagagcgtgctgaccaacaccgccggctgcctgagaaacgtgagcagcgagagaagcgaggccagaagaaagctgagagagtgcgacggcctggtggacgccctgatcttcatcgtgcaggccgagatcggccagaaggacagcgacagcaagctggtggagaactgcgtgtgcctgctgagaaacctgagctaccaggtgcacagagagatcccccaggccgagagataccaggaggccgcccccaacgtggccaacaacaccggcccccacgccgccagctgcttcggcgccaagaagggcaaggacgagtggttcagcagaggcaagaagcccatcgaggaccccgccaacgacaccgtggacttccccaagagaaccagccccgccagaggctacgagctgctgttccagcccgaggtggtgagaatctacatcagcctgctgaaggagagcaagacccccgccatcctggaggccagcgccggcgccatccagaacctgtgcgccggcagatggacctacggcagatacatcagaagcgccctgagacaggagaaggccctgagcgccatcgccgacctgctgaccaacgagcacgagagagtggtgaaggccgccagcggcgccctgagaaacctggccgtggacgccagaaacaaggagctgatcggcaagcacgccatccccaacctggtgaagaacctgcccggcggccagcagaacagcagctggaacttcagcgaggacaccgtgatcagcatcctgaacaccatcaacgaggtgatcgccgagaacctggaggccgccaagaagctgagagagacccagggcatcgagaagctggtgctgatcaacaagagcggcaacagaagcgagaaggaggtgagagccgccgccctggtgctgcagaccatctggggctacaaggagctgagaaagcccctggagaaggagggctggaagaagagcgacttccaggtgaacctgaacaacgccagcagaagccagagcagccacagctacgacgacagcaccctgcccctgatcgacagaaaccagaagagcgacaagaagcccgacagagaggagatccagatgagcaacatgggcagcaacaccaagagcctggacaacaactacagcacccccaacgagagaggcgaccacaacagaaccctggacagaagcggcgacctgggcgacatggagcccctgaagggcaccacccccctgatgcaggacgagggccaggagagcctggaggaggagctggacgtgctggtgctggacgacgagggcggccaggtgagctaccccagcatgcagaagatctag

SEQ ID NO: 75677 - DNA, 2499 bp, Artificial Sequence
  Description of Artificial Sequence: Synthetic coding sequence
atgcaggagcccggccagatcgtggagacctacaccgaggaggaccccgagggcgccatgagcgtggtgagcgtggagaccagcgacgacggcaccaccagaagaaccgagaccaccgtgaagaaggtggtgaagaccgtgaccaccagaaccgtgcagcccgtggccatgggccccgacggcctgcccgtggacgccagcagcgtgagcaacaactacatccagaccctgggcagagacttcagaaagaacggcaacggcggccccggcccctacgtgggccaggccggcaccgccaccctgcccagaaacttccactacccccccgacggctacagcagacactacgaggacggctaccccggcggcagcgacaactacggcagcctgagcagagtgaccagaatcgaggagagatacagacccagcatggagggctacagagcccccagcagacaggacgtgtacggcccccagccccaggtgagagtgggcggcagcagcgtggacctgcacagattccaccccgagccctacggcctggaggacgaccagagaagcatgggctacgacgacctggactacggcatgatgagcgactacggcaccgccagaagaaccggcacccccagcgaccccagaagaagactgagaagctacgaggacatgatcggcgaggaggtgcccagcgaccagtactactgggcccccctggcccagcacgagagaggcagcctggccagcctggacagcctgagaaagggcggcccccccccccccaactggagacagcccgagctgcccgaggtgatcgccatgctgggcttcagactggacgccgtgaagagcaacgccgccgcctacctgcagcacctgtgctacagaaacgacaaggtgaagaccgacgtgagaaagctgaagggcatccccgtgctggtgggcctgctggaccaccccaagaaggaggtgcacctgggcgcctgcggcgccctgaagaacatcagcttcggcagagaccaggacaacaagatcgccatcaagaactgcgacggcgtgcccgccctggtgagactgctgagaaaggccagagacatggacctgaccgaggtgatcaccggcaccctgtggaacctgagcagccacgacagcatcaagatggagatcgtggaccacgccctgcacgccctgaccgacgaggtgatcatcccccacagcggctgggagagagagcccaacgaggactgcaagcccagacacatcgagtgggagagcgtgctgaccaacaccgccggctgcctgagaaacgtgagcagcgagagaagcgaggccagaagaaagctgagagagtgcgacggcctggtggacgccctgatcttcatcgtgcaggccgagatcggccagaaggacagcgacagcaagctggtggagaactgcgtgtgcctgctgagaaacctgagctaccaggtgcacagagagatcccccaggccgagagataccaggaggccgcccccaacgtggccaacaacaccggcccccacgccgccagctgcttcggcgccaagaagggcaagggcaagaagcccatcgaggaccccgccaacgacaccgtggacttccccaagagaaccagccccgccagaggctacgagctgctgttccagcccgaggtggtgagaatctacatcagcctgctgaaggagagcaagacccccgccatcctggaggccagcgccggcgccatccagaacctgtgcgccggcagatggacctacggcagatacatcagaagcgccctgagacaggagaaggccctgagcgccatcgccgacctgctgaccaacgagcacgagagagtggtgaaggccgccagcggcgccctgagaaacctggccgtggacgccagaaacaaggagctgatcggcaagcacgccatccccaacctggtgaagaacctgcccggcggccagcagaacagcagctggaacttcagcgaggacaccgtgatcagcatcctgaacaccatcaacgaggtgatcgccgagaacctggaggccgccaagaagctgagagagacccagggcatcgagaagctggtgctgatcaacaagagcggcaacagaagcgagaaggaggtgagagccgccgccctggtgctgcagaccatctggggctacaaggagctgagaaagcccctggagaaggagggctggaagaagagcgacttccaggtgaacctgaacaacgccagcagaagccagagcagccacagctacgacgacagcaccctgcccctgatcgacagaaaccagaagagcgacaagaagcccgacagagaggagatccagatgagcaacatgggcagcaacaccaagagcctggacaacaactacagcacccccaacgagagaggcgaccacaacagaaccctggacagaagcggcgacctgggcgacatggagcccctgaagggcaccacccccctgatgcagaagatctag

SEQ ID NO: 75678 - DNA, 2802 bp, Artificial Sequence; identical to SEQ ID NO: 75669
  Description of Artificial Sequence: Synthetic coding sequence

SEQ ID NO: 75679 - DNA, 15 bp, Artificial Sequence
  Description of Artificial Sequence: Synthetic coding sequence
atggacgacagctag

SEQ ID NO: 75680 - DNA, 2802 bp, Artificial Sequence; identical to SEQ ID NO: 75669
  Description of Artificial Sequence: Synthetic coding sequence

SEQ ID NO: 75681 - DNA, 1851 bp, Artificial Sequence
  Description of Artificial Sequence: Synthetic coding sequence
atgatcggcgaggaggtgcccagcgaccagtactactgggcccccctggcccagcacgagagaggcagcctggccagcctggacagcctgagaaagggcggcccccccccccccaactggagacagcccgagctgcccgaggtgatcgccatgctgggcttcagactggacgccgtgaagagcaacgccgccgcctacctgcagcacctgtgctacagaaacgacaaggtgaagaccgacgtgagaaagctgaagggcatccccgtgctggtgggcctgctggaccaccccaagaaggaggtgcacctgggcgcctgcggcgccctgaagaacatcagcttcggcagagaccaggacaacaagatcgccatcaagaactgcgacggcgtgcccgccctggtgagactgctgagaaaggccagagacatggacctgaccgaggtgatcaccggcaccctgtggaacctgagcagccacgacagcatcaagatggagatcgtggaccacgccctgcacgccctgaccgacgaggtgatcatcccccacagcggctgggagagagagcccaacgaggactgcaagcccagacacatcgagtgggagagcgtgctgaccaacaccgccggctgcctgagaaacgtgagcagcgagagaagcgaggccagaagaaagctgagagagtgcgacggcctggtggacgccctgatcttcatcgtgcaggccgagatcggccagaaggacagcgacagcaagctggtggagaactgcgtgtgcctgctgagaaacctgagctaccaggtgcacagagagatcccccaggccgagagataccaggaggccgcccccaacgtggccaacaacaccggcccccacgccgccagctgcttcggcgccaagaagggcaaggacgagtggttcagcagaggcaagaagcccatcgaggaccccgccaacgacaccgtggacttccccaagagaaccagccccgccagaggctacgagctgctgttccagcccgaggtggtgagaatctacatcagcctgctgaaggagagcaagacccccgccatcctggaggccagcgccggcgccatccagaacctgtgcgccggcagatggacctacggcagatacatcagaagcgccctgagacaggagaaggccctgagcgccatcgccgacctgctgaccaacgagcacgagagagtggtgaaggccgccagcggcgccctgagaaacctggccgtggacgccagaaacaaggagctgatcggcaagcacgccatccccaacctggtgaagaacctgcccggcggccagcagaacagcagctggaacttcagcgaggacaccgtgatcagcatcctgaacaccatcaacgaggtgatcgccgagaacctggaggccgccaagaagctgagagagacccagggcatcgagaagctggtgctgatcaacaagagcggcaacagaagcgagaaggaggtgagagccgccgccctggtgctgcagaccatctggggctacaaggagctgagaaagcccctggagaaggagggctggaagaagagcgacttccaggtgaacctgaacaacgccagcagaagccagagcagccacagctacgacgacagcaccctgcccctgatcgacagaaaccagaagagcgacaagaagcccgacagagaggagatccagatgagcaacatgggcagcaacaccaagagcctggacaacaactacagcacccccaacgagagaggcgaccacaacagaaccctggacagaagcggcgacctgggcgacatggagcccctgaagggcaccacccccctgatgcagaagatctag

SEQ ID NO: 75682 - DNA, 2727 bp, Artificial Sequence
  Description of Artificial Sequence: Synthetic coding sequence
atggccaacggcaccctgaccagaagacaccagaacggcagattcgtgggcgacgccgacctggagagacagaagttcagcgacctgaagctgaacggcccccaggaccacagccacctgctgtacagcaccatccccagaatgcaggagcccggccagatcgtggagacctacaccgaggaggaccccgagggcgccatgagcgtggtgagcgtggagaccagcgacgacggcaccaccagaagaaccgagaccaccgtgaagaaggtggtgaagaccgtgaccaccagaaccgtgcagcccgtggccatgggccccgacggcctgcccgtggacgccagcagcgtgagcaacaactacatccagaccctgggcagagacttcagaaagaacggcaacggcggccccggcccctacgtgggccaggccggcaccgccaccctgcccagaaacttccactacccccccgacggctacagcagacactacgaggacggctaccccggcggcagcgacaactacggcagcctgagcagagtgaccagaatcgaggagagatacagacccagcatggagggctacagagcccccagcagacaggacgtgtacggcccccagccccaggtgagagtgggcggcagcagcgtggacctgcacagattccaccccgagccctacggcctggaggacgaccagagaagcatgggctacgacgacctggactacggcatgatgagcgactacggcaccgccagaagaaccggcacccccagcgaccccagaagaagactgagaagctacgaggacatgatcggcgaggaggtgcccagcgaccagtactactgggcccccctggcccagcacgagagaggcagcctggccagcctggacagcctgagaaagggcggcccccccccccccaactggagacagcccgagctgcccgaggtgatcgccatgctgggcttcagactggacgccgtgaagagcaacgccgccgcctacctgcagcacctgtgctacagaaacgacaaggtgaagaccgacgtgagaaagctgaagggcatccccgtgctggtgggcctgctggaccaccccaagaaggaggtgcacctgggcgcctgcggcgccctgaagaacatcagcttcggcagagaccaggacaacaagatcgccatcaagaactgcgacggcgtgcccgccctggtgagactgctgagaaaggccagagacatggacctgaccgaggtgatcaccggcaccctgtggaacctgagcagccacgacagcatcaagatggagatcgtggaccacgccctgcacgccctgaccgacgaggtgatcatcccccacagcggctgggagagagagcccaacgaggactgcaagcccagacacatcgagtgggagagcgtgctgaccaacaccgccggctgcctgagaaacgtgagcagcgagagaagcgaggccagaagaaagctgagagagtgcgacggcctggtggacgccctgatcttcatcgtgcaggccgagatcggccagaaggacagcgacagcaagctggtggagaactgcgtgtgcctgctgagaaacctgagctaccaggtgcacagagagatcccccaggccgagagataccaggaggccgcccccaacgtggccaacaacaccggcccccacgccgccagctgcttcggcgccaagaagggcaagggcaagaagcccatcgaggaccccgccaacgacaccgtggacttccccaagagaaccagccccgccagaggctacgagctgctgttccagcccgaggtggtgagaatctacatcagcctgctgaaggagagcaagacccccgccatcctggaggccagcgccggcgccatccagaacctgtgcgccggcagatggacctacggcagatacatcagaagcgccctgagacaggagaaggccctgagcgccatcgccgacctgctgaccaacgagcacgagagagtggtgaaggccgccagcggcgccctgagaaacctggccgtggacgccagaaacaaggagctgatcggcaagcacgccatccccaacctggtgaagaacctgcccggcggccagcagaacagcagctggaacttcagcgaggacaccgtgatcagcatcctgaacaccatcaacgaggtgatcgccgagaacctggaggccgccaagaagctgagagagacccagggcatcgagaagctggtgctgatcaacaagagcggcaacagaagcgagaaggaggtgagagccgccgccctggtgctgcagaccatctggggctacaaggagctgagaaagcccctggagaaggagggctggaagaagagcgacttccaggtgaacctgaacaacgccagcagaagccagagcagccacagctacgacgacagcaccctgcccctgatcgacagaaaccagaagagcgacaagaagcccgacagagaggagatccagatgagcaacatgggcagcaacaccaagagcctggacaacaactacagcacccccaacgagagaggcgaccacaacagaaccctggacagaagcggcgacctgggcgacatggagcccctgaagggcaccacccccctgatgcaggacgagggccaggagagcctggaggaggagctggacgtgctggtgctggacgacgagggcggccaggtgagctaccccagcatgcagaagatctag

SEQ ID NO: 75683 - DNA, 1833 bp, Artificial Sequence
  Description of Artificial Sequence: Synthetic coding sequence
atgatcggcgaggaggtgcccagcgaccagtactactgggcccccctggcccagcacgagagaggcagcctggccagcctggacagcctgagaaagggcggcccccccccccccaactggagacagcccgagctgcccgaggtgatcgccatgctgggcttcagactggacgccgtgaagagcaacgccgccgcctacctgcagcacctgtgctacagaaacgacaaggtgaagaccgacgtgagaaagctgaagggcatccccgtgctggtgggcctgctggaccaccccaagaaggaggtgcacctgggcgcctgcggcgccctgaagaacatcagcttcggcagagaccaggacaacaagatcgccatcaagaactgcgacggcgtgcccgccctggtgagactgctgagaaaggccagagacatggacctgaccgaggtgatcaccggcaccctgtggaacctgagcagccacgacagcatcaagatggagatcgtggaccacgccctgcacgccctgaccgacgaggtgatcatcccccacagcggctgggagagagagcccaacgaggactgcaagcccagacacatcgagtgggagagcgtgctgaccaacaccgccggctgcctgagaaacgtgagcagcgagagaagcgaggccagaagaaagctgagagagtgcgacggcctggtggacgccctgatcttcatcgtgcaggccgagatcggccagaaggacagcgacagcaagctggtggagaactgcgtgtgcctgctgagaaacctgagctaccaggtgcacagagagatcccccaggccgagagataccaggaggccgcccccaacgtggccaacaacaccggcccccacgccgccagctgcttcggcgccaagaagggcaagggcaagaagcccatcgaggaccccgccaacgacaccgtggacttccccaagagaaccagccccgccagaggctacgagctgctgttccagcccgaggtggtgagaatctacatcagcctgctgaaggagagcaagacccccgccatcctggaggccagcgccggcgccatccagaacctgtgcgccggcagatggacctacggcagatacatcagaagcgccctgagacaggagaaggccctgagcgccatcgccgacctgctgaccaacgagcacgagagagtggtgaaggccgccagcggcgccctgagaaacctggccgtggacgccagaaacaaggagctgatcggcaagcacgccatccccaacctggtgaagaacctgcccggcggccagcagaacagcagctggaacttcagcgaggacaccgtgatcagcatcctgaacaccatcaacgaggtgatcgccgagaacctggaggccgccaagaagctgagagagacccagggcatcgagaagctggtgctgatcaacaagagcggcaacagaagcgagaaggaggtgagagccgccgccctggtgctgcagaccatctggggctacaaggagctgagaaagcccctggagaaggagggctggaagaagagcgacttccaggtgaacctgaacaacgccagcagaagccagagcagccacagctacgacgacagcaccctgcccctgatcgacagaaaccagaagagcgacaagaagcccgacagagaggagatccagatgagcaacatgggcagcaacaccaagagcctggacaacaactacagcacccccaacgagagaggcgaccacaacagaaccctggacagaagcggcgacctgggcgacatggagcccctgaagggcaccacccccctgatgcagaagatctag

SEQ ID NO: 75684 - DNA, 1938 bp, Artificial Sequence
  Description of Artificial Sequence: Synthetic coding sequence
atgatcggcgaggaggtgcccagcgaccagtactactgggcccccctggcccagcacgagagaggcagcctggccagcctggacagcctgagaaagggcggcccccccccccccaactggagacagcccgagctgcccgaggtgatcgccatgctgggcttcagactggacgccgtgaagagcaacgccgccgcctacctgcagcacctgtgctacagaaacgacaaggtgaagaccgacgtgagaaagctgaagggcatccccgtgctggtgggcctgctggaccaccccaagaaggaggtgcacctgggcgcctgcggcgccctgaagaacatcagcttcggcagagaccaggacaacaagatcgccatcaagaactgcgacggcgtgcccgccctggtgagactgctgagaaaggccagagacatggacctgaccgaggtgatcaccggcaccctgtggaacctgagcagccacgacagcatcaagatggagatcgtggaccacgccctgcacgccctgaccgacgaggtgatcatcccccacagcggctgggagagagagcccaacgaggactgcaagcccagacacatcgagtgggagagcgtgctgaccaacaccgccggctgcctgagaaacgtgagcagcgagagaagcgaggccagaagaaagctgagagagtgcgacggcctggtggacgccctgatcttcatcgtgcaggccgagatcggccagaaggacagcgacagcaagctggtggagaactgcgtgtgcctgctgagaaacctgagctaccaggtgcacagagagatcccccaggccgagagataccaggaggccgcccccaacgtggccaacaacaccggcccccacgccgccagctgcttcggcgccaagaagggcaaggacgagtggttcagcagaggcaagaagcccatcgaggaccccgccaacgacaccgtggacttccccaagagaaccagccccgccagaggctacgagctgctgttccagcccgaggtggtgagaatctacatcagcctgctgaaggagagcaagacccccgccatcctggaggccagcgccggcgccatccagaacctgtgcgccggcagatggacctacggcagatacatcagaagcgccctgagacaggagaaggccctgagcgccatcgccgacctgctgaccaacgagcacgagagagtggtgaaggccgccagcggcgccctgagaaacctggccgtggacgccagaaacaaggagctgatcggcaagcacgccatccccaacctggtgaagaacctgcccggcggccagcagaacagcagctggaacttcagcgaggacaccgtgatcagcatcctgaacaccatcaacgaggtgatcgccgagaacctggaggccgccaagaagctgagagagacccagggcatcgagaagctggtgctgatcaacaagagcggcaacagaagcgagaaggaggtgagagccgccgccctggtgctgcagaccatctggggctacaaggagctgagaaagcccctggagaaggagggctggaagaagagcgacttccaggtgaacctgaacaacgccagcagaagccagagcagccacagctacgacgacagcaccctgcccctgatcgacagaaaccagaagagcgacaagaagcccgacagagaggagatccagatgagcaacatgggcagcaacaccaagagcctggacaacaactacagcacccccaacgagagaggcgaccacaacagaaccctggacagaagcggcgacctgggcgacatggagcccctgaagggcaccacccccctgatgcaggacgagggccaggagagcctggaggaggagctggacgtgctggtgctggacgacgagggcggccaggtgagctaccccagcatgcagaagatctag

SEQ ID NO: 75685 - DNA, 2517 bp, Artificial Sequence
  Description of Artificial Sequence: Synthetic coding sequence
atgcaggagcccggccagatcgtggagacctacaccgaggaggaccccgagggcgccatgagcgtggtgagcgtggagaccagcgacgacggcaccaccagaagaaccgagaccaccgtgaagaaggtggtgaagaccgtgaccaccagaaccgtgcagcccgtggccatgggccccgacggcctgcccgtggacgccagcagcgtgagcaacaactacatccagaccctgggcagagacttcagaaagaacggcaacggcggccccggcccctacgtgggccaggccggcaccgccaccctgcccagaaacttccactacccccccgacggctacagcagacactacgaggacggctaccccggcggcagcgacaactacggcagcctgagcagagtgaccagaatcgaggagagatacagacccagcatggagggctacagagcccccagcagacaggacgtgtacggcccccagccccaggtgagagtgggcggcagcagcgtggacctgcacagattccaccccgagccctacggcctggaggacgaccagagaagcatgggctacgacgacctggactacggcatgatgagcgactacggcaccgccagaagaaccggcacccccagcgaccccagaagaagactgagaagctacgaggacatgatcggcgaggaggtgcccagcgaccagtactactgggcccccctggcccagcacgagagaggcagcctggccagcctggacagcctgagaaagggcggcccccccccccccaactggagacagcccgagctgcccgaggtgatcgccatgctgggcttcagactggacgccgtgaagagcaacgccgccgcctacctgcagcacctgtgctacagaaacgacaaggtgaagaccgacgtgagaaagctgaagggcatccccgtgctggtgggcctgctggaccaccccaagaaggaggtgcacctgggcgcctgcggcgccctgaagaacatcagcttcggcagagaccaggacaacaagatcgccatcaagaactgcgacggcgtgcccgccctggtgagactgctgagaaaggccagagacatggacctgaccgaggtgatcaccggcaccctgtggaacctgagcagccacgacagcatcaagatggagatcgtggaccacgccctgcacgccctgaccgacgaggtgatcatcccccacagcggctgggagagagagcccaacgaggactgcaagcccagacacatcgagtgggagagcgtgctgaccaacaccgccggctgcctgagaaacgtgagcagcgagagaagcgaggccagaagaaagctgagagagtgcgacggcctggtggacgccctgatcttcatcgtgcaggccgagatcggccagaaggacagcgacagcaagctggtggagaactgcgtgtgcctgctgagaaacctgagctaccaggtgcacagagagatcccccaggccgagagataccaggaggccgcccccaacgtggccaacaacaccggcccccacgccgccagctgcttcggcgccaagaagggcaaggacgagtggttcagcagaggcaagaagcccatcgaggaccccgccaacgacaccgtggacttccccaagagaaccagccccgccagaggctacgagctgctgttccagcccgaggtggtgagaatctacatcagcctgctgaaggagagcaagacccccgccatcctggaggccagcgccggcgccatccagaacctgtgcgccggcagatggacctacggcagatacatcagaagcgccctgagacaggagaaggccctgagcgccatcgccgacctgctgaccaacgagcacgagagagtggtgaaggccgccagcggcgccctgagaaacctggccgtggacgccagaaacaaggagctgatcggcaagcacgccatccccaacctggtgaagaacctgcccggcggccagcagaacagcagctggaacttcagcgaggacaccgtgatcagcatcctgaacaccatcaacgaggtgatcgccgagaacctggaggccgccaagaagctgagagagacccagggcatcgagaagctggtgctgatcaacaagagcggcaacagaagcgagaaggaggtgagagccgccgccctggtgctgcagaccatctggggctacaaggagctgagaaagcccctggagaaggagggctggaagaagagcgacttccaggtgaacctgaacaacgccagcagaagccagagcagccacagctacgacgacagcaccctgcccctgatcgacagaaaccagaagagcgacaagaagcccgacagagaggagatccagatgagcaacatgggcagcaacaccaagagcctggacaacaactacagcacccccaacgagagaggcgaccacaacagaaccctggacagaagcggcgacctgggcgacatggagcccctgaagggcaccacccccctgatgcagaagatctag

SEQ ID NO: 75686 - DNA, 2640 bp, Artificial Sequence
  Description of Artificial Sequence: Synthetic coding sequence
atggccaacggcaccctgaccagaagacaccagaacggcagattcgtgggcgacgccgacctggagagacagaagttcagcgacctgaagctgaacggcccccaggaccacagccacctgctgtacagcaccatccccagaatgcaggagcccggccagatcgtggagacctacaccgaggaggaccccgagggcgccatgagcgtggtgagcgtggagaccagcgacgacggcaccaccagaagaaccgagaccaccgtgaagaaggtggtgaagaccgtgaccaccagaaccgtgcagcccgtggccatgggccccgacggcctgcccgtggacgccagcagcgtgagcaacaactacatccagaccctgggcagagacttcagaaagaacggcaacggcggccccggcccctacgtgggccaggccggcaccgccaccctgcccagaaacttccactacccccccgacggctacagcagacactacgaggacggctaccccggcggcagcgacaactacggcagcctgagcagagtgaccagaatcgaggagagatacagacccagcatggagggctacagagcccccagcagacaggacgtgtacggcccccagccccaggtgagagtgggcggcagcagcgtggacctgcacagattccaccccgagccctacggcctggaggacgaccagagaagcatgggctacgacgacctggactacggcatgatgagcgactacggcaccgccagaagaaccggcacccccagcgaccccagaagaagactgagaagctacgaggacatgatcggcgaggaggtgcccagcgaccagtactactgggcccccctggcccagcacgagagaggcagcctggccagcctggacagcctgagaaagggcggcccccccccccccaactggagacagcccgagctgcccgaggtgatcgccatgctgggcttcagactggacgccgtgaagagcaacgccgccgcctacctgcagcacctgtgctacagaaacgacaaggtgaagaccgacgtgagaaagctgaagggcatccccgtgctggtgggcctgctggaccaccccaagaaggaggtgcacctgggcgcctgcggcgccctgaagaacatcagcttcggcagagaccaggacaacaagatcgccatcaagaactgcgacggcgtgcccgccctggtgagactgctgagaaaggccagagacatggacctgaccgaggtgatcaccggcaccctgtggaacctgagcagccacgacagcatcaagatggagatcgtggaccacgccctgcacgccctgaccgacgaggtgatcatcccccacagcggctgggagagagagcccaacgaggactgcaagcccagacacatcgagtgggagagcgtgctgaccaacaccgccggctgcctgagaaacgtgagcagcgagagaagcgaggccagaagaaagctgagagagtgcgacggcctggtggacgccctgatcttcatcgtgcaggccgagatcggccagaaggacagcgacagcaagctggtggagaactgcgtgtgcctgctgagaaacctgagctaccaggtgcacagagagatcccccaggccgagagataccaggaggccgcccccaacgtggccaacaacaccggcccccacgccgccagctgcttcggcgccaagaagggcaagggcaagaagcccatcgaggaccccgccaacgacaccgtggacttccccaagagaaccagccccgccagaggctacgagctgctgttccagcccgaggtggtgagaatctacatcagcctgctgaaggagagcaagacccccgccatcctggaggccagcgccggcgccatccagaacctgtgcgccggcagatggacctacggcagatacatcagaagcgccctgagacaggagaaggccctgagcgccatcgccgacctgctgaccaacgagcacgagagagtggtgaaggccgccagcggcgccctgagaaacctggccgtggacgccagaaacaaggagctgatcggcaagcacgccatccccaacctggtgaagaacctgcccggcggccagcagaacagcagctggaacttcagcgaggacaccgtgatcagcatcctgaacaccatcaacgaggtgatcgccgagaacctggaggccgccaagaagctgagagagacccagggcatcgagaagctggtgctgatcaacaagagcggcaacagaagcgagaaggaggtgagagccgccgccctggtgctgcagaccatctggggctacaaggagctgagaaagcccctggagaaggagggctggaagaagagcgacttccaggtgaacctgaacaacgccagcagaagccagagcagccacagctacgacgacagcaccctgcccctgatcgacagaaaccagaagagcgacaagaagcccgacagagaggagatccagatgagcaacatgggcagcaacaccaagagcctggacaacaactacagcacccccaacgagagaggcgaccacaacagaaccctggacagaagcggcgacctgggcgacatggagcccctgaagggcaccacccccctgatgcagaagatctag

SEQ ID NO: 75687 - DNA, 2640 bp, Artificial Sequence; identical to SEQ ID NO: 75686
  Description of Artificial Sequence: Synthetic coding sequence

SEQ ID NO: 75688 - DNA, 2499 bp, Artificial Sequence; identical to SEQ ID NO: 75677
  Description of Artificial Sequence: Synthetic coding sequence

SEQ ID NO: 75689 - DNA, 390 bp, Artificial Sequence
  Description of Artificial Sequence: Synthetic coding sequence
atggccaacggcaccctgaccagaagacaccagaacggcagattcgtgggcgacgccgacctggagagacagaagttcagcgacctgaagctgaacggcccccaggaccacagccacctgctgtacagcaccatccccagaatgcaggagcccggccagatcgtggagacctacaccgaggaggaccccgagggcgccatgagcgtggtgagcgtggagaccagcgacgacggcaccaccagaagaaccgagaccaccgtgaagaaggtggtgaagaccgtgaccaccagaaccgtgcagcccgtggccatgggccccgacggcctgcccgtggacgccagcagcgtgagcaacaactacatccagaccctgggcagagacttcagatag

SEQ ID NO: 75690 - DNA, 2586 bp, Artificial Sequence
  Description of Artificial Sequence: Synthetic coding sequence
atgcaggagcccggccagatcgtggagacctacaccgaggaggaccccgagggcgccatgagcgtggtgagcgtggagaccagcgacgacggcaccaccagaagaaccgagaccaccgtgaagaaggtggtgaagaccgtgaccaccagaaccgtgcagcccgtggccatgggccccgacggcctgcccgtggacgccagcagcgtgagcaacaactacatccagaccctgggcagagacttcagaaagaacggcaacggcggccccggcccctacgtgggccaggccggcaccgccaccctgcccagaaacttccactacccccccgacggctacagcagacactacgaggacggctaccccggcggcagcgacaactacggcagcctgagcagagtgaccagaatcgaggagagatacagacccagcatggagggctacagagcccccagcagacaggacgtgtacggcccccagccccaggtgagagtgggcggcagcagcgtggacctgcacagattccaccccgagccctacggcctggaggacgaccagagaagcatgggctacgacgacctggactacggcatgatgagcgactacggcaccgccagaagaaccggcacccccagcgaccccagaagaagactgagaagctacgaggacatgatcggcgaggaggtgcccagcgaccagtactactgggcccccctggcccagcacgagagaggcagcctggccagcctggacagcctgagaaagggcggcccccccccccccaactggagacagcccgagctgcccgaggtgatcgccatgctgggcttcagactggacgccgtgaagagcaacgccgccgcctacctgcagcacctgtgctacagaaacgacaaggtgaagaccgacgtgagaaagctgaagggcatccccgtgctggtgggcctgctggaccaccccaagaaggaggtgcacctgggcgcctgcggcgccctgaagaacatcagcttcggcagagaccaggacaacaagatcgccatcaagaactgcgacggcgtgcccgccctggtgagactgctgagaaaggccagagacatggacctgaccgaggtgatcaccggcaccctgtggaacctgagcagccacgacagcatcaagatggagatcgtggaccacgccctgcacgccctgaccgacgaggtgatcatcccccacagcggctgggagagagagcccaacgaggactgcaagcccagacacatcgagtgggagagcgtgctgaccaacaccgccggctgcctgagaaacgtgagcagcgagagaagcgaggccagaagaaagctgagagagtgcgacggcctggtggacgccctgatcttcatcgtgcaggccgagatcggccagaaggacagcgacagcaagctggtggagaactgcgtgtgcctgctgagaaacctgagctaccaggtgcacagagagatcccccaggccgagagataccaggaggccgcccccaacgtggccaacaacaccggcccccacgccgccagctgcttcggcgccaagaagggcaagggcaagaagcccatcgaggaccccgccaacgacaccgtggacttccccaagagaaccagccccgccagaggctacgagctgctgttccagcccgaggtggtgagaatctacatcagcctgctgaaggagagcaagacccccgccatcctggaggccagcgccggcgccatccagaacctgtgcgccggcagatggacctacggcagatacatcagaagcgccctgagacaggagaaggccctgagcgccatcgccgacctgctgaccaacgagcacgagagagtggtgaaggccgccagcggcgccctgagaaacctggccgtggacgccagaaacaaggagctgatcggcaagcacgccatccccaacctggtgaagaacctgcccggcggccagcagaacagcagctggaacttcagcgaggacaccgtgatcagcatcctgaacaccatcaacgaggtgatcgccgagaacctggaggccgccaagaagctgagagagacccagggcatcgagaagctggtgctgatcaacaagagcggcaacagaagcgagaaggaggtgagagccgccgccctggtgctgcagaccatctggggctacaaggagctgagaaagcccctggagaaggagggctggaagaagagcgacttccaggtgaacctgaacaacgccagcagaagccagagcagccacagctacgacgacagcaccctgcccctgatcgacagaaaccagaagagcgacaagaagcccgacagagaggagatccagatgagcaacatgggcagcaacaccaagagcctggacaacaactacagcacccccaacgagagaggcgaccacaacagaaccctggacagaagcggcgacctgggcgacatggagcccctgaagggcaccacccccctgatgcaggacgagggccaggagagcctggaggaggagctggacgtgctggtgctggacgacgagggcggccaggtgagctaccccagcatgcagaagatctag

SEQ ID NO: 75691 - DNA, 2658 bp, Artificial Sequence
  Description of Artificial Sequence: Synthetic coding sequence
atggccaacggcaccctgaccagaagacaccagaacggcagattcgtgggcgacgccgacctggagagacagaagttcagcgacctgaagctgaacggcccccaggaccacagccacctgctgtacagcaccatccccagaatgcaggagcccggccagatcgtggagacctacaccgaggaggaccccgagggcgccatgagcgtggtgagcgtggagaccagcgacgacggcaccaccagaagaaccgagaccaccgtgaagaaggtggtgaagaccgtgaccaccagaaccgtgcagcccgtggccatgggccccgacggcctgcccgtggacgccagcagcgtgagcaacaactacatccagaccctgggcagagacttcagaaagaacggcaacggcggccccggcccctacgtgggccaggccggcaccgccaccctgcccagaaacttccactacccccccgacggctacagcagacactacgaggacggctaccccggcggcagcgacaactacggcagcctgagcagagtgaccagaatcgaggagagatacagacccagcatggagggctacagagcccccagcagacaggacgtgtacggcccccagccccaggtgagagtgggcggcagcagcgtggacctgcacagattccaccccgagccctacggcctggaggacgaccagagaagcatgggctacgacgacctggactacggcatgatgagcgactacggcaccgccagaagaaccggcacccccagcgaccccagaagaagactgagaagctacgaggacatgatcggcgaggaggtgcccagcgaccagtactactgggcccccctggcccagcacgagagaggcagcctggccagcctggacagcctgagaaagggcggcccccccccccccaactggagacagcccgagctgcccgaggtgatcgccatgctgggcttcagactggacgccgtgaagagcaacgccgccgcctacctgcagcacctgtgctacagaaacgacaaggtgaagaccgacgtgagaaagctgaagggcatccccgtgctggtgggcctgctggaccaccccaagaaggaggtgcacctgggcgcctgcggcgccctgaagaacatcagcttcggcagagaccaggacaacaagatcgccatcaagaactgcgacggcgtgcccgccctggtgagactgctgagaaaggccagagacatggacctgaccgaggtgatcaccggcaccctgtggaacctgagcagccacgacagcatcaagatggagatcgtggaccacgccctgcacgccctgaccgacgaggtgatcatcccccacagcggctgggagagagagcccaacgaggactgcaagcccagacacatcgagtgggagagcgtgctgaccaacaccgccggctgcctgagaaacgtgagcagcgagagaagcgaggccagaagaaagctgagagagtgcgacggcctggtggacgccctgatcttcatcgtgcaggccgagatcggccagaaggacagcgacagcaagctggtggagaactgcgtgtgcctgctgagaaacctgagctaccaggtgcacagagagatcccccaggccgagagataccaggaggccgcccccaacgtggccaacaacaccggcccccacgccgccagctgcttcggcgccaagaagggcaaggacgagtggttcagcagaggcaagaagcccatcgaggaccccgccaacgacaccgtggacttccccaagagaaccagccccgccagaggctacgagctgctgttccagcccgaggtggtgagaatctacatcagcctgctgaaggagagcaagacccccgccatcctggaggccagcgccggcgccatccagaacctgtgcgccggcagatggacctacggcagatacatcagaagcgccctgagacaggagaaggccctgagcgccatcgccgacctgctgaccaacgagcacgagagagtggtgaaggccgccagcggcgccctgagaaacctggccgtggacgccagaaacaaggagctgatcggcaagcacgccatccccaacctggtgaagaacctgcccggcggccagcagaacagcagctggaacttcagcgaggacaccgtgatcagcatcctgaacaccatcaacgaggtgatcgccgagaacctggaggccgccaagaagctgagagagacccagggcatcgagaagctggtgctgatcaacaagagcggcaacagaagcgagaaggaggtgagagccgccgccctggtgctgcagaccatctggggctacaaggagctgagaaagcccctggagaaggagggctggaagaagagcgacttccaggtgaacctgaacaacgccagcagaagccagagcagccacagctacgacgacagcaccctgcccctgatcgacagaaaccagaagagcgacaagaagcccgacagagaggagatccagatgagcaacatgggcagcaacaccaagagcctggacaacaactacagcacccccaacgagagaggcgaccacaacagaaccctggacagaagcggcgacctgggcgacatggagcccctgaagggcaccacccccctgatgcagaagatctag

SEQ ID NO: 75692 - DNA, 1920 bp, Artificial Sequence
  Description of Artificial Sequence: Synthetic coding sequence
atgatcggcgaggaggtgcccagcgaccagtactactgggcccccctggcccagcacgagagaggcagcctggccagcctggacagcctgagaaagggcggcccccccccccccaactggagacagcccgagctgcccgaggtgatcgccatgctgggcttcagactggacgccgtgaagagcaacgccgccgcctacctgcagcacctgtgctacagaaacgacaaggtgaagaccgacgtgagaaagctgaagggcatccccgtgctggtgggcctgctggaccaccccaagaaggaggtgcacctgggcgcctgcggcgccctgaagaacatcagcttcggcagagaccaggacaacaagatcgccatcaagaactgcgacggcgtgcccgccctggtgagactgctgagaaaggccagagacatggacctgaccgaggtgatcaccggcaccctgtggaacctgagcagccacgacagcatcaagatggagatcgtggaccacgccctgcacgccctgaccgacgaggtgatcatcccccacagcggctgggagagagagcccaacgaggactgcaagcccagacacatcgagtgggagagcgtgctgaccaacaccgccggctgcctgagaaacgtgagcagcgagagaagcgaggccagaagaaagctgagagagtgcgacggcctggtggacgccctgatcttcatcgtgcaggccgagatcggccagaaggacagcgacagcaagctggtggagaactgcgtgtgcctgctgagaaacctgagctaccaggtgcacagagagatcccccaggccgagagataccaggaggccgcccccaacgtggccaacaacaccggcccccacgccgccagctgcttcggcgccaagaagggcaagggcaagaagcccatcgaggaccccgccaacgacaccgtggacttccccaagagaaccagccccgccagaggctacgagctgctgttccagcccgaggtggtgagaatctacatcagcctgctgaaggagagcaagacccccgccatcctggaggccagcgccggcgccatccagaacctgtgcgccggcagatggacctacggcagatacatcagaagcgccctgagacaggagaaggccctgagcgccatcgccgacctgctgaccaacgagcacgagagagtggtgaaggccgccagcggcgccctgagaaacctggccgtggacgccagaaacaaggagctgatcggcaagcacgccatccccaacctggtgaagaacctgcccggcggccagcagaacagcagctggaacttcagcgaggacaccgtgatcagcatcctgaacaccatcaacgaggtgatcgccgagaacctggaggccgccaagaagctgagagagacccagggcatcgagaagctggtgctgatcaacaagagcggcaacagaagcgagaaggaggtgagagccgccgccctggtgctgcagaccatctggggctacaaggagctgagaaagcccctggagaaggagggctggaagaagagcgacttccaggtgaacctgaacaacgccagcagaagccagagcagccacagctacgacgacagcaccctgcccctgatcgacagaaaccagaagagcgacaagaagcccgacagagaggagatccagatgagcaacatgggcagcaacaccaagagcctggacaacaactacagcacccccaacgagagaggcgaccacaacagaaccctggacagaagcggcgacctgggcgacatggagcccctgaagggcaccacccccctgatgcaggacgagggccaggagagcctggaggaggagctggacgtgctggtgctggacgacgagggcggccaggtgagctaccccagcatgcagaagatctag

SEQ ID NO: 75693 - DNA, 2499 bp, Artificial Sequence; identical to SEQ ID NO: 75677
  Description of Artificial Sequence: Synthetic coding sequence

SEQ ID NO: 75694 - DNA, 2499 bp, Artificial Sequence; identical to SEQ ID NO: 75677
  Description of Artificial Sequence: Synthetic coding sequence

SEQ ID NO: 75695 - DNA, 2640 bp, Artificial Sequence; identical to SEQ ID NO: 75686
  Description of Artificial Sequence: Synthetic coding sequence

SEQ ID NO: 75696 - DNA, 2523 bp, Artificial Sequence
  Description of Artificial Sequence: Synthetic coding sequence
atgcaggagcccggccagatcgtggagacctacaccgaggaggaccccgagggcgccatgagcgtggtgagcgtggagaccagcgacgacggcaccaccagaagaaccgagaccaccgtgaagaaggtggtgaagaccgtgaccaccagaaccgtgcagcccgtggccatgggccccgacggcctgcccgtggacgccagcagcgtgagcaacaactacatccagaccctgggcagagacttcagaaagaacggcaacggcggccccggcccctacgtgggccaggccggcaccgccaccctgcccagaaacttccactacccccccgacggctacagcagacactacgaggacggctaccccggcggcagcgacaactacggcagcctgagcagagtgaccagaatcgaggagagatacagacccagcatggagggctacagagcccccagcagacaggacgtgtacggcccccagccccaggtgagagtgggcggcagcagcgtggacctgcacagattccaccccgagccctacggcctggaggacgaccagagaagcatgggctacgacgacctggactacggcatgatgagcgactacggcaccgccagaagaaccggcacccccagcgaccccagaagaagactgagaagctacgaggacatgatcggcgaggaggtgcccagcgaccagtactactgggcccccctggcccagcacgagagaggcagcctggccagcctggacagcctgagaaagggcggcccccccccccccaactggagacagcccgagctgcccgaggtgatcgccatgctgggcttcagactggacgccgtgaagagcaacgccgccgcctacctgcagcacctgtgctacagaaacgacaaggtgaagaccgacgtgagaaagctgaagggcatccccgtgctggtgggcctgctggaccaccccaagaaggaggtgcacctgggcgcctgcggcgccctgaagaacatcagcttcggcagagaccaggacaacaagatcgccatcaagaactgcgacggcgtgcccgccctggtgagactgctgagaaaggccagagacatggacctgaccgaggtgatcaccggcaccctgtggaacctgagcagccacgacagcatcaagatggagatcgtggaccacgccctgcacgccctgaccgacgaggtgatcatcccccacagcggctgggagagagagcccaacgaggactgcaagcccagacacatcgagtgggagagcgtgctgaccaacaccgccggctgcctgagaaacgtgagcagcgagagaagcgaggccagaagaaagctgagagagtgcgacggcctggtggacgccctgatcttcatcgtgcaggccgagatcggccagaaggacagcgacagcaagctggtggagaactgcgtgtgcctgctgagaaacctgagctaccaggtgcacagagagatcccccaggccgagagataccaggaggccgcccccaacgtggccaacaacaccggcccccacgccgccagctgcttcggcgccaagaagggcaagggcaagaagcccatcgaggaccccgccaacgacaccgtggacttccccaagagaaccagccccgccagaggctacgagctgctgttccagcccgaggtggtgagaatctacatcagcctgctgaaggagagcaagacccccgccatcctggaggccagcgccggcgccatccagaacctgtgcgccggcagatggacctacggcagatacatcagaagcgccctgagacaggagaaggccctgagcgccatcgccgacctgctgaccaacgagcacgagagagtggtgaaggccgccagcggcgccctgagaaacctggccgtggacgccagaaacaaggagctgatcggcaagcacgccatccccaacctggtgaagaacctgcccggcggccagcagaacagcagctggaacttcagcgaggacaccgtgatcagcatcctgaacaccatcaacgaggtgatcgccgagaacctggaggccgccaagaagctgagagagacccagggcatcgagaagctggtgctgatcaacaagagcggcaacagaagcgagaaggaggtgagagccgccgccctggtgctgcagaccatctggggctacaaggagctgagaaagcccctggagaaggagggctggaagaagagcgacttccaggtgaacctgaacaacgccagcagaagccagagcagccacagctacgacgacagcaccctgcccctgatcgacagaaaccagaagagcgacaacaactacagcacccccaacgagagaggcgaccacaacagaaccctggacagaagcggcgacctgggcgacatggagcccctgaagggcaccacccccctgatgcaggacgagggccaggagagcctggaggaggagctggacgtgctggtgctggacgacgagggcggccaggtgagctaccccagcatgcagaagatctag

SEQ ID NO: 75697 - DNA, 2745 bp, Artificial Sequence
  Description of Artificial Sequence: Synthetic coding sequence
atggccaacggcaccctgaccagaagacaccagaacggcagattcgtgggcgacgccgacctggagagacagaagttcagcgacctgaagctgaacggcccccaggaccacagccacctgctgtacagcaccatccccagaatgcaggagcccggccagatcgtggagacctacaccgaggaggaccccgagggcgccatgagcgtggtgagcgtggagaccagcgacgacggcaccaccagaagaaccgagaccaccgtgaagaaggtggtgaagaccgtgaccaccagaaccgtgcagcccgtggccatgggccccgacggcctgcccgtggacgccagcagcgtgagcaacaactacatccagaccctgggcagagacttcagaaagaacggcaacggcggccccggcccctacgtgggccaggccggcaccgccaccctgcccagaaacttccactacccccccgacggctacagcagacactacgaggacggctaccccggcggcagcgacaactacggcagcctgagcagagtgaccagaatcgaggagagatacagacccagcatggagggctacagagcccccagcagacaggacgtgtacggcccccagccccaggtgagagtgggcggcagcagcgtggacctgcacagattccaccccgagccctacggcctggaggacgaccagagaagcatgggctacgacgacctggactacggcatgatgagcgactacggcaccgccagaagaaccggcacccccagcgaccccagaagaagactgagaagctacgaggacatgatcggcgaggaggtgcccagcgaccagtactactgggcccccctggcccagcacgagagaggcagcctggccagcctggacagcctgagaaagggcggcccccccccccccaactggagacagcccgagctgcccgaggtgatcgccatgctgggcttcagactggacgccgtgaagagcaacgccgccgcctacctgcagcacctgtgctacagaaacgacaaggtgaagaccgacgtgagaaagctgaagggcatccccgtgctggtgggcctgctggaccaccccaagaaggaggtgcacctgggcgcctgcggcgccctgaagaacatcagcttcggcagagaccaggacaacaagatcgccatcaagaactgcgacggcgtgcccgccctggtgagactgctgagaaaggccagagacatggacctgaccgaggtgatcaccggcaccctgtggaacctgagcagccacgacagcatcaagatggagatcgtggaccacgccctgcacgccctgaccgacgaggtgatcatcccccacagcggctgggagagagagcccaacgaggactgcaagcccagacacatcgagtgggagagcgtgctgaccaacaccgccggctgcctgagaaacgtgagcagcgagagaagcgaggccagaagaaagctgagagagtgcgacggcctggtggacgccctgatcttcatcgtgcaggccgagatcggccagaaggacagcgacagcaagctggtggagaactgcgtgtgcctgctgagaaacctgagctaccaggtgcacagagagatcccccaggccgagagataccaggaggccgcccccaacgtggccaacaacaccggcccccacgccgccagctgcttcggcgccaagaagggcaaggacgagtggttcagcagaggcaagaagcccatcgaggaccccgccaacgacaccgtggacttccccaagagaaccagccccgccagaggctacgagctgctgttccagcccgaggtggtgagaatctacatcagcctgctgaaggagagcaagacccccgccatcctggaggccagcgccggcgccatccagaacctgtgcgccggcagatggacctacggcagatacatcagaagcgccctgagacaggagaaggccctgagcgccatcgccgacctgctgaccaacgagcacgagagagtggtgaaggccgccagcggcgccctgagaaacctggccgtggacgccagaaacaaggagctgatcggcaagcacgccatccccaacctggtgaagaacctgcccggcggccagcagaacagcagctggaacttcagcgaggacaccgtgatcagcatcctgaacaccatcaacgaggtgatcgccgagaacctggaggccgccaagaagctgagagagacccagggcatcgagaagctggtgctgatcaacaagagcggcaacagaagcgagaaggaggtgagagccgccgccctggtgctgcagaccatctggggctacaaggagctgagaaagcccctggagaaggagggctggaagaagagcgacttccaggtgaacctgaacaacgccagcagaagccagagcagccacagctacgacgacagcaccctgcccctgatcgacagaaaccagaagagcgacaagaagcccgacagagaggagatccagatgagcaacatgggcagcaacaccaagagcctggacaacaactacagcacccccaacgagagaggcgaccacaacagaaccctggacagaagcggcgacctgggcgacatggagcccctgaagggcaccacccccctgatgcaggacgagggccaggagagcctggaggaggagctggacgtgctggtgctggacgacgagggcggccaggtgagctaccccagcatgcagaagatctag

SEQ ID NO: 75698 - DNA, 381 bp, Artificial Sequence
  Description of Artificial Sequence: Synthetic coding sequence
atgatcggcgaggaggtgcccagcgaccagtactactgggcccccctggcccagcacgagagaggcagcctggccagcctggacagcctgagaaagggcggcccccccccccccaactggagacagcccgagctgcccgaggtgatcgccatgctgggcttcagactggacgccgtgaagagcaacgccgccgcctacctgcagcacctgtgctacagaaacgacaaggtgaagaccgacgtgagaaagctgaagggcatccccgtgctggtgggcctgctggaccaccccaagaaggaggtgcacctgggcgcctgcggcgccctgaagaacatcagcttcggcagagaccaggacaacaagatcgccatcaagaactag

SEQ ID NO: 75699 - DNA, 2640 bp, Artificial Sequence; identical to SEQ ID NO: 75686
  Description of Artificial Sequence: Synthetic coding sequence

SEQ ID NO: 75700 - DNA, 3678 bp, Artificial Sequence
  Description of Artificial Sequence: Synthetic coding sequence
atgttcgccagaaagccccccggcgccgcccccctgggcgccatgcccgtgcccgaccagcccagcagcgccagcgagaagaccagcagcctgagccccggcctgaacaccagcaacggcgacggcagcgagaccgagaccaccagcgccatcctggccagcgtgaaggagcaggagctgcagttcgagagactgaccagagagctggaggccgagagacagatcgtggccagccagctggagagatgcaagctgggcagcgagaccggcagcatgagcagcatgagcagcgccgaggagcagttccagtggcagagccaggacggccagaaggacatcgaggacgagctgaccaccggcctggagctggtggacagctgcatcagaagcctgcaggagagcggcatcctggacccccaggactacagcaccggcgagagacccagcctgctgagccagagcgccctgcagctgaacagcaagcccgagggcagcttccagtaccccgccagctaccacagcaaccagaccctggccctgggcgagaccacccccagccagctgcccgccagaggcacccaggccagagccaccggccagagcttcagccagggcaccaccagcagagccggccacctggccggccccgagcccgcccccccccccccccccccccccagagagcccttcgcccccagcctgggcagcgccttccacctgcccgacgccccccccgccgccgccgccgccgccctgtactacagcagcagcaccctgcccgccccccccagaggcggcagccccctggccgccccccagggcggcagccccaccaagctgcagagaggcggcagcgcccccgagggcgccacctacgccgcccccagaggcagcagccccaagcagagccccagcagactggccaagagctacagcaccagcagccccatcaacatcgtggtgagcagcgccggcctgagccccatcagagtgaccagcccccccaccgtgcagagcaccatcagcagcagccccatccaccagctgagcagcaccatcggcacctacgccaccctgagccccaccaagagactggtgcacgccagcgagcagtacagcaagcacagccaggagctgtacgccaccgccaccctgcagagacccggcagcctggccgccggcagcagagccagctacagcagccagcacggccacctgggccccgagctgagagccctgcagagccccgagcaccacatcgaccccatctacgaggacagagtgtaccagaagccccccatgagaagcctgagccagagccagggcgaccccctgccccccgcccacaccggcacctacagaaccagcaccgcccccagcagccccggcgtggacagcgtgcccctgcagagaaccggcagccagcacggcccccagaacgccgccgccgccaccttccagagagccagctacgccgccggccccgccagcaactacgccgacccctacagacagctgcagtactgccccagcgtggagagcccctacagcaagagcggccccgccctgccccccgagggcaccctggccagaagccccagcatcgacagcatccagaaggaccccagagagttcggctggagagaccccgagctgcccgaggtgatccagatgctgcagcaccagttccccagcgtgcagagcaacgccgccgcctacctgcagcacctgtgcttcggcgacaacaagatcaaggccgagatcagaagacagggcggcatccagctgctggtggacctgctggaccacagaatgaccgaggtgcacagaagcgcctgcggcgccctgagaaacctggtgtacggcaaggccaacgacgacaacaagatcgccctgaagaactgcggcggcatccccgccctggtgagactgctgagaaagaccaccgacctggagatcagagagctggtgaccggcgtgctgtggaacctgagcagctgcgacgccctgaagatgcccatcatccaggacgccctggccgtgctgaccaacgccgtgatcatcccccacagcggctgggagaacagccccctgcaggacgacagaaagatccagctgcacagcagccaggtgctgagaaacgccaccggctgcctgagaaacgtgagcagcgccggcgaggaggccagaagaagaatgagagagtgcgacggcctgaccgacgccctgctgtacgtgatccagagcgccctgggcagcagcgagatcgacagcaagaccgtggagaactgcgtgtgcatcctgagaaacctgagctacagactggccgccgagaccagccagggccagcacatgggcaccgacgagctggacggcctgctgtgcggcgaggccaacggcaaggacgccgagagcagcggctgctggggcaagaagaagaagaagaagaagagccaggaccagtgggacggcgtgggccccctgcccgactgcgccgagccccccaagggcatccagatgctgtggcaccccagcatcgtgaagccctacctgaccctgctgagcgagtgcagcaaccccgacaccctggagggcgccgccggcgccctgcagaacctggccgccggcagctggaagtggagcgtgtacatcagagccgccgtgagaaaggagaagggcctgcccatcctggtggagctgctgagaatcgacaacgacagagtggtgtgcgccgtggccaccgccctgagaaacatggccctggacgtgagaaacaaggagctgatcggcaagtacgccatgagagacctggtgcacagactgcccggcggcaacaacagcaacaacaccgccagcaaggccatgagcgacgacaccgtgaccgccgtgtgctgcaccctgcacgaggtgatcaccaagaacatggagaacgccaaggccctgagagacgccggcggcatcgagaagctggtgggcatcagcaagagcaagggcgacaagcacagccccaaggtggtgaaggccgccagccaggtgctgaacagcatgtggcagtacagagacctgagaagcctgtacaagaaggacggctggagccagtaccacttcgtggccagcagcagcaccatcgagagagacagacagagaccctacagcagcagcagaacccccagcatcagccccgtgagagtgagccccaacaacagaagcgccagcgcccccgccagccccagagagatgatcagcctgaaggagagaaagaccgactacgagtgcaccggcagcaacgccacctaccacggcgccaagggcgagcacaccagcagaaaggacgccatgaccgcccagaacaccggcatcagcaccctgtacagaaacagctacggcgcccccgccgaggacatcaagcacaaccaggtgagcgcccagcccgtgccccaggagcccagcagaaaggactacgagacctaccagcccttccagaacagcaccagaaactacgacgagagcttcttcgaggaccaggtgcaccacagaccccccgccagcgagtacaccatgcacctgggcctgaagagcaccggcaactacgtggacttctacagcgccgccagaccctacagcgagctgaactacgagaccagccactaccccgccagccccgacagctgggtgtag

SEQ ID NO: 75701 - DNA, 3504 bp, Artificial Sequence
  Description of Artificial Sequence: Synthetic coding sequence
atgttcgccagaaagccccccggcgccgcccccctgggcgccatgcccgtgcccgaccagcccagcagcgccagcgagaagaccagcagcctgagccccggcctgaacaccagcaacggcgacggcagcgagaccgagaccaccagcgccatcctggccagcgtgaaggagcaggagctgcagttcgagagactgaccagagagctggaggccgagagacagatcgtggccagccagctggagagatgcaagctgggcagcgagaccggcagcatgagcagcatgagcagcgccgaggagcagttccagtggcagagccaggacggccagaaggacatcgaggacgagctgaccaccggcctggagctggtggacagctgcatcagaagcctgcaggagagcggcatcctggacccccaggactacagcaccggcgagagacccagcctgctgagccagagcgccctgcagctgaacagcaagcccgagggcagcttccagtaccccgccagctaccacagcaaccagaccctggccctgggcgagaccacccccagccagctgcccgccagaggcacccaggccagagccaccggccagagcttcagccagggcaccaccagcagagccggccacctggccggccccgagcccgcccccccccccccccccccccccagagagcccttcgcccccagcctgggcagcgccttccacctgcccgacgccccccccgccgccgccgccgccgccctgtactacagcagcagcaccctgcccgccccccccagaggcggcagccccctggccgccccccagggcggcagccccaccaagctgcagagaggcggcagcgcccccgagggcgccacctacgccgcccccagaggcagcagccccaagcagagccccagcagactggccaagagctacagcaccagcagccccatcaacatcgtggtgagcagcgccggcctgagccccatcagagtgaccagcccccccaccgtgcagagcaccatcagcagcagccccatccaccagctgagcagcaccatcggcacctacgccaccctgagccccaccaagagactggtgcacgccagcgagcagtacagcaagcacagccaggagctgtacgccaccgccaccctgcagagacccggcagcctggccgccggcagcagagccagctacagcagccagcacggccacctgggccccgagctgagagccctgcagagccccgagcaccacatcgaccccatctacgaggacagagtgtaccagaagccccccatgagaagcctgagccagagccagggcgaccccctgccccccgcccacaccggcacctacagaaccagcaccgcccccagcagccccggcgtggacagcgtgcccctgcagagaaccggcagccagcacggcccccagaacgccgccgccgccaccttccagagagccagctacgccgccggccccgccagcaactacgccgacccctacagacagctgcagtactgccccagcgtggagagcccctacagcaagagcggccccgccctgccccccgagggcaccctggccagaagccccagcatcgacagcatccagaaggaccccagagagttcggctggagagaccccgagctgcccgaggtgatccagatgctgcagcaccagttccccagcgtgcagagcaacgccgccgcctacctgcagcacctgtgcttcggcgacaacaagatcaaggccgagatcagaagacagggcggcatccagctgctggtggacctgctggaccacagaatgaccgaggtgcacagaagcgcctgcggcgccctgagaaacctggtgtacggcaaggccaacgacgacaacaagatcgccctgaagaactgcggcggcatccccgccctggtgagactgctgagaaagaccaccgacctggagatcagagagctggtgaccggcgtgctgtggaacctgagcagctgcgacgccctgaagatgcccatcatccaggacgccctggccgtgctgaccaacgccgtgatcatcccccacagcggctgggagaacagccccctgcaggacgacagaaagatccagctgcacagcagccaggtgctgagaaacgccaccggctgcctgagaaacgtgagcagcgccggcgaggaggccagaagaagaatgagagagtgcgacggcctgaccgacgccctgctgtacgtgatccagagcgccctgggcagcagcgagatcgacagcaagaccgtggagaactgcgtgtgcatcctgagaaacctgagctacagactggccgccgagaccagccagggccagcacatgggcaccgacgagctggacggcctgctgtgcggcgaggccaacggcaaggacgccgagagcagcggctgctggggcaagaagaagaagaagaagaagagccaggaccagtggagcgtgtacatcagagccgccgtgagaaaggagaagggcctgcccatcctggtggagctgctgagaatcgacaacgacagagtggtgtgcgccgtggccaccgccctgagaaacatggccctggacgtgagaaacaaggagctgatcggcaagtacgccatgagagacctggtgcacagactgcccggcggcaacaacagcaacaacaccgccagcaaggccatgagcgacgacaccgtgaccgccgtgtgctgcaccctgcacgaggtgatcaccaagaacatggagaacgccaaggccctgagagacgccggcggcatcgagaagctggtgggcatcagcaagagcaagggcgacaagcacagccccaaggtggtgaaggccgccagccaggtgctgaacagcatgtggcagtacagagacctgagaagcctgtacaagaaggacggctggagccagtaccacttcgtggccagcagcagcaccatcgagagagacagacagagaccctacagcagcagcagaacccccagcatcagccccgtgagagtgagccccaacaacagaagcgccagcgcccccgccagccccagagagatgatcagcctgaaggagagaaagaccgactacgagtgcaccggcagcaacgccacctaccacggcgccaagggcgagcacaccagcagaaaggacgccatgaccgcccagaacaccggcatcagcaccctgtacagaaacagctacggcgcccccgccgaggacatcaagcacaaccaggtgagcgcccagcccgtgccccaggagcccagcagaaaggactacgagacctaccagcccttccagaacagcaccagaaactacgacgagagcttcttcgaggaccaggtgcaccacagaccccccgccagcgagtacaccatgcacctgggcctgaagagcaccggcaactacgtggacttctacagcgccgccagaccctacagcgagctgaactacgagaccagccactaccccgccagccccgacagctgggtgtag

SEQ ID NO: 75702 - DNA, 2379 bp, Artificial Sequence
  Description of Artificial Sequence: Synthetic coding sequence
atgagaagcctgagccagagccagggcgaccccctgccccccgcccacaccggcacctacagaaccagcaccgcccccagcagccccggcgtggacagcgtgcccctgcagagaaccggcagccagcacggcccccagaacgccgccgccgccaccttccagagagccagctacgccgccggccccgccagcaactacgccgacccctacagacagctgcagtactgccccagcgtggagagcccctacagcaagagcggccccgccctgccccccgagggcaccctggccagaagccccagcatcgacagcatccagaaggaccccagagagttcggctggagagaccccgagctgcccgaggtgatccagatgctgcagcaccagttccccagcgtgcagagcaacgccgccgcctacctgcagcacctgtgcttcggcgacaacaagatcaaggccgagatcagaagacagggcggcatccagctgctggtggacctgctggaccacagaatgaccgaggtgcacagaagcgcctgcggcgccctgagaaacctggtgtacggcaaggccaacgacgacaacaagatcgccctgaagaactgcggcggcatccccgccctggtgagactgctgagaaagaccaccgacctggagatcagagagctggtgaccggcgtgctgtggaacctgagcagctgcgacgccctgaagatgcccatcatccaggacgccctggccgtgctgaccaacgccgtgatcatcccccacagcggctgggagaacagccccctgcaggacgacagaaagatccagctgcacagcagccaggtgctgagaaacgccaccggctgcctgagaaacgtgagcagcgccggcgaggaggccagaagaagaatgagagagtgcgacggcctgaccgacgccctgctgtacgtgatccagagcgccctgggcagcagcgagatcgacagcaagaccgtggagaactgcgtgtgcatcctgagaaacctgagctacagactggccgccgagaccagccagggccagcacatgggcaccgacgagctggacggcctgctgtgcggcgaggccaacggcaaggacgccgagagcagcggctgctggggcaagaagaagaagaagaagaagagccaggaccagtgggacggcgtgggccccctgcccgactgcgccgagccccccaagggcatccagatgctgtggcaccccagcatcgtgaagccctacctgaccctgctgagcgagtgcagcaaccccgacaccctggagggcgccgccggcgccctgcagaacctggccgccggcagctggaagtggagcgtgtacatcagagccgccgtgagaaaggagaagggcctgcccatcctggtggagctgctgagaatcgacaacgacagagtggtgtgcgccgtggccaccgccctgagaaacatggccctggacgtgagaaacaaggagctgatcggcaagtacgccatgagagacctggtgcacagactgcccggcggcaacaacagcaacaacaccgccagcaaggccatgagcgacgacaccgtgaccgccgtgtgctgcaccctgcacgaggtgatcaccaagaacatggagaacgccaaggccctgagagacgccggcggcatcgagaagctggtgggcatcagcaagagcaagggcgacaagcacagccccaaggtggtgaaggccgccagccaggtgctgaacagcatgtggcagtacagagacctgagaagcctgtacaagaaggacggctggagccagtaccacttcgtggccagcagcagcaccatcgagagagacagacagagaccctacagcagcagcagaacccccagcatcagccccgtgagagtgagccccaacaacagaagcgccagcgcccccgccagccccagagagatgatcagcctgaaggagagaaagaccgactacgagtgcaccggcagcaacgccacctaccacggcgccaagggcgagcacaccagcagaaaggacgccatgaccgcccagaacaccggcatcagcaccctgtacagaaacagctacggcgcccccgccgaggacatcaagcacaaccaggtgagcgcccagcccgtgccccaggagcccagcagaaaggactacgagacctaccagcccttccagaacagcaccagaaactacgacgagagcttcttcgaggaccaggtgcaccacagaccccccgccagcgagtacaccatgcacctgggcctgaagagcaccggcaactacgtggacttctacagcgccgccagaccctacagcgagctgaactacgagaccagccactaccccgccagccccgacagctgggtgtag

SEQ ID NO: 75703 - DNA, 2667 bp, Artificial Sequence
  Description of Artificial Sequence: Synthetic coding sequence
atgagcagcatgagcagcgccgaggagcagttccagtggcagagccaggacggccagaaggacatcgaggacgagctgaccaccggcctggagctggtggacagctgcatcagaagcctgcaggagagcggcatcctggacccccaggactacagcaccggcgagaccggcagcagagccagctacagcagccagcacggccacctgggccccgagctgagagccctgcagagccccgagcaccacatcgaccccatctacgaggacagagtgtaccagaagccccccatgagaagcctgagccagagccagggcgaccccctgccccccgcccacaccggcacctacagaaccagcaccgcccccagcagccccggcgtggacagcgtgcccctgcagagaaccggcagccagcacggcccccagaacgccgccgccgccaccttccagagagccagctacgccgccggccccgccagcaactacgccgacccctacagacagctgcagtactgccccagcgtggagagcccctacagcaagagcggccccgccctgccccccgagggcaccctggccagaagccccagcatcgacagcatccagaaggaccccagagagttcggctggagagaccccgagctgcccgaggtgatccagatgctgcagcaccagttccccagcgtgcagagcaacgccgccgcctacctgcagcacctgtgcttcggcgacaacaagatcaaggccgagatcagaagacagggcggcatccagctgctggtggacctgctggaccacagaatgaccgaggtgcacagaagcgcctgcggcgccctgagaaacctggtgtacggcaaggccaacgacgacaacaagatcgccctgaagaactgcggcggcatccccgccctggtgagactgctgagaaagaccaccgacctggagatcagagagctggtgaccggcgtgctgtggaacctgagcagctgcgacgccctgaagatgcccatcatccaggacgccctggccgtgctgaccaacgccgtgatcatcccccacagcggctgggagaacagccccctgcaggacgacagaaagatccagctgcacagcagccaggtgctgagaaacgccaccggctgcctgagaaacgtgagcagcgccggcgaggaggccagaagaagaatgagagagtgcgacggcctgaccgacgccctgctgtacgtgatccagagcgccctgggcagcagcgagatcgacagcaagaccgtggagaactgcgtgtgcatcctgagaaacctgagctacagactggccgccgagaccagccagggccagcacatgggcaccgacgagctggacggcctgctgtgcggcgaggccaacggcaaggacgccgagagcagcggctgctggggcaagaagaagaagaagaagaagagccaggaccagtgggacggcgtgggccccctgcccgactgcgccgagccccccaagggcatccagatgctgtggcaccccagcatcgtgaagccctacctgaccctgctgagcgagtgcagcaaccccgacaccctggagggcgccgccggcgccctgcagaacctggccgccggcagctggaagtggagcgtgtacatcagagccgccgtgagaaaggagaagggcctgcccatcctggtggagctgctgagaatcgacaacgacagagtggtgtgcgccgtggccaccgccctgagaaacatggccctggacgtgagaaacaaggagctgatcggcaagtacgccatgagagacctggtgcacagactgcccggcggcaacaacagcaacaacaccgccagcaaggccatgagcgacgacaccgtgaccgccgtgtgctgcaccctgcacgaggtgatcaccaagaacatggagaacgccaaggccctgagagacgccggcggcatcgagaagctggtgggcatcagcaagagcaagggcgacaagcacagccccaaggtggtgaaggccgccagccaggtgctgaacagcatgtggcagtacagagacctgagaagcctgtacaagaaggacggctggagccagtaccacttcgtggccagcagcagcaccatcgagagagacagacagagaccctacagcagcagcagaacccccagcatcagccccgtgagagtgagccccaacaacagaagcgccagcgcccccgccagccccagagagatgatcagcctgaaggagagaaagaccgactacgagtgcaccggcagcaacgccacctaccacggcgccaagggcgagcacaccagcagaaaggacgccatgaccgcccagaacaccggcatcagcaccctgtacagaaacagctacggcgcccccgccgaggacatcaagcacaaccaggtgagcgcccagcccgtgccccaggagcccagcagaaaggactacgagacctaccagcccttccagaacagcaccagaaactacgacgagagcttcttcgaggaccaggtgcaccacagaccccccgccagcgagtacaccatgcacctgggcctgaagagcaccggcaactacgtggacttctacagcgccgccagaccctacagcgagctgaactacgagaccagccactaccccgccagccccgacagctgggtgtag

SEQ ID NO: 75704 - DNA, 546 bp, Artificial Sequence
  Description of Artificial Sequence: Synthetic coding sequence
atgagcagcatgagcagcgccgaggagcagttccagtggcagagccaggacggccagaaggacatcgaggacgagctgaccaccggcctggagctggtggacagctgcatcagaagcctgcaggagagcggcatcctggacccccaggactacagcaccggcgagagacccagcctgctgagccagagcgccctgcagctgaacagcaagcccgagggcagcttccagtaccccgccagctaccacagcaaccagaccctggccctgggcgagaccacccccagccagctgcccgccagaggcacccaggccagagccaccggccagagcttcagccagggcaccaccagcagagccggccacctggccggccccgagcccgcccccccccccccccccccccccagagagcccttcgcccccagcctgggcagcgccttccacctgcccgacgccccccccgccgccgccgccgccgccctgtactacagcagcagcaccctgcccgccccccccagaggcggcagccccctggccgccccctag

SEQ ID NO: 75705 - DNA, 963 bp, Artificial Sequence
  Description of Artificial Sequence: Synthetic coding sequence
atgaccgtgtggtgcgccgtggccaccgccctgagaaacatggccctggacgtgagaaacaaggagctgatcggcaagtacgccatgagagacctggtgcacagactgcccggcggcaacaacagcaacaacaccgccagcaaggccatgagcgacgacaccgtgaccgccgtgtgctgcaccctgcacgaggtgatcaccaagaacatggagaacgccaaggccctgagagacgccggcggcatcgagaagctggtgggcatcagcaagagcaagggcgacaagcacagccccaaggtggtgaaggccgccagccaggtgctgaacagcatgtggcagtacagagacctgagaagcctgtacaagaaggacggctggagccagtaccacttcgtggccagcagcagcaccatcgagagagacagacagagaccctacagcagcagcagaacccccagcatcagccccgtgagagtgagccccaacaacagaagcgccagcgcccccgccagccccagagagatgatcagcctgaaggagagaaagaccgactacgagtgcaccggcagcaacgccacctaccacggcgccaagggcgagcacaccagcagaaaggacgccatgaccgcccagaacaccggcatcagcaccctgtacagaaacagctacggcgcccccgccgaggacatcaagcacaaccaggtgagcgcccagcccgtgccccaggagcccagcagaaaggactacgagacctaccagcccttccagaacagcaccagaaactacgacgagagcttcttcgaggaccaggtgcaccacagaccccccgccagcgagtacaccatgcacctgggcctgaagagcaccggcaactacgtggacttctacagcgccgccagaccctacagcgagctgaactacgagaccagccactaccccgccagccccgacagctgggtgtag

SEQ ID NO: 75706 - DNA, 246 bp, Artificial Sequence
  Description of Artificial Sequence: Synthetic coding sequence
atgaacagagagggcgcccccggcaagagccccgaggagatgtacatccagcagaaggtgagagtgctgctgatgctgagaaagatgggcagcaacctgaccgccagcgaggaggagttcctgagaacctacgccggcgtggtgaacagccagctgagccagctgcccccccacagcatcgaccagggcgccgaggacgtggtgatggccttcagcagaagcgagaccgaggacagaagacagtag

SEQ ID NO: 75707 - DNA, 246 bp, Artificial Sequence; identical to SEQ ID NO: 75706
  Description of Artificial Sequence: Synthetic coding sequence

SEQ ID NO: 75708 - DNA, 246 bp, Artificial Sequence; identical to SEQ ID NO: 75706
  Description of Artificial Sequence: Synthetic coding sequence

SEQ ID NO: 75709 - DNA, 246 bp, Artificial Sequence; identical to SEQ ID NO: 75706
  Description of Artificial Sequence: Synthetic coding sequence

SEQ ID NO: 75710 - DNA, 246 bp, Artificial Sequence; identical to SEQ ID NO: 75706
  Description of Artificial Sequence: Synthetic coding sequence

SEQ ID NO: 75711 - DNA, 1692 bp, Artificial Sequence
  Description of Artificial Sequence: Synthetic coding sequence
atggacgtgggcgagctgctgagctaccagcccaacagaggcaccaagagacccagagacgacgaggaggaggagcagaagatgagaagaaagcagaccggcaccagagagagaggcagatacagagaggaggagatgaccgtggtggaggaggccgacgacgacaagaagagactgctgcagatcatcgacagagacggcgaggaggaggaggaggaggaggagcccctggacgagagcagcgtgaagaagatgatcctgaccttcgagaagagaagctacaagaaccaggagctgagaatcaagttccccgacaaccccgagaagttcatggagagcgagctggacctgaacgacatcatccaggagatgcacgtggtggccaccatgcccgacctgtaccacctgctggtggagctgaacgccgtgcagagcctgctgggcctgctgggccacgacaacaccgacgtgagcatcgccgtggtggacctgctgcaggagctgaccgacatcgacaccctgcacgagagcgaggagggcgccgaggtgctgatcgacgccctggtggacggccaggtggtggccctgctggtgcagaacctggagagactggacgagagcgtgaaggaggaggccgacggcgtgcacaacaccctggccatcgtggagaacatggccgagttcagacccgagatgtgcaccgagggcgcccagcagggcctgctgcagtggctgctgaagagactgaaggccaagatgcccttcgacgccaacaagctgtactgcagcgaggtgctggccatcctgctgcaggacaacgacgagaacagagagctgctgggcgagctggacggcatcgacgtgctgctgcagcagctgagcgtgttcaagagacacaaccccagcaccgccgaggagcaggagatgatggagaacctgttcgacagcctgtgcagctgcctgatgctgagcagcaacagagagagattcctgaagggcgagggcctgcagctgatgaacctgatgctgagagagaagaagatcagcagaagcagcgccctgaaggtgctggaccacgccatgatcggccccgagggcaccgacaactgccacaagttcgtggacatcctgggcctgagaaccatcttccccctgttcatgaagagccccagaaagatcaagaaggtgggcaccaccgagaaggagcacgaggagcacgtgtgcagcatcctggccagcctgctgagaaacctgagaggccagcagagaaccagactgctgaacaagttcaccgagaacgacagcgagaaggtggacagactgatggagctgcacttcaagtacctgggcgccatgcaggtggccgacaagaagatcgagggcgagaagcacgacatggtgagaagaggcgagatcatcgacaacgacaccgaggaggagttctacctgagaagactggacgccggcctgttcgtgctgcagcacatctgctacatcatggccgagatctgcaacgccaacgtgccccagatcagacagagagtgcaccagatcctgaacatgagaggcagcagcatcaagatcgtgagacacatcatcaaggagtacgccgagaacatcggcgacggcagaagccccgagttcagagagaacgagcagaagagaatcctgggcctgctggagaacttctag

SEQ ID NO: 75712 - DNA, 1611 bp, Artificial Sequence
  Description of Artificial Sequence: Synthetic coding sequence
atgagaagaaagcagaccggcaccagagagagaggcagatacagagaggaggagatgaccgtggtggaggaggccgacgacgacaagaagagactgctgcagatcatcgacagagacggcgaggaggaggaggaggaggaggagcccctggacgagagcagcgtgaagaagatgatcctgaccttcgagaagagaagctacaagaaccaggagctgagaatcaagttccccgacaaccccgagaagttcatggagagcgagctggacctgaacgacatcatccaggagatgcacgtggtggccaccatgcccgacctgtaccacctgctggtggagctgaacgccgtgcagagcctgctgggcctgctgggccacgacaacaccgacgtgagcatcgccgtggtggacctgctgcaggagctgaccgacatcgacaccctgcacgagagcgaggagggcgccgaggtgctgatcgacgccctggtggacggccaggtggtggccctgctggtgcagaacctggagagactggacgagagcgtgaaggaggaggccgacggcgtgcacaacaccctggccatcgtggagaacatggccgagttcagacccgagatgtgcaccgagggcgcccagcagggcctgctgcagtggctgctgaagagactgaaggccaagatgcccttcgacgccaacaagctgtactgcagcgaggtgctggccatcctgctgcaggacaacgacgagaacagagagctgctgggcgagctggacggcatcgacgtgctgctgcagcagctgagcgtgttcaagagacacaaccccagcaccgccgaggagcaggagatgatggagaacctgttcgacagcctgtgcagctgcctgatgctgagcagcaacagagagagattcctgaagggcgagggcctgcagctgatgaacctgatgctgagagagaagaagatcagcagaagcagcgccctgaaggtgctggaccacgccatgatcggccccgagggcaccgacaactgccacaagttcgtggacatcctgggcctgagaaccatcttccccctgttcatgaagagccccagaaagatcaagaaggtgggcaccaccgagaaggagcacgaggagcacgtgtgcagcatcctggccagcctgctgagaaacctgagaggccagcagagaaccagactgctgaacaagttcaccgagaacgacagcgagaaggtggacagactgatggagctgcacttcaagtacctgggcgccatgcaggtggccgacaagaagatcgagggcgagaagcacgacatggtgagaagaggcgagatcatcgacaacgacaccgaggaggagttctacctgagaagactggacgccggcctgttcgtgctgcagcacatctgctacatcatggccgagatctgcaacgccaacgtgccccagatcagacagagagtgcaccagatcctgaacatgagaggcagcagcatcaagatcgtgagacacatcatcaaggagtacgccgagaacatcggcgacggcagaagccccgagttcagagagaacgagcagaagagaatcctgggcctgctggagaacttctag

SEQ ID NO: 75713 - DNA, 501 bp, Artificial Sequence
  Description of Artificial Sequence: Synthetic coding sequence
atgagaagaaagcagaccggcaccagagagagaggcagatacagagaggaggagatgaccgtggtggaggaggccgacgacgacaagaagagactgctgcagatcatcgacagagacggcgaggaggaggaggaggaggaggagcccctggacgagagcagcgtgaagaagatgatcctgaccttcgagaagagaagctacaagaaccaggagctgagaatcaagttccccgacaaccccgagaagttcatggagagcgagctggacctgaacgacatcatccaggagatgcacgtggtggccaccatgcccgacctgtaccacctgctggtggagctgaacgccgtgcagagcctgctgggcctgctgggccacgacaacaccgacgtgagcatcgccgtggtggacctgctgcaggagctgaccgacatcgacaccctgcacgagagcgaggagggcgccgaggtgctgatcgacgccctggtggacggccaggtgtag

SEQ ID NO: 75714 - DNA, 1443 bp, Artificial Sequence
  Description of Artificial Sequence: Synthetic coding sequence
atgatcagagccgcccccccccccctgttcctgctgctgctgctgctgctgctgctggtgagctgggccagcagaggcgaggccgcccccgaccaggacgagatccagagactgcccggcctggccaagcagcccagcttcagacagtacagcggctacctgaagggcagcggcagcaagcacctgcactactggttcgtggagagccagaaggaccccgagaacagccccgtggtgctgtggctgaacggcggccccggctgcagcagcctggacggcctgctgaccgagcacggccccttcctggtgcagcccgacggcgtgaccctggagtacaacccctacagctggaacctgatcgccaacgtgctgtacctggagagccccgccggcgtgggcttcagctacagcgacgacaagttctacgccaccaacgacaccgaggtggcccagagcaacttcgaggccctgcaggacttcttcagactgttccccgagtacaagaacaacaagctgttcctgaccggcgagagctacgccggcatctacatccccaccctggccgtgctggtgatgcaggaccccagcatgaacctgcagggcctggccgtgggcaacggcctgagcagctacgagcagaacgacaacagcctggtgtacttcgcctactaccacggcctgctgggcaacagactgtggagcagcctgcagacccactgctgcagccagaacaagtgcaacttctacgacaacaaggacctggagtgcgtgaccaacctgcaggaggtggccagaatcgtgggcaacagcggcctgaacatctacaacctgtacgccccctgcgccggcggcgtgcccagccacttcagatacgagaaggacaccgtggtggtgcaggacctgggcaacatcttcaccagactgcccctgaagagaatgtggcaccaggccctgctgagaagcggcgacaaggtgagaatggaccccccctgcaccaacaccaccgccgccagcacctacctgaacaacccctacgtgagaaaggccctgaacatccccgagcagctgccccagtgggacatgtgcaacttcctggtgaacctgcagtacagaagactgtacagaagcatgaacagccagtacctgaagctgctgagcagccagaagtaccagatcctgctgtacaacggcgacgtggacatggcctgcaacttcatgggcgacgagtggttcgtggacagcctgaaccagaagatggaggtgcagagaagaccctggctggtgaagtacggcgacagcggcgagcagatcgccggcttcgtgaaggagttcagccacatcgccttcctgaccatcaagggcgccggccacatggtgcccaccgacaagcccctggccgccttcaccatgttcagcagattcctgaacaagcagccctactag

SEQ ID NO: 75715 - DNA, 1446 bp, Artificial Sequence
  Description of Artificial Sequence: Synthetic coding sequence
atgaccagcagccccagagccccccccggcgagcagggcagaggcggcgccgagatgatcagagccgcccccccccccctgttcctgctgctgctgctgctgctgctgctggtgagctgggccagcagaggcgaggccgcccccgaccaggacgagatccagagactgcccggcctggccaagcagcccagcttcagacagtacagcggctacctgaagggcagcggcagcaagcacctgcactactggttcgtggagagccagaaggaccccgagaacagccccgtggtgctgtggctgaacggcggccccggctgcagcagcctggacggcctgctgaccgagcacggccccttcctgatcgccaacgtgctgtacctggagagccccgccggcgtgggcttcagctacagcgacgacaagttctacgccaccaacgacaccgaggtggcccagagcaacttcgaggccctgcaggacttcttcagactgttccccgagtacaagaacaacaagctgttcctgaccggcgagagctacgccggcatctacatccccaccctggccgtgctggtgatgcaggaccccagcatgaacctgcagggcctggccgtgggcaacggcctgagcagctacgagcagaacgacaacagcctggtgtacttcgcctactaccacggcctgctgggcaacagactgtggagcagcctgcagacccactgctgcagccagaacaagtgcaacttctacgacaacaaggacctggagtgcgtgaccaacctgcaggaggtggccagaatcgtgggcaacagcggcctgaacatctacaacctgtacgccccctgcgccggcggcgtgcccagccacttcagatacgagaaggacaccgtggtggtgcaggacctgggcaacatcttcaccagactgcccctgaagagaatgtggcaccaggccctgctgagaagcggcgacaaggtgagaatggaccccccctgcaccaacaccaccgccgccagcacctacctgaacaacccctacgtgagaaaggccctgaacatccccgagcagctgccccagtgggacatgtgcaacttcctggtgaacctgcagtacagaagactgtacagaagcatgaacagccagtacctgaagctgctgagcagccagaagtaccagatcctgctgtacaacggcgacgtggacatggcctgcaacttcatgggcgacgagtggttcgtggacagcctgaaccagaagatggaggtgcagagaagaccctggctggtgaagtacggcgacagcggcgagcagatcgccggcttcgtgaaggagttcagccacatcgccttcctgaccatcaagggcgccggccacatggtgcccaccgacaagcccctggccgccttcaccatgttcagcagattcctgaacaagcagccctactag

SEQ ID NO: 75716 - DNA, 870 bp, Artificial Sequence
  Description of Artificial Sequence: Synthetic coding sequence
atgatcagagccgcccccccccccctgttcctgctgctgctgctgctgctgctgctggtgagctgggccagcagaggcgaggccgcccccgaccaggacgagatccagagactgcccggcctggccaagcagcccagcttcagacagtacagcggctacctgaagggcagcggcagcaagcacctgcactactggttcgtggagagccagaaggaccccgagaacagccccgtggtgctgtggctgaacggcggccccggctgcagcagcctggacggcctgctgaccgagcacggccccttcctggtgcagcccgacggcgtgaccctggagtacaacccctacagctggaacctgatcgccaacgtgctgtacctggagagccccgccggcgtgggcttcagctacagcgacgacaagttctacgccaccaacgacaccgaggtggcccagagcaacttcgaggccctgcaggacttcttcagactgttccccgagtacaagaacaacaagctgttcctgaccggcgagagctacgccggcatctacatccccaccctggccgtgctggtgatgcaggaccccagcatgaacctgcagggcctggccgtgggcaacggcctgagcagctacgagcagaacgacaacagcctggtgtacttcgcctactaccacggcctgctgggcaacagactgtggagcagcctgcagacccactgctgcagccagaacaagtgcaacttctacgacaacaaggacctggagtgcgtgaccaacctgcaggaggtggccagaatcgtgggcaacagcggcctgaacatctacaacctgtacgccccctgcgccggcggcgtgcccagccacttctag

SEQ ID NO: 75717 - DNA, 1497 bp, Artificial Sequence
  Description of Artificial Sequence: Synthetic coding sequence
atgaccagcagccccagagccccccccggcgagcagggcagaggcggcgccgagatgatcagagccgcccccccccccctgttcctgctgctgctgctgctgctgctgctggtgagctgggccagcagaggcgaggccgcccccgaccaggacgagatccagagactgcccggcctggccaagcagcccagcttcagacagtacagcggctacctgaagggcagcggcagcaagcacctgcactactggttcgtggagagccagaaggaccccgagaacagccccgtggtgctgtggctgaacggcggccccggctgcagcagcctggacggcctgctgaccgagcacggccccttcctggtgcagcccgacggcgtgaccctggagtacaacccctacagctggaacctgatcgccaacgtgctgtacctggagagccccgccggcgtgggcttcagctacagcgacgacaagttctacgccaccaacgacaccgaggtggcccagagcaacttcgaggccctgcaggacttcttcagactgttccccgagtacaagaacaacaagctgttcctgaccggcgagagctacgccggcatctacatccccaccctggccgtgctggtgatgcaggaccccagcatgaacctgcagggcctggccgtgggcaacggcctgagcagctacgagcagaacgacaacagcctggtgtacttcgcctactaccacggcctgctgggcaacagactgtggagcagcctgcagacccactgctgcagccagaacaagtgcaacttctacgacaacaaggacctggagtgcgtgaccaacctgcaggaggtggccagaatcgtgggcaacagcggcctgaacatctacaacctgtacgccccctgcgccggcggcgtgcccagccacttcagatacgagaaggacaccgtggtggtgcaggacctgggcaacatcttcaccagactgcccctgaagagaatgtggcaccaggccctgctgagaagcggcgacaaggtgagaatggaccccccctgcaccaacaccaccgccgccagcacctacctgaacaacccctacgtgagaaaggccctgaacatccccgagcagctgccccagtgggacatgtgcaacttcctggtgaacctgcagtacagaagactgtacagaagcatgaacagccagtacctgaagctgctgagcagccagaagtaccagatcctgctgtacaacggcgacgtggacatggcctgcaacttcatgggcgacgagtggttcgtggacagcctgaaccagaagatggaggtgcagagaagaccctggctggtgaagtacggcgacagcggcgagcagatcgccggcttcgtgaaggagttcagccacatcgccttcctgaccatcaagggcgccggccacatggtgcccaccgacaagcccctggccgccttcaccatgttcagcagattcctgaacaagcagccctactag

SEQ ID NO: 75718 - DNA, 1038 bp, Artificial Sequence
  Description of Artificial Sequence: Synthetic coding sequence
atgatcagagccgcccccccccccctgttcctgctgctgctgctgctgctgctgctggtgagctgggccagcagaggcgaggccgcccccgaccaggacgagatccagagactgcccggcctggccaagcagcccagcttcagacagtacagcggctacctgaagggcagcggcagcaagcacctgcactactggttcgtggagagccagaaggaccccgagaacagccccgtggtgctgtggctgaacggcggccccggctgcagcagcctggacggcctgctgaccgagcacggccccttcctgatcgccaacgtgctgtacctggagagccccgccggcgtgggcttcagctacagcgacgacaagttctacgccaccaacgacaccgaggtggcccagagcaacttcgaggccctgcaggacttcttcagactgttccccgagtacaagaacaacaagctgttcctgaccggcgagagctacgccggcatctacatccccaccctggccgtgctggtgatgcaggaccccagcatgaacctgcagggcctggccgtgggcaacggcctgagcagctacgagcagaacgacaacagcctggtgtacttcgcctactaccacggcctgctgggcaacagactgtggagcagcctgcagacccactgctgcagccagaacaagtgcaacttctacgacaacaaggacctggagtgcgtgaccaacctgcaggaggtggccagaatcgtgggcaacagcggcctgaacatctacaacctgtacgccccctgcgccggcggcgtgcccagccacttcagatacgagaaggacaccgtggtggtgcaggacctgggcaacatcttcaccagactgcccctgaagagaatgtggcaccaggccctgctgagaagcggcgacaaggtgagaatggaccccccctgcaccaacaccaccgccgccagcacctacctgaacaacccctacgtgagaaaggccctgaacatccccgagcagctgccccagtgggacatgtgctag

SEQ ID NO: 75719 - DNA, 1149 bp, Artificial Sequence
  Description of Artificial Sequence: Synthetic coding sequence
atgatgttccccggcctgctggccccccccgccggctaccccagcctgctgagacccacccccaccctgaccctgccccagagcctgcagagcgccttcagcggccacagcagcttcctggtggaggacctgatcagaatcagcagaccccccgcctacctgcccagaagcgtgcccaccgccagcatgagcccccccagacagggcgcccccaccgccctgaccgacaccggcgccagcgacctgggcagccccggccccggcagcagaagaggcggcagcccccccaccgccttcagccccgccagcgagaccaccttcctgaagttcggcgtgaacgccatcctgagcagcggccccagaaccgagaccagccccgccctgctgcagagcgtgccccccaagaccttcgccttcccctacttcgagggcagcttccagcccttcatcagaagcagctacttccccgccagcagcagcgtggtgcccatccccggcaccttcagctggcccctggccgccagaggcaagcccagaagaggcatgctgagaagagccgtgttcagcgacgtgcagagaaaggccctggagaagatgttccagaagcagaagtacatcagcaagcccgacagaaagaagctggccgccaagctgggcctgaaggacagccaggacaccgccagaagaaccgagcccgcccccgacagcacccccagacccagagccagccccggcgcccccgacctgaccagcgccagccccttcttcagccccgccggcaccttccaggtgaagatctggttccagaacagaagaatgaagtggagaaacagcaaggagagagagctgctgagcagcggcggctgcagagagcagaccctgcccaccaagctgaacccccaccccgacctgagcgacgtgggccagaagggccccggcaacgaggaggaggaggagggccccggcagccccagccacagactggcctaccacgccagcagcgacccccagcacctgagagaccccagactgcccggccccctgccccccagccccgcccacagcagcagccccggcaagcccagcgacttcagcgacagcgaggaggaggaggagggcgaggagcaggaggagatcaccgtgagctag

SEQ ID NO: 75720 - DNA, 1341 bp, Artificial Sequence
  Description of Artificial Sequence: Synthetic coding sequence
atgggcgccggccccagctgcgacacccccgccaactgcacctacctggacctgctgggcacctgggtgttccaggtgggcagcagcggcagccagagagacgtgaactgcagcgtgatgggcccccaggagaagaaggtggtggtgtacctgcagaagctggacaccgcctacgacgacctgggcaacagcggccacttcaccatcatctacaaccagggcttcgagatcgtgctgaacgactacaagtggttcgccttcttcaagtacaaggaggagggcagcaaggtgaccacctactgcaacgagaccatgaccggctgggtgcacgacgtgctgggcagaaactgggcctgcttcaccggcaagaaggtgggcaccgccagcgagaacgtgtacgtgaacatcgcccacctgaagaacagccaggagaagtacagcaacagactgtacaagtacgaccacaacttcgtgaaggccatcaacgccatccagaagagctggaccgccaccacctacatggagtacgagaccctgaccctgggcgacatgatcagaagaagcggcggccacagcagaaagatccccagacccaagcccgcccccctgaccgccgagatccagcagaagatcctgcacctgcccaccagctgggactggagaaacgtgcacggcatcaacttcgtgagccccgtgagaaaccaggccagctgcggcagctgctacagcttcgccagcatgggcatgctggaggccagaatcagaatcctgaccaacaacagccagacccccatcctgagcccccaggaggtggtgagctgcagccagtacgcccagggctgcgagggcggcttcccctacctgatcgccggcaagtacgcccaggacttcggcctggtggaggaggcctgcttcccctacaccggcaccgacagcccctgcaagatgaaggaggactgcttcagatactacagcagcgagtaccactacgtgggcggcttctacggcggctgcaacgaggccctgatgaagctggagctggtgcaccacggccccatggccgtggccttcgaggtgtacgacgacttcctgcactacaagaagggcatctaccaccacaccggcctgagagaccccttcaaccccttcgagctgaccaaccacgccgtgctgctggtgggctacggcaccgacagcgccagcggcatggactactggatcgtgaagaacagctggggcaccggctggggcgagaacggctacttcagaatcagaagaggcaccgacgagtgcgccatcgagagcatcgccgtggccgccacccccatccccaagctgtag

SEQ ID NO: 75721 - DNA, 414 bp, Artificial Sequence
  Description of Artificial Sequence: Synthetic coding sequence
atgggcgccggccccagcctgctgctggccgccctgctgctgctgctgagcggcgacggcgccgtgagatgcgacacccccgccaactgcacctacctggacctgctgggcacctgggtgttccaggtgggcagcagcggcagccagagagacgtgaactgcagcgtgatgggcccccaggagaagaaggtggtggtgtacctgcagaagctggacaccgcctacgacgacctgggcaacagcggccacttcaccatcatctacaaccagggcttcgagatcgtgctgaacgactacaagtggttcgccttcttcaaggacgtgaccgacttcatcagccacctgttcatgcagctgggcaccgtgggcatctacgacctgccccacctgagaaacaagctggtgatcaagtag

SEQ ID NO: 75722 - DNA, 426 bp, Artificial Sequence
  Description of Artificial Sequence: Synthetic coding sequence
atgggcgccggccccagcctgctgctggccgccctgctgctgctgctgagcggcgacggcgccgtgagatgcgacacccccgccaactgcacctacctggacctgctgggcacctgggtgttccaggtgggcagcagcggcagccagagagacgtgaactgcagcgtgatgggcccccaggagaagaaggtggtggtgtacctgcagaagctggacaccgcctacgacgacctgggcaacagcggccacttcaccatcatctacaaccagggcttcgagatcgtgctgaacgactacaagtggttcgccttcttcaaggacgtgaccgacttcatcagccacctgttcatgcagctgggcaccgtgggcatctacgacctgccccacctgagaaacaagctggccatgaacagaagatggggctag

SEQ ID NO: 75723 - DNA, 1191 bp, Artificial Sequence
  Description of Artificial Sequence: Synthetic coding sequence
atgaagaccctgctgctgctgctgctggtgctgctggagctgggcgaggcccagggcagcctgcacagagtgcccctgagaagacaccccagcctgaagaagaagctgagagccagaagccagctgagcgagttctggaagagccacaacctggacatgatccagttcaccgagagctgcagcatggaccagagcgccaaggagcccctgatcaactacctggacatggagtacttcggcaccatcagcatcggcagccccccccagaacttcaccgtgatcttcgacaccggcagcagcaacctgtgggtgcccagcgtgtactgcaccagccccgcctgcaagacccacagcagattccagcccagccagagcagcacctacagccagcccggccagagcttcagcatccagtacggcaccggcagcctgagcggcatcatcggcgccgaccaggtgagcgtggagggcctgaccgtggtgggccagcagttcggcgagagcgtgaccgagcccggccagaccttcgtggacgccgagttcgacggcatcctgggcctgggctaccccagcctggccgtgggcggcgtgacccccgtgttcgacaacatgatggcccagaacctggtggacctgcccatgttcagcgtgtacatgagcagcaaccccgagggcggcgccggcagcgagctgatcttcggcggctacgaccacagccacttcagcggcagcctgaactgggtgcccgtgaccaagcaggcctactggcagatcgccctggacaacatccaggtgggcggcaccgtgatgttctgcagcgagggctgccaggccatcgtggacaccggcaccagcctgatcaccggccccagcgacaagatcaagcagctgcagaacgccatcggcgccgcccccgtggacggcgagtacgccgtggagtgcgccaacctgaacgtgatgcccgacgtgaccttcaccatcaacggcgtgccctacaccctgagccccaccgcctacaccctgctggacttcgtggacggcatgcagttctgcagcagcggcttccagggcctggacatccacccccccgccggccccctgtggatcctgggcgacgtgttcatcagacagttctacagcgtgttcgacagaggcaacaacagagtgggcctggcccccgccgtgccctag

SEQ ID NO: 75724 - DNA, 1092 bp, Artificial Sequence
  Description of Artificial Sequence: Synthetic coding sequence
atgaagaccctgctgctgctgctgctggtgctgctggagctgggcgaggcccagggcagcctgcacagagtgcccctgagaagacaccccagcctgaagaagaagctgagagccagaagccagctgagcgagttctggaagagccacaacctggacatgatccagttcaccgagagctgcagcatggaccagagcgccaaggagcccctgatcaactacctggacatggagtacttcggcaccatcagcatcggcagccccccccagaacttcaccgtgatcttcgacaccggcagcagcaacctgtgggtgcccagcgtgtactgcaccagccccgcctgcaagacccacagcagattccagcccagccagagcagcacctacagccagcccggccagagcttcagcatccagtacggcaccggcagcctgagcggcatcatcggcgccgaccaggtgagcgtggagggcctgaccgtggtgggccagcagttcggcgagagcgtgaccgagcccggccagaccttcgtggacgccgagttcgacggcatcctgggcctgggctaccccagcctggccgtgggcggcgtgacccccgtgttcgacaacatgatggcccagaacctggtggacctgcccatgttcagcgtgtacatgagcagcaaccccgagggcggcgccggcagcgagctgatcttcggcggctacgaccacagccacttcagcggcagcctgaactgggtgcccgtgaccaagcaggcctactggcagatcgccctggacaacatgctgtggagcgtgcccaccctgaccagctgcagaatgagccccagccccctgaccgagagccccatccccagcgcccagctgcccaccccctactggaccagctggatggagtgcagcagcgccgccgtggccttcaaggacctgaccagcaccctgcagctgggccccagcggcagctggggcatgagcagcttcgacagcttcacccagagcctgaccgtgggcatcaccgtgtgggactggccccagcagagccccaaggagggcccctgcgtgtgcgcctgcctgagcgacagaccctag

SEQ ID NO: 75725 - DNA, 1206 bp, Artificial Sequence
  Description of Artificial Sequence: Synthetic coding sequence
atgaagaccctgctgctgctgctgctggtgctgctggagctgggcgaggcccagggcagcctgcacagagtgcccctgagaagacaccccagcctgaagaagaagctgagagccagaagccagctgagcgagttctggaagagccacaacctggacatgatccagttcaccgagagctgcagcatggaccagagcgccaaggagcccctgatcaactacctggacatggagtacttcggcaccatcagcatcggcagccccccccagaacttcaccgtgatcttcgacaccggcagcagcaacctgtgggtgcccagcgtgtactgcaccagccccgcctgcaagacccacagcagattccagcccagccagagcagcacctacagccagcccggccagagcttcagcatccagtacggcaccggcagcctgagcggcatcatcggcgccgaccaggtgagcgccttcagctaccaggtggagggcctgaccgtggtgggccagcagttcggcgagagcgtgaccgagcccggccagaccttcgtggacgccgagttcgacggcatcctgggcctgggctaccccagcctggccgtgggcggcgtgacccccgtgttcgacaacatgatggcccagaacctggtggacctgcccatgttcagcgtgtacatgagcagcaaccccgagggcggcgccggcagcgagctgatcttcggcggctacgaccacagccacttcagcggcagcctgaactgggtgcccgtgaccaagcaggcctactggcagatcgccctggacaacatccaggtgggcggcaccgtgatgttctgcagcgagggctgccaggccatcgtggacaccggcaccagcctgatcaccggccccagcgacaagatcaagcagctgcagaacgccatcggcgccgcccccgtggacggcgagtacgccgtggagtgcgccaacctgaacgtgatgcccgacgtgaccttcaccatcaacggcgtgccctacaccctgagccccaccgcctacaccctgctggacttcgtggacggcatgcagttctgcagcagcggcttccagggcctggacatccacccccccgccggccccctgtggatcctgggcgacgtgttcatcagacagttctacagcgtgttcgacagaggcaacaacagagtgggcctggcccccgccgtgccctag

SEQ ID NO: 75726 - DNA, 867 bp, Artificial Sequence
  Description of Artificial Sequence: Synthetic coding sequence
atggagtacttcggcaccatcagcatcggcagccccccccagaacttcaccgtgatcttcgacaccggcagcagcaacctgtgggtgcccagcgtgtactgcaccagccccgcctgcaagacccacagcagattccagcccagccagagcagcacctacagccagcccggccagagcttcagcatccagtacggcaccggcagcctgagcggcatcatcggcgccgaccaggtgagcgtggagggcctgaccgtggtgggccagcagttcggcgagagcgtgaccgagcccggccagaccttcgtggacgccgagttcgacggcatcctgggcctgggctaccccagcctggccgtgggcggcgtgacccccgtgttcgacaacatgatggcccagaacctggtggacctgcccatgttcagcgtgtacatgagcagcaaccccgagggcggcgccggcagcgagctgatcttcggcggctacgaccacagccacttcagcggcagcctgaactgggtgcccgtgaccaagcaggcctactggcagatcgccctggacaacatgctgtggagcgtgcccaccctgaccagctgcagaatgagccccagccccctgaccgagagccccatccccagcgcccagctgcccaccccctactggaccagctggatggagtgcagcagcgccgccgtggccttcaaggacctgaccagcaccctgcagctgggccccagcggcagctggggcatgagcagcttcgacagcttcacccagagcctgaccgtgggcatcaccgtgtgggactggccccagcagagccccaaggagggcccctgcgtgtgcgcctgcctgagcgacagaccctag

SEQ ID NO: 75727 - DNA, 1455 bp, Artificial Sequence
  Description of Artificial Sequence: Synthetic coding sequence
atggccccctggctgcagctgctgagcctgctgggcctgctgcccggcgccgtggccgcccccgcccagcccagagccgccagcttccaggcctggggcccccccagccccgagctgctggcccccaccagattcgccctggagatgttcaacagaggcagagccgccggcaccagagccgtgctgggcctggtgagaggcagagtgagaagagccggccagggcagcctgtacagcctggaggccaccctggaggagcccccctgcaacgaccccatggtgtgcagactgcccgtgagcaagaagaccctgctgtgcagcttccaggtgctggacgagctgggcagacacgtgctgctgagaaaggactgcggccccgtggacaccaaggtgcccggcgccggcgagcccaagagcgccttcacccagggcagcgccatgatcagcagcctgagccagaaccaccccgacaacagaaacgagaccttcagcagcgtgatcagcctgctgaacgaggaccccctgagccaggacctgcccgtgaagatggccagcatcttcaagaacttcgtgatcacctacaacagaacctacgagagcaaggaggaggccagatggagactgagcgtgttcgtgaacaacatggtgagagcccagaagatccaggccctggacagaggcaccgcccagtacggcgtgaccaagttcagcgacctgaccgaggaggagttcagaaccatctacctgaacaccctgctgagaaaggagcccggcaacaagatgaagcaggccaagagcgtgggcgacctggccccccccgagtgggactggagaagcaagggcgccgtgaccaaggtgaaggaccagggcatgtgcggcagctgctgggccttcagcgtgaccggcaacgtggagggccagtggttcctgaaccagggcaccctgctgagcctgagcgagcaggagctgctggactgcgacaagatggacaaggcctgcatgggcggcctgcccagcaacgcctacagcgccatcaagaacctgggcggcctggagaccgaggacgactacagctaccagggccacatgcagagctgcaacttcagcgccgagaaggccaaggtgtacatcaacgacagcgtggagctgagccagaacgagcagaagctggccgcctggctggccaagagaggccccatcagcgtggccatcaacgccttcggcatgcagttctacagacacggcatcagcagacccctgagacccctgtgcagcccctggctgatcgaccacgccgtgctgctggtgggctacggcaacagaagcgacgtgcccttctgggccatcaagaacagctggggcaccgactggggcgagaagggctactactacctgcacagaggcagcggcgcctgcggcgtgaacaccatggccagcagcgccgtggtggactag

SEQ ID NO: 75728 - DNA, 675 bp, Artificial Sequence
  Description of Artificial Sequence: Synthetic coding sequence
atggccgccgccgtgccccagagagcctggaccgtggagcagctgagaagcgagcagctgcccaagaaggacatcatcaagttcctgcaggagcacggcagcgacagcttcctggccgagcacaagctgctgggcaacatcaagaacgtggccaagaccgccaacaaggaccacctggtgaccgcctacaaccacctgttcgagaccaagagattcaagggcaccgagagcatcagcaaggtgagcgagcaggtgaagaacgtgaagctgaacgaggacaagcccaaggagaccaagagcgaggagaccctggacgagggcccccccaagtacaccaagagcgtgctgaagaagggcgacaagaccaacttccccaagaagggcgacgtggtgcactgctggtacaccggcaccctgcaggacggcaccgtgttcgacaccaacatccagaccagcgccaagaagaagaagaacgccaagcccctgagcttcaaggtgggcgtgggcaaggtgatcagaggctgggacgaggccctgctgaccatgagcaagggcgagaaggccagactggagatcgagcccgagtgggcctacggcaagaagggccagcccgacgccaagatcccccccaacgccaagctgaccttcgaggtggagctggtggacatcgactag

SEQ ID NO: 75729 - DNA, 801 bp, Artificial Sequence
  Description of Artificial Sequence: Synthetic coding sequence
atgagcagcgtgttcggcaagcccagagccggcagcggcccccagagcgcccccctggaggtgaacctggccatcctgggcagaagaggcgccggcaagagcgccctgaccgtgaagttcctgaccaagagattcatcagcgagtacgaccccaacctggaggacacctacagcagcgaggagaccgtggaccaccagcccgtgcacctgagagtgatggacaccgccgacctggacacccccagaaactgcgagagatacctgaactgggcccacgccttcctggtggtgtacagcgtggacagcagacagagcttcgacagcagcagcagctacctggagctgctggccctgcacgccaaggagacccagagaagcatccccgccctgctgctgggcaacaagctggacatggcccagtacagacaggtgaccaaggccgagggcgtggccctggccggcagattcggctgcctgttcttcgaggtgagcgcctgcctggacttcgagcacgtgcagcacgtgttccacgaggccgtgagagaggccagaagagagctggagaagagccccctgaccagacccctgttcatcagcgaggagagagccctgccccaccaggcccccctgaccgccagacacggcctggccagctgcaccttcaacaccctgagcaccatcaacctgaaggagatgcccaccgtggcccaggccaagctggtgaccgtgaagagcagcagagcccagagcaagagaaaggcccccaccctgaccctgctgaagggcttcaagatcttctag

SEQ ID NO: 75730 - DNA, 972 bp, Artificial Sequence
  Description of Artificial Sequence: Synthetic coding sequence
atgtgggccaccctgcccctgctgtgcgccgccgagctgtgcgtgaacagcctggagaagttccacttcaagagctggatgagcaagcacagaaagacctacagcaccgaggagtaccaccacagactgcagaccttcgccagcaactggagaaagatcaacgcccacaacaacggcaaccacaccttcaagatggccctgaaccagttcagcgacatgagcttcgccgagatcaagcacaagtacctgtggagcgagccccagaactgcagcgccaccaagagcaactacctgagaggcaccggcccctacccccccagcgtggactggagaaagaagggcaacttcgtgagccccgtgaagaaccagggcgcctgcggcagctgctggaccttcagcaccaccggcgccctggagagcgccatcgccatcgccaccggcaagatgctgagcctggccgagcagcagctggtggactgcgcccaggacttcaacaaccacggctgccagggcggcctgcccagccaggccttcgagtacatcctgtacaacaagggcatcatgggcgaggacacctacccctaccagggcaaggacggctactgcaagttccagcccggcaaggccatcggcttcgtgaaggacgtggccaacatcaccatctacgacgaggaggccatggtggaggccgtggccctgtacaaccccgtgagcttcgccttcgaggtgacccaggacttcatgatgtacagaaccggcatctacagcagcaccagctgccacaagacccccgacaaggtgaaccacgccgtgctggccgtgggctacggcgagaagaacggcatcccctactggatcgtgaagaacagctggggcccccagtggggcatgaacggctacttcctgatcgagagaggcaagaacatgtgcggcctggccgcctgcgccagctaccccatccccctggtgtag

SEQ ID NO: 75731 - DNA, 621 bp, Artificial Sequence
  Description of Artificial Sequence: Synthetic coding sequence
atgtgggccaccctgcccctgctgtgcgccggcgcctggctgctgggcgtgcccgtgtgcggcgccgccgagctgtgcgtgaacagcctggagaagttccacttcaagagctggatgagcaagcacagaaagacctacagcaccgaggagtaccaccacagactgcagaccttcgccagcaactggagaaagatcaacgcccacaacaacggcaaccacaccttcaagatggccctgaaccagttcagcgacatgagcttcgccgagatcaagcacaagtacctgtggagcgagccccagaactgcagcgccaccaagagcaactacctgagaggcaccggcccctacccccccagcgtggactggagaaagaagggcaacttcgtgagccccgtgaagaaccaggtgtgcctggccatcagcatcctgagcctgcagaacggccacacccccagacagtacaccagaaagaacaacagcaagggcccccagaaccaccacaagcacatccccgccagcgtgagcagcagacacctgagccccggcagacccagcctgccccagctgagagagatctgcgagggcaagagactgggcgaggccagcgtgaacctgggctag

SEQ ID NO: 75732 - DNA, 990 bp, Artificial Sequence
  Description of Artificial Sequence: Synthetic coding sequence
atgtggggcctgaaggtgctgctgctgcccgtggtgagcttcgccctgtaccccgaggagatcctggacacccactgggagctgtggaagaagacccacagaaagcagtacaacaacaaggtggacgagatcagcagaagactgatctgggagaagaacctgaagtacatcagcatccacaacctggaggccagcctgggcgtgcacacctacgagctggccatgaaccacctgggcgacatgaccagcgaggaggtggtgcagaagatgaccggcctgaaggtgcccctgagccacagcagaagcaacgacaccctgtacatccccgagtgggagggcagagcccccgacagcgtggactacagaaagaagggctacgtgacccccgtgaagaaccagggccagtgcggcagctgctgggccttcagcagcgtgggcgccctggagggccagctgaagaagaagaccggcaagctgctgaacctgagcccccagaacctggtggactgcgtgagcgagaacgacggctgcggcggcggctacatgaccaacgccttccagtacgtgcagaagaacagaggcatcgacagcgaggacgcctacccctacgtgggccaggaggagagctgcatgtacaaccccaccggcaaggccgccaagtgcagaggctacagagagatccccgagggcaacgagaaggccctgaagagagccgtggccagagtgggccccgtgagcgtggccatcgacgccagcctgaccagcttccagttctacagcaagggcgtgtactacgacgagagctgcaacagcgacaacctgaaccacgccgtgctggccgtgggctacggcatccagaagggcaacaagcactggatcatcaagaacagctggggcgagaactggggcaacaagggctacatcctgatggccagaaacaagaacaacgcctgcggcatcgccaacctggccagcttccccaagatgtag

SEQ ID NO: 75733 - DNA, 777 bp, Artificial Sequence
  Description of Artificial Sequence: Synthetic coding sequence
atgcacaaggagaacgaggagatctacaacgtgagcgagaacagaaagcactgccccatcttcccctgccccctgctgaccagaagcggcaaggtgcccgagttcagacacgagagagaggagagactggaggagatgatcagaagacagaacctggacggcaacctgagcttcgtgatgtggggcctgaaggtgctgctgctgcccgtggtgagcttcgccctgtaccccgaggagatcctggacacccactgggagctgtggaagaagacccacagaaagcagtacaacaacaaggtggacgagatcagcagaagactgatctgggagaagaacctgaagtacatcagcatccacaacctggaggccagcctgggcgtgcacacctacgagctggccatgaaccacctgggcgacatgaccagcgaggaggtggtgcagaagatgaccggcctgaaggtgcccctgagccacagcagaagcaacgacaccctgtacatccccgagtgggagggcagagcccccgacagcgtggactacagaaagaagggctacgtgacccccgtgaagaaccagggccagtgcggcagctgctgggccttcagcagcgtgggcgccctggagggccagctgaagaagaagaccggcaagctgctgaacctgagcccccagaacctggtggactgcgtgagcgagaacgacggctgcggcggcggctacatgaccaacgccttccagtacgtgcagaagaacagaggcatcgacagcgaggactag

SEQ ID NO: 75734 - DNA, 1005 bp, Artificial Sequence
  Description of Artificial Sequence: Synthetic coding sequence
atgaacctgagcctggtgctggccgccttctgcctgggcatcgccagcgccgtgcccaagttcgaccagaacctggacaccaagtggtaccagtggaaggccacccacagaagactgtacggcgccaacgaggagggctggagaagagccgtgtgggagaagaacatgaagatgatcgagctgcacaacggcgagtacagccagggcaagcacggcttcaccatggccatgaacgccttcggcgacatgaccaacgaggagttcagacagatgatgggctgcttcagaaaccagaagttcagaaagggcaaggtgttcagagagcccctgttcctggacctgcccaagagcgtggactggagaaagaagggctacgtgacccccgtgaagaaccagaagcagtgcggcagctgctgggccttcagcgccaccggcgccctggagggccagatgttcagaaagaccggcaagctggtgagcctgagcgagcagaacctggtggactgcagcagaccccagggcaaccagggctgcaacggcggcttcatggccagagccttccagtacgtgaaggagaacggcggcctggacagcgaggagagctacccctacgtggccgtggacgagatctgcaagtacagacccgagaacagcgtggccaacgacaccggcttcaccgtggtggcccccggcaaggagaaggccctgatgaaggccgtggccaccgtgggccccatcagcgtggccatggacgccggccacagcagcttccagttctacaagagcggcatctacttcgagcccgactgcagcagcaagaacctggaccacggcgtgctggtggtgggctacggcttcgagggcgccaacagcaacaacagcaagtactggctggtgaagaacagctggggccccgagtggggcagcaacggctacgtgaagatcgccaaggacaagaacaaccactgcggcatcgccaccgccgccagctaccccaacgtgtag

SEQ ID NO: 75735 - DNA, 1005 bp, Artificial Sequence; identical to SEQ ID NO: 75734
  Description of Artificial Sequence: Synthetic coding sequence

SEQ ID NO: 75736 - DNA, 996 bp, Artificial Sequence
  Description of Artificial Sequence: Synthetic coding sequence
atgaagagactggtgtgcgtgctgctggtgtgcagcagcgccgtggcccagctgcacaaggaccccaccctggaccaccactggcacctgtggaagaagacctacggcaagcagtacaaggagaagaacgaggaggccgtgagaagactgatctgggagaagaacctgaagttcgtgatgctgcacaacctggagcacagcatgggcatgcacagctacgacctgggcatgaaccacctgggcgacatgaccagcgaggaggtgatgagcctgatgagcagcctgagagtgcccagccagtggcagagaaacatcacctacaagagcaaccccaacagaatcctgcccgacagcgtggactggagagagaagggctgcgtgaccgaggtgaagtaccagggcagctgcggcgcctgctgggccttcagcgccgtgggcgccctggaggcccagctgaagctgaagaccggcaagctggtgagcctgagcgcccagaacctggtggactgcagcaccgagaagtacggcaacaagggctgcaacggcggcttcatgaccaccgccttccagtacatcatcgacaacaagggcatcgacagcgacgccagctacccctacaaggccatggaccagaagtgccagtacgacagcaagtacagagccgccacctgcagcaagtacaccgagctgccctacggcagagaggacgtgctgaaggaggccgtggccaacaagggccccgtgagcgtgggcgtggacgccagacaccccagcttcttcctgtacagaagcggcgtgtactacgagcccagctgcacccagaacgtgaaccacggcgtgctggtggtgggctacggcgacctgaacggcaaggagtactggctggtgaagaacagctggggccacaacttcggcgaggagggctacatcagaatggccagaaacaagggcaaccactgcggcatcgccagcttccccagctaccccgagatctag

SEQ ID NO: 75737 - DNA, 846 bp, Artificial Sequence
  Description of Artificial Sequence: Synthetic coding sequence
atgaagagactggtgtgcgtgctgctggtgtgcagcagcgccgtggcccagctgcacaaggaccccaccctggaccaccactggcacctgtggaagaagacctacggcaagcagtacaaggagaagaacgaggaggccgtgagaagactgatctgggagaagaacctgaagttcgtgatgctgcacaacctggagcacagcatgggcatgcacagctacgacctgggcatgaaccacctgggcgacatgggcagctgcggcgcctgctgggccttcagcgccgtgggcgccctggaggcccagctgaagctgaagaccggcaagctggtgagcctgagcgcccagaacctggtggactgcagcaccgagaagtacggcaacaagggctgcaacggcggcttcatgaccaccgccttccagtacatcatcgacaacaagggcatcgacagcgacgccagctacccctacaaggccatggaccagaagtgccagtacgacagcaagtacagagccgccacctgcagcaagtacaccgagctgccctacggcagagaggacgtgctgaaggaggccgtggccaacaagggccccgtgagcgtgggcgtggacgccagacaccccagcttcttcctgtacagaagcggcgtgtactacgagcccagctgcacccagaacgtgaaccacggcgtgctggtggtgggctacggcgacctgaacggcaaggagtactggctggtgaagaacagctggggccacaacttcggcgaggagggctacatcagaatggccagaaacaagggcaaccactgcggcatcgccagcttccccagctaccccgagatctag

SEQ ID NO: 75738 - DNA, 1131 bp, Artificial Sequence
  Description of Artificial Sequence: Synthetic coding sequence
atggccctgaccgcccaccccagctgcctgctggccctgctggtggccggcctggcccagggcatcagaggccccctgagagcccaggacctgggcccccagcccctggagctgaaggaggccttcaagctgttccagatccagttcaacagaagctacctgagccccgaggagcacgcccacagactggacatcttcgcccacaacctggcccaggcccagagactgcaggaggaggacctgggcaccgccgagttcggcgtgacccccttcagcgacctgaccgaggaggagttcggccagctgtacggctacagaagagccgccggcggcgtgcccagcatgggcagagagatcagaagcgaggagcccgaggagagcgtgcccttcagctgcgactggagaaaggtggccagcgccatcagccccatcaaggaccagaagaactgcaactgctgctgggccatggccgccgccggcaacatcgagaccctgtggagaatcagcttctgggacttcgtggacgtgagcgtgcaggagctgctggactgcggcagatgcggcgacggctgccacggcggcttcgtgtgggacgccttcatcaccgtgctgaacaacagcggcctggccagcgagaaggactaccccttccagggcaaggtgagagcccacagatgccaccccaagaagtaccagaaggtggcctggatccaggacttcatcatgctgcagaacaacgagcacagaatcgcccagtacctggccacctacggccccatcaccgtgaccatcaacatgaagcccctgcagctgtacagaaagggcgtgatcaaggccacccccaccacctgcgacccccagctggtggaccacagcgtgctgctggtgggcttcggcagcgtgaagagcgaggagggcatctgggccgagaccgtgagcagccagagccagccccagcccccccaccccaccccctactggatcctgaagaacagctggggcgcccagtggggcgagaagggctacttcagactgcacagaggcagcaacacctgcggcatcaccaagttccccctgaccgccagagtgcagaagcccgacatgaagcccagagtgagctgccccccctag

SEQ ID NO: 75739 - DNA, 2679 bp, Artificial Sequence
  Description of Artificial Sequence: Synthetic coding sequence
atgaccgaccccttctgcgtgggcggcagaagactgcccggcagcagcaagagcggccccggcaaggacggcagcagaaaggaggtgagactgcccatgctgcacgacccccccaagatgggcatgcccgtggtgagaggcggccagaccgtgcccggccaggcccccctgtgcttcgaccccggcagccccgccagcgacaagaccgagggcaagaagaagggcagacccaaggccgagaaccaggccctgagagacatccccctgagcctgatgaacgactggaaggacgagttcaaggcccacagcagagtgaagtgccccaacagcggctgctggctggagttccccagcatctacggcctgaagtaccactaccagagatgccagggcggcgccatcagcgacagactggccttcccctgccccttctgcgaggccgccttcaccagcaagacccagctggagaagcacagaatctggaaccacatggacagacccctgcccgccagcaagcccggccccatcagcagacccgtgaccatcagcagacccgtgggcgtgagcaagcccatcggcgtgagcaagcccgtgaccatcggcaagcccgtgggcgtgagcaagcccatcggcatcagcaagcccgtgagcgtgggcagacccatgcccgtgaccaaggccatccccgtgaccagacccgtgcccgtgaccaagcccgtgaccgtgagcagacccatgcccgtgaccaaggccatgcccgtgaccaagcccatcaccgtgaccaagagcgtgcccgtgaccaagcccgtgcccgtgaccaagcccatcaccgtgaccaagctggtgaccgtgaccaagcccgtgcccgtgaccaagcccgtgaccgtgagcagacccatcgtggtgagcaagcccgtgaccgtgagcagacccatcgccatcagcagacacacccccccctgcaagatggtgctgctgaccagaagcgagaacaaggcccccagagccaccggcagaaacagcggcaagaagagagccgccgacagcctggacacctgccccatcccccccaagcaggccagacccgagaacggcgagtacggccccagcagcatgggccagagcagcgccttccagctgagcgccgacaccagcagcggcagcctgagccccggcagcagacccagcggcggcatggaggccctgaaggccgccggccccgccagcccccccgaggaggaccccgagagaaccaagcacagaagaaagcagaagacccccaagaagttcaccggcgagcagcccagcatcagcggcaccttcggcctgaagggcctggtgaaggccgaggacaaggccagagtgcacagaagcaagaagcaggagggccccggccccgaggacgccagaaagaaggtgcccgccgcccccatcaccgtgagcaaggaggcccccgcccccgtggcccaccccgcccccggcggccccgaggagcagtggcagagagccatccacgagagaggcgaggccgtgtgccccacctgcaacgtggtgaccagaaagaccctggtgggcctgaagaagcacatggaggtgtgccagaagctgcaggacgccctgaagtgccagcactgcagaaagcagttcaagagcaaggccggcctgaactaccacaccatggccgagcacagcgccaagcccagcgacgccgaggccagcgagggcggcgagcaggaggagagagagagactgagaaaggtgctgaagcagatgggcagactgagatgcccccaggagggctgcggcgccgccttcagcagcctgatgggctaccagtaccaccagagaagatgcggcaagcccccctgcgaggtggacagccccagcttcccctgcacccactgcggcaagacctacagaagcaaggccggccacgactaccacgtgagaagcgagcacaccgcccccccccccgaggagcccaccgacaagagccccgaggccgaggaccccctgggcgtggagagaacccccagcggcagagtgagaagaaccagcgcccaggtggccgtgttccacctgcaggagatcgccgaggacgagctggccagagactggaccaagagaagaatgaaggacgacctggtgcccgagaccgccagactgaactacaccagacccggcctgcccaccctgaacccccagctgctggaggcctggaagaacgaggtgaaggagaagggccacgtgaactgccccaacgactgctgcgaggccatctacagcagcgtgagcggcctgaaggcccacctggccagctgcagcaagggcgcccacctggccggcaagtacagatgcctgctgtgccccaaggagttcagcagcgagagcggcgtgaagtaccacatcctgaagacccacgccgagaactggttcagaaccagcgccgaccccccccccaagcacagaagccaggacagcctggtgcccaagaaggagaagaagaagaacctggccggcggcaagaagagaggcagaaagcccaaggagagaacccccgaggagcccgtggccaagctgccccccagaagagacgactggccccccggctgcagagacaagggcgccagaggcagcaccggcagaaaggtgggcgtgagcaaggcccccgagaagtag

SEQ ID NO: 75740 - DNA, 2343 bp, Artificial Sequence
  Description of Artificial Sequence: Synthetic coding sequence
atggaccagaacagcgtgcccgagaaggcccagaacgaggccgacaccaacaacgccgacagattcttcagaagccacagcagccccccccaccacagacccggccacagcagagccctgcaccactacgagctgcaccaccacggcgtgccccaccagagaggcgagagccaccacccccccgagttccaggacttccacgaccaggccctgagcagccacgtgcaccagagccaccaccacagcgaggccagaaaccacggcagagcccacggccccaccggcttcggcctggcccccagccagggcgccgtgcccagccacagaagctacggcgaggactaccacgacgagctgcagagagacggcagaagacaccacgacggcagccagtacggcggcttccaccagcagagcgacagccactaccacagaggcagccaccacggcagaccccagtacctgggcgagaacctgagccactacagcagcggcgtgccccaccacggcgaggccagccaccacggcggcagctacctgccccacggccccaacccctacagcgagagcttccaccacagcgaggccagccacctgagcggcctgcagcacgacgagagccagcaccaccaggtgccccacagaggctggccccaccaccaccaggtgcaccaccacggcagaagcagacaccacgaggcccaccagcacggcaagagcccccaccacggcgagaccatcagcccccacagcagcgtgggcagctaccagagaggcatcagcgactaccacagcgagtaccaccagggcgaccaccaccccagcgagtaccaccacggcgaccacccccaccacacccagcaccactaccaccagacccacagacacagagactaccaccagcaccaggaccaccacggcgcctaccacagcagctacctgcacggcgactacgtgcagagcaccagccagctgagcatcccccacaccagcagaagcctgatccacgacgcccccggccccgccgccagcagaaccggcgtgttcccctaccacgtggcccaccccagaggcagcgcccacagcatgaccagaagcagcagcaccatcagaagcagagtgacccagatgagcaagaaggtgcacacccaggacatcagcaccaagcacagcgaggactggggcaaggaggagggccagttccagaagagaaagaccggcagactgcagagaaccagaaagaagggccacagcaccaacctgttccagtggctgtgggagaagctgaccttcctgatccagggcttcagagagatgatcagaaacctgacccagagcctggccttcgagaccttcatcttcttcgtggtgtgcctgaacaccgtgatgctggtggcccagaccttcgccgaggtggagatcagaggcgagtggtacttcatggccctggacagcatcttcttctgcatctacgtggtggaggccctgctgaagatcatcgccctgggcctgagctacttcttcgacttctggaacaacctggacttcttcatcatggccatggccgtgctggacttcctgctgatgcagacccacagcttcgccatctaccaccagagcctgttcagaatcctgaaggtgttcaagagcctgagagccctgagagccatcagagtgctgagaagactgagcttcctgaccagcgtgcaggaggtgaccggcaccctgggccagagcctgcccagcatcgccgccatcctgatcctgatgttcacctgcctgttcctgttcagcgccgtgctgagagccctgttcagaaagagcgaccccaagagattccagaacatcttcaccaccatcttcaccctgttcaccctgctgaccctggacgactggagcctgatctacatggacagcagagcccagggcgcctggtacatcatccccatcctggtgatctacatcatcatccagtacttcatcttcctgaacctggtgatcaccgtgctggtggacagcttccagaccgccctgttcaagggcctggagaaggccaagcaggagagagccgccagaatccaggagaagctgctggaggacagcctgaccgagctgagagccgccgagcccaaggaggtggccagcgagggcaccatgctgaagagactgatcgagaagaagttcggcaccatgaccgagaagcagcaggagctgctgttccactacctgcagctggtggccagcgtggagcaggagcagcagaagttcagaagccaggccgccgtgatcgacgagatcgtggacaccaccttcgaggccggcgaggaggacttcagaaactag

SEQ ID NO: 75741 - DNA, 1197 bp, Artificial Sequence
  Description of Artificial Sequence: Synthetic coding sequence
atgagccagcacagacaccagagacacagcagagtgatcagcagcagccccgtggacaccaccagcgtgggcttctgccccaccttcaagaagttcaagagaaacgacgacgagtgcagagccttcgtgaagagagtgatcatgagcagattcttcaagatcatcatgatcagcaccgtgaccagcaacgccttcttcatggccctgtggaccagctacgacatcagatacagactgttcagactgctggagttcagcgagatcttcttcgtgagcatctgcaccagcgagctgagcatgaaggtgtacgtggaccccatcaactactggaagaacggctacaacctgctggacgtgatcatcatcatcgtgatgttcctgccctacgccctgagacagctgatgggcaagcagttcacctacctgtacatcgccgacggcatgcagagcctgagaatcctgaagctgatcggctacagccagggcatcagaaccctgatcaccgccgtgggccagaccgtgtacaccgtggccagcgtgctgctgctgctgttcctgctgatgtacatcttcgccatcctgggcttctgcctgttcggcagccccgacaacggcgaccacgacaactggggcaacctggccgccgccttcttcaccctgttcagcctggccaccgtggacggctggaccgacctgcagaagcagctggacaacagagagttcgccctgagcagagccttcaccatcatcttcatcctgctggccagcttcatcttcctgaacatgttcgtgggcgtgatgatcatgcacaccgaggacagcatcagaaagttcgagagagagctgatgctggagcagcaggagatgctgatgggcgagaagcaggtgatcctgcagagacagcaggaggagatcagcagactgatgcacatccagaagaacgccgactgcaccagcttcagcgagctggtggagaacttcaagaagaccctgagccacaccgaccccatggtgctggacgacttcggcaccagcctgcccttcatcgacatctacttcagcaccctggactaccaggacaccaccgtgcacaagctgcaggagctgtactacgagatcgtgcacgtgctgagcctgatgctggaggacctgccccaggagaagccccagagcctggagaaggtggacgagaagtag

SEQ ID NO: 75742 - DNA, 1419 bp, Artificial Sequence
  Description of Artificial Sequence: Synthetic coding sequence
atgagagacaacgagaaggcctggtggcagcagtggaccagccacaccggcctggagggctggggcggcacccaggaggacagaatgggcttcggcggcgccgtggccgccctgagaggcagacccagccccctgcagagcaccatccacgagagctacggcagacccgaggagcaggtgctgatcaacagacaggagatcaccaacaaggccgacgcctgggacatgcaggagttcatcacccacatgtacatcaagcagctgctgagacaccccgccttccagctgctgctggccctgctgctggtgatcaacgccatcaccatcgccctgagaaccaacagctacctggaccagaagcactacgagctgttcagcaccatcgacgacatcgtgctgaccatcctgctgtgcgaggtgctgctgggctggctgaacggcttctggatcttctggaaggacggctggaacatcctgaacttcatcatcgtgttcatcctgctgctgagattcttcatcaacgagatcaacatccccagcatcaactacaccctgagagccctgagactggtgcacgtgtgcatggccgtggagcccctggccagaatcatcagagtgatcctgcagagcgtgcccgacatggccaacatcatggtgctgatcctgttcttcatgctggtgttcagcgtgttcggcgtgaccctgttcggcgccttcgtgcccaagcacttccagaacatccaggtggccctgtacaccctgttcatctgcatcacccaggacggctgggtggacatctacagcgacttccagaccgagaagagagagtacgccatggagatcggcggcgccatctacttcaccatcttcatcaccatcggcgccttcatcggcatcaacctgttcgtgatcgtggtgaccaccaacctggagcagatgatgaaggccggcgagcagggccagcagcagagaatcaccttcagcgagaccggcgccgaggaggaggaggagaacgaccagctgcccctggtgcactgcgtggtggccagaagcgagaagagcggcctgctgcaggagcccctggccggcggccccctgagcaacctgagcgagaacacctgcgacaacttctgcctggtgctggaggccatccaggagaacctgagacagtacaaggagatcagagacgagctgaacatgatcgtggaggaggtgagagccatcagattcaaccaggagcaggagagcgaggtgctgaacagaagaagcagcaccagcggcagcctggagaccaccagcagcaaggacatcagacagatgagccagcagcaggacctgctgagcgccctggtgagcatggagaaggtgcacgacagcagcagccagatcctgctgaagaagcacaagagcagccactag

SEQ ID NO: 75743 - DNA, 3351 bp, Artificial Sequence
  Description of Artificial Sequence: Synthetic coding sequence
atggagagccccctgatctacgtgagcgtgctgctgctgaacatcttcgagttcagcagcggcatcgtgtacaacaaggacgacaccgagaagagattcgcctgcagcaacaagggcttcccccaggagaacgagatcatcaagctgtacctgttcctggagaacctgaagatccagtgcttcttccagaccgagaacgagatcgccagcaaggccatgctgagcgtgttcaccagcggcggcctggcccccagcctgggcatcatgaacagcacctacaacggcatcttccacttcaacctgaccctgttcagcgacagaatcctgtggctggtggacatccccagagagaacatcacccagagcaccgacatcgccgccgtggaggagtggctggtgagaatcaccctgcaccacggcctgaacatctacgccaccgagggcaccctgctggacgtgatcagagagcccatcctgcagtggacccccggcgacgtgatccccgagagcgagatcagcaagctgtacccccacgtggtggacctgaaggtgaccaagtgcccctgcgccaacgacgtggccctgctgggcttcatcgtggacaccatcgtggacggcgtgtacatcggcatcaccttcggcggcttctggcacgactacgacaccacctggttcaacatgacccagaccatctacagccagctgcaggaggagtacgaggacctgagcctggtggacatggtgctgaccaaccacttcctggtgatcctgaccagcctgggcctgttcgtgagcgaggacctgagataccccagcagacacagcctgagcttcagcagagccgacttctgcggcttcgagagagtggactacgtgaagggcaagctgtggtacaacgagagatgcttcgccaacagagagcacttcgaggtggactacgtgaccgtgaccttcgagagaaacagaaccctgagcgagagcagcagctgcttctacagccaggagcccttcctggagtgggtgccctgcctgccccacatcttcaagggcatcaagatcttccccaccgtgctgaccttcctggtggaccaggagagaggcaccggcgtgtacctgttctacaacaaggtgagaaagaccgccatcgccagcgtgagcaccctgagaaacaacgagcccaacagccagagcaagttccccatcttcagattccccagcagcttcagcagccccgtgggcatggtgttccaccccagaagccacttcctgtacgcctacggcaaccagatctggctgagcgtggacggcggcaacaccttccagctgatcgccaacttccacgacgacatcatcaagaagaccttccacagcttctacaccagcgccatcaccttcgtgagccagagaggcaaggtgtacagcaccaaggccggcatgggcagatacagcgccgtgggcagcgtgaccgagagaatcttcaccctgtactacgaccacctgggcttcctgcacaagctgaccctgggcagattcgaggccagcggcccccccaccgccttcggcaacagcagaaacctgttcggccagccccccgacatgggcttcgagaccgccctggccccccagcacaccagcctggacgagatcatcttcttcgcctacgtgcccgagaacgagccccaggagaccatctacagcaagaagttcggcaacatccactacggcaaggtgatccacagcggcaagaccggcagagcctacatcagaaaggtgctgcagcacaccacccccaagggcttcctgagcagcgtgatcgccgagatgaaggagcccttcggcctggaggaggtgaacgagagcagctgcctgagcagcagcctgctgatcaacaaggccggcaacgtgtacaagctgaccctggacagccaggtggtgcaggccctgttcgaggacaccgacatcgagaagaccgtggtgctgcccggctacagcagcttcctgatcaccagcatcctggacaacaagaacgccctggccatcgccaccatgcccgagagcgcccccaacaacatgaccttcctgaagagcacctggttcctgtacaacttcggccagagaaacggcagaacctggaagatctacagcaagccctgcaactactggttccagcacgacgacagccccagcctgaacatcgtgaagtacatcgacctgggcaacagctacgtgctgaaggccaaggtgatcagaaacgccaagggcttcagaatgctggagatccccctgctgaccgtgttcgtgggcaaccccaacctgctggaggtgaccgccgaggtgaccttcgacgacaccgacagctacgtgatcaccatcagcgccgccagcaaggtgctgcaccagggcagcaccagcctggccttcatcatgtggagcgccagcaccgagtgcttcgtgaccaccatggtgcccaccctgaagagcagctgcagctacctgagaagcatgcaccacatccccagcaagttcatccccttcgaggactggatcagcggcgtgcacaaggacagccagggcttcaacctgatcaagaccctgcccatcaactacagaccccccagcaacatgggcatcgccatccccctgaccgacaacttctaccacgccgaccccagcaagcccatccccagaaacatgttccacatgagcaagaagaccggcaagttcaagcagtgcgccaacgtgagcaccagagaggagtgcaactgcaccaaggaccagaagttcagccacgccgtggccttcagcgactgcagagagaaggtgcccagattcaagttccccatcacccagtaccccgtgagcctggagatcatcaacgaggacggcagagtgcccctgcagagcccctacctggtgaccgtgaccgaggtgaacatgagacacaactggaagctgaagcacaccgtgcccgagaacatcaagagaatgaagcagctggtggagcccatcctgggcgccgccgtgtacaaccccagcggcctgaacctgagcatcaagggcagcgagctgttccacttcagagtgaccgtgatcagcggcgtgaccttctgcaacctgatcgaggagttccagatctacgtggacgaggcccccctgcccttccccggccacaccctgatcgccgtggccaccgccgtggtgctgggcggcctgatcttcatcgccttcatgttccagctgcagggcatccacccctggagaaccttccagagatggatcagaagaaaccaggagaagttcagcagcatcagcctgagcgagctgatccacagaagcaagagcgaggagtag

SEQ ID NO: 75744 - DNA, 225 bp, Artificial Sequence
  Description of Artificial Sequence: Synthetic coding sequence
atggagagccccctgatctacgtgagcgtgctgctgctgaacatcttcgagttcagcagcggcatcgtgtacaacaaggacgacaccgagaagagattcgcctgcagcaacaagggcttcccccaggagaacgagatcatcaagctgtacctgttcctggagaacctgaagatccagtgcttcttccagaccgagaacgagatcgccagcaaggccatgctgtag

SEQ ID NO: 75745 - DNA, 303 bp, Artificial Sequence
  Description of Artificial Sequence: Synthetic coding sequence
atggagagccccctgatctacgtgagcgtgctgctgctgaacatcttcgagttcagcagcggcatcgtgtacaacaaggacgacaccgagaagagattcgcctgcagcaacaagggcttcccccaggagaacgagatcatcaagctgtacctgttcctggagaacctgaagatccagtgcttcttccagaccgagaacgagatcgccagcaaggccatgctgagcgtgttcaccagcggcggcctggcccccagcctgggcatcatgaacagcacctacaacggcatcttccacttcaactag

SEQ ID NO: 75746 - DNA, 225 bp, Artificial Sequence; identical to SEQ ID NO: 75744
  Description of Artificial Sequence: Synthetic coding sequence

SEQ ID NO: 75747 - DNA, 795 bp, Artificial Sequence
  Description of Artificial Sequence: Synthetic coding sequence
atgcacaaccccgacggcagcgccagccccaccgccgaccccggcagcgagctgcagaccctgggccaggccgccagaagaccccccccccccagagccggccacgacgcccccagaagaaccagacccagcgccagaaagcccctgagctgcttcagcagaagacccatgcccaccagagagccccccaagaccagaggcagcagaggccacctgcacacccacccccccggccccggcccccccctgcagggcctggcccccagaggcctgaagaccagcgcccccagacccccctgccagccccagcccggcccccacaaggccaagaccaagaagatcgtgttcgaggacgagctgctgagccaggccctgctgggcgccaagaagcccatcggcgccatccccaagggccacaagcccagaccccaccccgtgcccgactacgagctgaagtacccccccgtgagcagcgagagagagagaagcagatacgtggccgtgttccaggaccagtacggcgagttcctggagctgcagcacgaggtgggctgcgcccaggccaagctgagacagctggaggccctgctgagcagcctgccccccccccagagccagaaggaggcccaggtggccgccagagtgtggagagagttcgagatgaagagaatggaccccggcttcctggacaagcaggccagatgccactacctgaagggcaagctgagacacctgaagacccagatccagaagttcgacgaccagggcgacagcgagggcagcgtgtacttctag

SEQ ID NO: 75748 - DNA, 3480 bp, Artificial Sequence
  Description of Artificial Sequence: Synthetic coding sequence
atgtgcggccccgccatgttccccgccggccccccctggcccagagtgagagtggtgcaggtgctgtgggccctgctggccgtgctgctggccagctggagactgtgggccatcaaggacttccaggagtgcacctggcaggtggtgctgaacgagttcaagagagtgggcgagagcggcgtgagcgacagcttcttcgagcaggagcccgtggacaccgtgagcagcctgttccacatgctggtggacagccccatcgaccccagcgagaagtacctgggcttcccctactacctgaagatcaactacagctgcgaggagaagcccagcgaggacctggtgagaatgggccacctgaccggcctgaagcccctggtgctggtgaccttccagagccccgtgaacttctacagatggaagatcgagcagctgcagatccagatggaggccgcccccttcagaagcaaggagccctgcatggccgaggaggtgtgcagcatgagctggtacacccccatgcccatcaagaagggcagcgtggtgatgagagtggacatcagcagcaacggcctgggcaccttcatccccgacaagagattccagatgaacatcaacggcttcctgaagagagacagagacaacaacatccagttcaccgtgggcgaggagctgttcaacctgatgccccagtacttcgtgggcgtgagcagcagacccctgtggcacaccgtggaccagagccccgtgctgatcctgggcggcatccccaacgagaagtacgtgctgatgaccgacaccagcttcaaggacttcagcctggtggagctgagcatcgacagctgctgggtgggcagcttctactgcccccacagcggcttcaccgccaccatctacgacaccatcgccaccgagagcaccctgttcatcagacagaaccagctggtgtactacttcaccggcacctacaccaccctgtacgagagaaacagaggcagcggcagctggatcagagtgctggccagcgagtgcatcaagaagctgtgccccgtgtacttccacagcaacggcagcgagtacatcatggccctgaccaccggcaagcacgagggctacgtgcacttcggcaccatcagagacggccaggtgagcttcgagatgctgcccagacagtggagcgtgtgcgagcagatcggcgtgaccacctgcagcatcatctggagcgagtacatcgccggcgagtacaccctgctgctgctggtggagagcggctacggcaacgccagcaagagattccaggtggtgagctacaacaccgccagcgacgacctggagctgctgtaccacatccccgagttcatccccgaggccagaggcctggagttcctgatgatcctgggcaccgagagctacaccagcaccgccatggcccccaagggcatcttctgcaacccctacaacaacctgatcttcatctggggcaacttcctgctgcagagcagcaacaaggagaacttcatctacctggccgacttccccaaggagctgagcatcaagtacatggccagaagcttcagaggcgccgtggccatcgtgaccgagaccgaggagatctggtacctgctggagggcagctacagagtgtaccagctgttccccagcaagggctggcaggtgcacatcagcctgaagctgatgcagcagagcagcctgtacgccagcaacgagaccatgctgaccctgttctacgaggacagcaagctgtaccagctggtgtacctgatgaacaaccagaagggccagctggtgaagagactggtgcccgtggagcagctgctgatgtaccagcagcacaccagccactacgacctggagagaaagggcggctacctgatgctgagcttcatcgacttctgccccttcagcgtgatgagactgagaagcctgcccagcccccagagatacaccagacaggagagatacagagccagaccccccagagtgctggagagaagcggcttccacaacgagaacagcctggccatctaccagggcctggtgtactacctgctgtggctgcacagcgtgtacgacaagccctacgccgaccccgtgcacgaccccacctggagatggtgggccaacaacaagcaggaccaggactactacttcttcctggccagcaactggagaagcgccggcggcgtgagcatcgagatggacagctacgagaagatctacaacctggagagcgcctacgagctgcccgagagaatcttcctggacaagggcaccgagtacagcttcgccatcttcctgagcgcccagggccacagcttcagaacccagagcgagctgggcaccgccttccagctgcacagccaggtggacgtgggcgtggtgctggccgaccccggctgcatcgaggccagcgtgaagcaggaggtgctgatcaacagaaacagcgtgctgttcagcatcaccctgaaggacaagaagctgtgctacgaccagggcatcagcggccaccacctgatggagaccagcatgaccgtgaacgtggtgggcagcagcggcctgtgcttccaggagacccacctgggcccccacatgcagggcaacctgatggtgcccgtgttcatcggctgcccccccggcaagagactggccttcgacatcacctacaccctggagtacagcagactgaagaacaagcactacttcgactgcgtgaacgtgaaccccgagatgccctgcttcctgttcagagacatcttctaccccttcttcctgatccaggacctggtgaccggcgacagcggcagcttccagggcagctacgtgctgctggtggtgggcggcggccccaccctggacagcctgaaggactacagcgaggacgagatctacagattcaacagccccctggacaagaccaacagcctgatctggaccaccagaaccaccagaaccaccaaggacagcgccttccacatcatgagccacgagagccccggcatcgagtggctgtgcctggagaacgccccctgctacgacaacgtgccccagggcatcttcgcccccgagttcttcttcaaggtgctggtgagcaacagaggcgtggacaccagcacctactgcaactaccagctgaccttcctgctgcacatccacggcctgcccctgagccccaagagagccctgttcatcatcatggtgagcgccagcgtgttcgtgggcctggtgatcttctacatcgccttctgcctgctgtggcccctggtggtgaagggctgcaccatgatcagatggaagatcaacaacctgatcgccagcgagagctactacacctacgccagcatcagcggcatcagcagcatgcccagcctgagacacagcagaatgggcagcatgttcagcagcagaatgaccgaggacagagccgagcccaaggaggccgtggagagacagctgatgacctag

SEQ ID NO: 75749 - DNA, 3480 bp, Artificial Sequence; identical to SEQ ID NO: 75748
  Description of Artificial Sequence: Synthetic coding sequence

SEQ ID NO: 75750 - DNA, 1983 bp, Artificial Sequence
  Description of Artificial Sequence: Synthetic coding sequence
atggacgtgctggtgagcgagtgcagcgccagactgctgcagcaggaggaggagatcaagagcctgaccgccgagatcgacagactgaagaactgcggctgcctgggcgccagccccaacctggagcagctgcaggaggagaacctgaagctgaagtacagactgaacatcctgagaaagagcctgcaggccgagagaaacaagcccaccaagaacatgatcaacatcatcagcagactgcaggaggtgttcggccacgccatcaaggccgcctaccccgacctggagaacccccccctgctggtgacccccagccagcaggccaagttcggcgactaccagtgcaacagcgccatgggcatcagccagatgctgaagaccaaggagcagaaggtgaaccccagagagatcgccgagaacatcaccaagcacctgcccgacaacgagtgcatcgagaaggtggagatcgccggccccggcttcatcaacgtgcacctgagaaaggacttcgtgagcgagcagctgaccagcctgctggtgaacggcgtgcagctgcccgccctgggcgagaacaagaaggtgatcgtggacttcagcagccccaacatcgccaaggagatgcacgtgggccacctgagaagcaccatcatcggcgagagcatcagcagactgttcgagttcgccggctacgacgtgctgagactgaaccacgtgggcgactggggcacccagttcggcatgctgatcgcccacctgcaggacaagttccccgactacctgaccgtgagcccccccatcggcgacctgcaggtgttctacaaggagagcaagaagagattcgacaccgaggaggagttcaagaagagagcctaccagtgcgtggtgctgctgcagggcaagaaccccgacatcaccaaggcctggaagctgatctgcgacgtgagcagacaggagctgaacaagatctacgacgccctggacgtgagcctgatcgagagaggcgagagcttctaccaggacagaatgaacgacatcgtgaaggagttcgaggacagaggcttcgtgcaggtggacgacggcagaaagatcgtgttcgtgcccggctgcagcatccccctgaccatcgtgaagagcgacggcggctacacctacgacaccagcgacctggccgccatcaagcagagactgttcgaggagaaggccgacatgatcatctacgtggtggacaacggccagagcgtgcacttccagaccatcttcgccgccgcccagatgatcggctggtacgaccccaaggtgaccagagtgttccacgccggcttcggcgtggtgctgggcgaggacaagaagaagttcaagaccagaagcggcgagaccgtgagactgatggacctgctgggcgagggcctgaagagaagcatggacaagctgaaggagaaggagagagacaaggtgctgaccgccgaggagctgaacgccgcccagaccagcgtggcctacggctgcatcaagtacgccgacctgagccacaacagactgaacgactacatcttcagcttcgacaagatgctggacgacagaggcaacaccgccgcctacctgctgtacgccttcaccagaatcagaagcatcgccagactggccaacatcgacgaggagatgctgcagaaggccgccagagagaccaagatcctgctggaccacgagaaggagtggaagctgggcagatgcatcctgagattccccgagatcctgcagaagatcctggacgacctgttcctgcacaccctgtgcgactacatctacgagctggccaccgccttcaccgagttctacgacagctgctactgcgtggagaaggacagacagaccggcaagatcctgaaggtgaacatgtggagaatgctgctgtgcgaggccgtggccgccgtgatggccaagggcttcgacatcctgggcatcaagcccgtgcagagaatgtag

SEQ ID NO: 75751 - DNA, 465 bp, Artificial Sequence
  Description of Artificial Sequence: Synthetic coding sequence
atgtgctggaccagaatcagacccggcacccccagcagccccggcgcccagagacccaccccctacgagtggatgagaagaagcgtggccgccggcggcggcggcggcagcggcaagaccagaaccaaggacaagtacagagtggtgtacaccgaccaccagagactggagctggagaaggagttccactacagcagatacatcaccatcagaagaaagagcgagctggccgccaacctgggcctgaccgagagacaggtgaagatctggttccagaacagaagagccaaggagagaaaggtgaacaagaagaagcagcagcagcagcagcccccccagccccccatggcccacgacatcaccgccacccccgccggccccagcctgggcggcctgtgccccagcaacaccagcctgctggccaccagcagccccatgcccgtgaaggaggagttcctgccctag

SEQ ID NO: 75752 - DNA, 183 bp, Artificial Sequence
  Description of Artificial Sequence: Synthetic coding sequence
atgagaggcggccccagaggccaccacgtgtgcggcctgtgcgccggccagggcttcgccagagtgcccagacccagccaggccagccagcccagacccggccccgccagcctgtgccccagcaacaccagcctgctggccaccagcagccccatgcccgtgaaggaggagttcctgccctag

SEQ ID NO: 75753 - DNA, 942 bp, Artificial Sequence
  Description of Artificial Sequence: Synthetic coding sequence
atgtacgtgagctacctgctggacaaggacgtgagcatgtaccccagcagcgtgagacacagcggcggcctgaacctggccccccagaacttcgtgagccccccccagtaccccgactacggcggctaccacgtggccgccgccgccgccgccgccgccaacctggacagcgcccagagccccggccccagctggcccgccgcctacggcgcccccctgagagaggactggaacggctacgcccccggcggcgccgccgccgccgccaacgccgtggcccacggcctgaacggcggcagccccgccgccgccatgggctacagcagccccgccgactaccacccccaccaccacccccaccaccacccccaccaccccgccgccgcccccagctgcgccagcggcctgctgcagaccctgaaccccggcccccccggccccgccgccaccgccgccgccgagcagctgagccccggcggccagagaagaaacctgtgcgagtggatgagaaagcccgcccagcagagcctgggcagccaggtgaagaccagaaccaaggacaagtacagagtggtgtacaccgaccaccagagactggagctggagaaggagttccactacagcagatacatcaccatcagaagaaaggccgagctggccgccaccctgggcctgagcgagagacaggtgaagatctggttccagaacagaagagccaaggagagaaagatcaacaagaagaagctgcagcagcagcagcagcagcagcccccccagcccccccccccccccccccagcccccccagccccagcccggccccctgagaagcgtgcccgagcccctgagccccgtgagcagcctgcaggccagcgtgcccggcagcgtgcccggcgtgctgggccccaccggcggcgtgctgaaccccaccgtgacccagtag

SEQ ID NO: 75754 - DNA, 855 bp, Artificial Sequence
  Description of Artificial Sequence: Synthetic coding sequence
atgtacggcagctgcctgctggagaaggaggccggcatgtaccccggcaccctgatgagccccggcggcgacggcaccgccggcaccggcggcaccggcggcggcggcagccccatgcccgccagcaacttcgccgccgcccccgccttcagccactacatgggctacccccacatgcccagcatggacccccactggcccagcctgggcgtgtggggcagcccctacagcccccccagagaggactggagcgtgtaccccggccccagcagcaccatgggcaccgtgcccgtgaacgacgtgaccagcagccccgccgccttctgcagcaccgactacagcaacctgggccccgtgggcggcggcaccagcggcagcagcctgcccggccaggccggcggcagcctggtgcccaccgacgccggcgccgccaaggccagcagccccagcagaagcagacacagcccctacgcctggatgagaaagaccgtgcaggtgaccggcaagaccagaaccaaggagaagtacagagtggtgtacaccgaccaccagagactggagctggagaaggagttccactgcaacagatacatcaccatccagagaaagagcgagctggccgtgaacctgggcctgagcgagagacaggtgaagatctggttccagaacagaagagccaaggagagaaagatgatcaagaagaagatcagccagttcgagaacagcggcggcagcgtgcagagcgacagcgacagcatcagccccggcgagctgcccaacaccttcttcaccacccccagcgccgtgagaggcttccagcccatcgagatccagcaggtgatcgtgagcgagtag

SEQ ID NO: 75755 - DNA, 456 bp, Artificial Sequence
  Description of Artificial Sequence: Synthetic coding sequence
atgatggccgaggagcacaccgacctggaggcccagatcgtgaaggacatccactgcaaggagatcgacctggtgaacagagaccccaagaacatcaacgaggacatcgtgaaggtggacttcgaggacgtgatcgccgagcccgtgggcacctacagcttcgacggcgtgtggaaggtgagctacaccaccttcaccgtgagcaagtactggtgctacagactgctgagcaccctgctgggcgtgcccctggccctgctgtggggcttcctgttcgcctgcatcagcttctgccacatctgggccgtggtgccctgcatcaagagctacctgatcgagatccagtgcatcagccacatctacagcctgtgcatcagaaccttctgcaaccccctgttcgccgccctgggccaggtgtgcagcagcatcaaggtggtgctgagaaaggaggtgtag

SEQ ID NO: 75756 - DNA, 456 bp, Artificial Sequence; identical to SEQ ID NO: 75755
  Description of Artificial Sequence: Synthetic coding sequence

SEQ ID NO: 75757 - DNA, 813 bp, Artificial Sequence
  Description of Artificial Sequence: Synthetic coding sequence
atggccgaccacatgatggccatgaaccacggcagattccccgacggcaccaacggcctgcaccaccaccccgcccacagaatgggcatgggccagttccccagcccccaccaccaccagcagcagcagccccagcacgccttcaacgccctgatgggcgagcacatccactacggcgccggcaacatgaacgccaccagcggcatcagacacgccatgggccccggcaccgtgaacggcggccacccccccagcgccctggcccccgccgccagattcaacaacagccagttcatgggcccccccgtggccagccagggcggcagcctgcccgccagcatgcagctgcagaagctgaacaaccagtacttcaaccaccacccctacccccacaaccactacatgcccgacctgcaccccgccgccggccaccagatgaacggcaccaaccagcacttcagagactgcaaccccaagcacagcggcggcagcagcacccccggcggcagcggcggcagcagcacccccggcggcagcggcagcagcagcggcggcggcgccggcagcagcaacagcggcggcggcagcggcagcggcaacatgcccgccagcgtggcccacgtgcccgccgccatgctgccccccaacgtgatcgacaccgacttcatcgacgaggaggtgctgatgagcctggtgatcgagatgggcctggacagaatcaaggagctgcccgagctgtggctgggccagaacgagttcgacttcatgaccgacttcgtgtgcaagcagcagcccagcagagtgagctgctag

SEQ ID NO: 75758 - DNA, 645 bp, Artificial Sequence
  Description of Artificial Sequence: Synthetic coding sequence
atggccgaccacatgatggccatgaaccacggcagattccccgacggcaccaacggcctgcaccaccaccccgcccacagaatgggcatgggccagttccccagcccccaccaccaccagcagcagcagccccagcacgccttcaacgccctgatgggcgagcacatccactacggcgccggcaacatgaacgccaccagcggcatcagacacgccatgggccccggcaccgtgaacggcggccacccccccagcgccctggcccccgccgccagattcaacaacagccagttcatgggcccccccgtggccagccagggcggcagcctgcccgccagcatgcagctgcagaagctgaacaaccagtacttcaaccaccacccctacccccacaaccactacatgcccgacctgcaccccgccgccggccaccagatgaacggcaccaaccagcacttcagagactgcaacccccccaacgtgatcgacaccgacttcatcgacgaggaggtgctgatgagcctggtgatcgagatgggcctggacagaatcaaggagctgcccgagctgtggctgggccagaacgagttcgacttcatgaccgacttcgtgtgcaagcagcagcccagcagagtgagctgctag

SEQ ID NO: 75759 - DNA, 813 bp, Artificial Sequence; identical to SEQ ID NO: 75757
  Description of Artificial Sequence: Synthetic coding sequence

SEQ ID NO: 75760 - DNA, 813 bp, Artificial Sequence; identical to SEQ ID NO: 75757
  Description of Artificial Sequence: Synthetic coding sequence

SEQ ID NO: 75761 - DNA, 1797 bp, Artificial Sequence
  Description of Artificial Sequence: Synthetic coding sequence
atggagaacagcagcgccgccagcgccagcagcgaggccggcagcagcagaagccaggagatcgaggagctggagagattcatcgacagctacgtgctggagtaccaggtgcagggcctgctggccgacaagaccgagggcgacggcgagagcgagagaacccagagccacatcagccagtggaccgccgactgcagcgagcccctggacagcagctgcagcttcagcagaggcagagcccccccccagcagaacggcagcaaggacaacagcctggacatgctgggcaccgacatctgggccgccaacaccttcgacagcttcagcggcgccacctgggacctgcagcccgagaagctggacttcacccagttccacagaaaggtgagacacacccccaagcagcccctgccccacatcgacagagagggctgcggcaagggcaagctggaggacggcgacggcatcaacctgaacgacatcgagaaggtgctgcccgcctggcagggctaccaccccatgccccacgaggtggagatcgcccacaccaagaagctgttcagaagaagaagaaacgacagaagaagacagcagagaccccccggcggcaacaagccccagcagcacggcgaccaccagcccggcagcgccaagcacaacagagaccaccagaagagctaccagggcggcagcgccccccaccccagcggcagacccacccaccacggctacagccagaacagaagatggcaccacggcaacatgaagcacccccccggcgacaagggcgaggccggcgcccacagaaacgccaaggagaccatgaccatcgagaaccccaagctggaggacaccgccggcgacaccggccacagcagcctggaggcccccagaagccccgacaccctggcccccgtggccagcgagagactgcccccccagcagagcggcggccccgaggtggagaccaagagaaaggacagcatcctgcccgagagaatcggcgagagacccaagatcaccctgctgcagagcagcaaggacagactgagaagaagactgaaggagaaggacgaggtggccgtggagaccaccaccccccagcagaacaagatggacaagctgatcgagatcctgaacagcatgagaaacaacagcagcgacgtggacaccaagctgaccaccttcatggaggaggcccagaacagcaccaacagcgaggagatgctgggcgagatcgtgagaaccatctaccagaaggccgtgagcgacagaagcttcgccttcaccgccgccaagctgtgcgacaagatggccctgttcatggtggagggcaccaagttcagaagcctgctgctgaacatgctgcagaaggacttcaccgtgagagaggagctgcagcagcaggacgtggagagatggctgggcttcatcaccttcctgtgcgaggtgttcggcaccatgagaagcagcaccggcgagcccttcagagtgctggtgtgccccatctacacctgcctgagagagctgctgcagagccaggacgtgaaggaggacgccgtgctgtgctgcagcatggagctgcagagcaccggcagactgctggaggagcagctgcccgagatgatgaccgagctgctggccagcgccagagacaagatgctgtgccccagcgagagcatgctgaccagaagcctgctgctggaggtgatcgagctgcacgccaacagctggaaccccctgaccccccccatcacccagtactacaacagaaccatccagaagctgaccgcctag

SEQ ID NO: 75762 - DNA, 1803 bp, Artificial Sequence
  Description of Artificial Sequence: Synthetic coding sequence
atggagaacagcagcgccgccagcgccagcagcgaggccggcagcagcagaagccaggagatcgaggagctggagagattcatcgacagctacgtgctggagtaccaggtgcagggcctgctggccgacaagaccgagggcgacggcgagagcgagagaacccagagccacatcagccagtggaccgccgactgcagcgagcccctggacagcagctgcagcttcagcagaggcagagcccccccccagcagaacggcagcaaggacaacagcctggacatgctgggcaccgacatctgggccgccaacaccttcgacagcttcagcggcgccacctgggacctgcagcccgagaagctggacttcacccagttccacagaaaggtgagacacacccccaagcagcccctgccccacatcgacagagagggctgcggcaagggcaagctggaggacggcgacggcatcaacctgaacgacatcgagaaggtgctgcccgcctggcagggctaccaccccatgccccacgaggtggagatcgcccacaccaagaagctgttcagaagaagaagaaacgacagaagaagacagcagagaccccccggcggcaacaagccccagcagcacggcgaccaccagcccggcagcgccaagcacaacagagaccaccagaagagctaccagggcggcagcgccccccaccccagcggcagacccacccaccacggctacagccagaacagaagatggcaccacggcaacatgaagcacccccccggcgacaagggcgaggccggcgcccacagaaacgccaaggagaccatgaccatcgagaaccccaagctggaggacaccgccggcgacaccggccacagcagcctggaggcccccagaagccccgacaccctggcccccgtggccagcgagagactgcccccccagcagagcggcggccccgaggtggagaccaagagaaaggacagcatcctgcccgagagaatcggcgagagacccaagatcaccctgctgcagagcagcaaggacagactgagaagaagactgaaggagaaggtgcccgacgaggtggccgtggagaccaccaccccccagcagaacaagatggacaagctgatcgagatcctgaacagcatgagaaacaacagcagcgacgtggacaccaagctgaccaccttcatggaggaggcccagaacagcaccaacagcgaggagatgctgggcgagatcgtgagaaccatctaccagaaggccgtgagcgacagaagcttcgccttcaccgccgccaagctgtgcgacaagatggccctgttcatggtggagggcaccaagttcagaagcctgctgctgaacatgctgcagaaggacttcaccgtgagagaggagctgcagcagcaggacgtggagagatggctgggcttcatcaccttcctgtgcgaggtgttcggcaccatgagaagcagcaccggcgagcccttcagagtgctggtgtgccccatctacacctgcctgagagagctgctgcagagccaggacgtgaaggaggacgccgtgctgtgctgcagcatggagctgcagagcaccggcagactgctggaggagcagctgcccgagatgatgaccgagctgctggccagcgccagagacaagatgctgtgccccagcgagagcatgctgaccagaagcctgctgctggaggtgatcgagctgcacgccaacagctggaaccccctgaccccccccatcacccagtactacaacagaaccatccagaagctgaccgcctag

SEQ ID NO: 75763 - DNA, 1947 bp, Artificial Sequence
  Description of Artificial Sequence: Synthetic coding sequence
atgggcagactgccctgcggccccctgcccggccagtggaccgccgactgcagcgagcccctggacagcagctgcagcttcagcagaggcagagcccccccccagcagaacggcagcaaggacaacagcctggacatgctgggcaccgacatctgggccgccaacaccttcgacagcttcagcggcgccacctgggacctgcagcccgagaagctggacttcacccagttccacagaaaggtgagacacacccccaagcagcccctgccccacatcgacagagagggctgcggcaagggcaagctggaggacggcgacggcatcaacctgaacgacatcgagaaggtgctgcccgcctggcagggctaccaccccatgccccacgaggtggagatcgcccacaccaagaagctgttcagaagaagaagaaacgacagaagaagacagcagagaccccccggcggcaacaagccccagcagcacggcgaccaccagcccggcagcgccaagcacaacagagaccaccagaagagctaccagggcggcagcgccccccaccccagcggcagacccacccaccacggctacagccagaacagaagatggcaccacggcaacatgaagcacccccccggcgacaagggcgaggccggcgcccacagaaacgccaaggagaccatgaccatcgagaaccccaagctggaggacaccgccggcgacaccggccacagcagcctggaggcccccagaagccccgacaccctggcccccgtggccagcgagagactgcccccccagcagagcggcggccccgaggtggagaccaagagaaaggacagcatcctgcccgagagaatcggcgagagacccaagatcaccctgctgcagagcagcaaggacagactgagaagaagactgaaggagaaggacgaggtggccgtggagaccaccaccccccagcagaacaagatggacaagctgatcgagatcctgaacagcatgagaaacaacagcagcgacgtggacaccaagctgaccaccttcatggaggaggcccagaacagcaccaacagcgaggagatgctgggcgagatcgtgagaaccatctaccagaaggccgtgagcgacagaagcttcgccttcaccgccgccaagctgtgcgacaagatggccctgttcatggtggagggcaccaagttcagaagcctgctgctgaacatgctgcagaaggacttcaccgtgagagaggagctgcagcagcaggacgtggagagatggctgggcttcatcaccttcctgtgcgaggtgttcggcaccatgagaagcagcaccggcgagcccttcagagtgctggtgtgccccatctacacctgcctgagagagctgctgcagagccaggacgtgaaggaggacgccgtgctgtgctgcagcatggagctgcagagcaccggcagactgctggaggagcagctgcccgagatgatgaccgagctgctggccagcgccagagacaagatgctgtgccccagcgagagcatgctgaccagaagcctgctgctggaggtgatcgagctgcacgccaacagctggaaccagggcgcctggcaggccgcccacggccagctgggcccctggtgcaccggccccgacggccaggccggcggccagggctggccctggagagagaaggagatgggcagaagagccggcagagtgggcggccagagcggcgccagagcctgcaagctgacccccatcagagaggcctgcttcttcttcctggtggccctggccctgcccttcctgacccccgccagccccctgcccatcagacccatcccccacggcgccctgtgcgagggcagccacagatgcgacagcagcgagaccctggccgccagccacgccggcgcccccctgggcagcgagagaaccagcgagggctag

SEQ ID NO: 75764 - DNA, 1077 bp, Artificial Sequence
  Description of Artificial Sequence: Synthetic coding sequence
atggagagcgccgacttctacgaggccgagcccagaccccccatgagcagccacctgcagagccccccccacgcccccagcagcgccgccttcggcttccccagaggcgccggccccgcccagccccccgccccccccgccgcccccgagcccctgggcggcatctgcgagcacgagaccagcatcgacatcagcgcctacatcgaccccgccgccttcaacgacgagttcctggccgacctgttccagcacagcagacagcaggagaaggccaaggccgccgtgggccccaccggcggcggcggcggcggcgacttcgactaccccggcgcccccgccggccccggcggcgccgtgatgcccggcggcgcccacggccccccccccggctacggctgcgccgccgccggctacctggacggcagactggagcccctgtacgagagagtgggcgcccccgccctgagacccctggtgatcaagcaggagcccagagaggaggacgaggccaagcagctggccctggccggcctgttcccctaccagcccccccccccccccccccccagccacccccacccccaccccccccccgcccacctggccgccccccacctgcagttccagatcgcccactgcggccagaccaccatgcacctgcagcccggccaccccacccccccccccacccccgtgcccagcccccaccccgcccccgccctgggcgccgccggcctgcccggccccggcagcgccctgaagggcctgggcgccgcccaccccgacctgagagccagcggcggcagcggcgccggcaaggccaagaagagcgtggacaagaacagcaacgagtacagagtgagaagagagagaaacaacatcgccgtgagaaagagcagagacaaggccaagcagagaaacgtggagacccagcagaaggtgctggagctgaccagcgacaacgacagactgagaaagagagtggagcagctgagcagagagctggacaccctgagaggcatcttcagacagctgcccgagagcagcctggtgaaggccatgggcaactgcgcctag

SEQ ID NO: 75765 - DNA, 810 bp, Artificial Sequence
  Description of Artificial Sequence: Synthetic coding sequence
atgagcgccgccctgttcagcctggacggccccgccagaggcgccccctggcccgccgagcccgcccccttctacgagcccggcagagccggcaagcccggcagaggcgccgagcccggcgccctgggcgagcccggcgccgccgcccccgccatgtacgacgacgagagcgccatcgacttcagcgcctacatcgacagcatggccgccgtgcccaccctggagctgtgccacgacgagctgttcgccgacctgttcaacagcaaccacaaggccggcggcgccggccccctggagctgctgcccggcggccccgccagacccctgggccccggccccgccgcccccagactgctgaagagagagcccgactggggcgacggcgacgcccccggcagcctgctgcccgcccaggtggccgcctgcgcccagaccgtggtgagcctggccgccgccggccagcccaccccccccaccagccccgagccccccagaagcagccccagacagacccccgcccccggccccgccagagagaagagcgccggcaagagaggccccgacagaggcagccccgagtacagacagagaagagagagaaacaacatcgccgtgagaaagagcagagacaaggccaagagaagaaaccaggagatgcagcagaagctggtggagctgagcgccgagaacgagaagctgcaccagagagtggagcagctgaccagagacctggccggcctgagacagttcttcaagcagctgcccagcccccccttcctgcccgccgccggcaccgccgactgcagatag

SEQ ID NO: 75766 - DNA, 402 bp, Artificial Sequence
  Description of Artificial Sequence: Synthetic coding sequence
atgagcgccgccctgttcagcctggacggccccgccagaggcgccccctggcccgccgagcccgcccccttctacgagcccggcagagccggcaagcccggcagaggcgccgagcccggcgccctgggcgagcccggcgccgccgcccccgccatgtacgacgacgagagcgccatcgacttcagcgcctacatcgacagcatggccgccgtgcccaccctggagctgtgccacgacgagctgttcgccgacctgttcaacagcaaccacaaggccagagccccctgggccagagccctgcccctgcccgcctgcagcagcgccagccccaccggcgccaccgccaccagacccgccagatgctgccccagaagatggcccagagcccacagaccctggtag

SEQ ID NO: 75767 - DNA, 1092 bp, Artificial Sequence
  Description of Artificial Sequence: Synthetic coding sequence
atggccagcggcgacttctgcagccccggcgagggcatggagatcctgcagcaggtgtgcagcaagcagctgcccccctgcaacctgagcaaggaggacctgctgcagaacccctacttcagcaagctgctgctgaacctgagccagcacgtggacgagagcggcctgagcctgaccctggccaaggagcaggcccaggcctggaaggaggtgagactgcacaagaccacctggctgagaagcgagatcctgcacagagtgatccaggagctgctggtggactactacgtgaagatccaggacaccaacgtgaccagcgaggacaagaagttccacgagaccctggagcagagactgctggtgaccgagctgatgagactgctgggccccagccaggagagagagatcccccccctgctgggcctggagaaggccgacctgctggagctgatgcccctgagcgaggacttcgtgtggatgagagccagactgcagcaggaggtggaggagcagctgaagaagaagtgcttcaccctgctgtgctactacgaccccaacagcgacgccgacagcgagaccgtgaaggccgccaaggtgtggaagctggccgaggtgctggtgggcgagcagcagcagtgccaggacgccaagagccagcagaaggagcagatgctgctgctggagaagaagagcgccgcctacagccaggtgctgctgagatgcctgaccctgctgcagagactgctgcaggagcacagactgaagacccagagcgagctggacagaatcaacgcccagtacctggaggtgaagtgcggcgccatgatcctgaagctgagaatggaggagctgaagatcctgagcgacacctacaccgtggagaaggtggaggtgcacagactgatcagagacagactggagggcgccatccacctgcaggagcaggacatggagaacagcagacaggtgctgaacagctacgaggtgctgggcgaggagttcgacagactggtgaaggagtacaccgtgctgaagcaggccaccgagaacaagagatgggccctgcaggagttcagcaaggtgtacagatag

SEQ ID NO: 75768 - DNA, 1359 bp, Artificial Sequence
  Description of Artificial Sequence: Synthetic coding sequence
atgggcagcagccagagcgtggagatccccggcggcggcaccgagggctaccacgtgctgagagtgcaggagaacagccccggccacagagccggcctggagcccttcttcgacttcatcgtgagcatcaacggcagcagactgaacaaggacaacgacaccctgaaggacctgctgaaggccaacgtggagaagcccgtgaagatgctgatctacagcagcaagaccctggagctgagagagaccagcgtgacccccagcaacctgtggggcggccagggcctgctgggcgtgagcatcagattctgcagcttcgacggcgccaacgagaacgtgtggcacgtgctggaggtggagagcaacagccccgccgccctggccggcctgagaccccacagcgactacatcatcggcgccgacaccgtgatgaacgagagcgaggacctgttcagcctgatcgagacccacgaggccaagcccctgaagctgtacgtgtacaacaccgacaccgacaactgcagagaggtgatcatcacccccaacagcgcctggggcggcgagggcagcctgggctgcggcatcggctacggctacctgcacagaatccccaccagacccttcgaggagggcaagaagatcagcctgcccggccagatggccggcacccccatcacccccctgaaggacggcttcaccgaggtgcagctgagcagcgtgaacccccccagcctgagcccccccggcaccaccggcatcgagcagagcctgaccggcctgagcatcagcagcaccccccccgccgtgagcagcgtgctgagcaccggcgtgcccaccgtgcccctgctgcccccccaggtgaaccagagcctgaccagcgtgccccccatgaaccccgccaccaccctgcccggcctgatgcccctgcccgccggcctgcccaacctgcccaacctgaacctgaacctgcccgccccccacatcatgcccggcgtgggcctgcccgagctggtgaaccccggcctgccccccctgcccagcatgccccccagaaacctgcccggcatcgcccccctgcccctgcccagcgagttcctgcccagcttccccctggtgcccgagagcagcagcgccgccagcagcggcgagctgctgagcagcctgccccccaccagcaacgcccccagcgaccccgccaccaccaccgccaaggccgacgccgccagcagcctgaccgtggacgtgaccccccccaccgccaaggcccccaccaccgtggaggacagagtgggcgacagcacccccgtgagcgagaagcccgtgagcgccgccgtggacgccaacgccagcgagagcccctag

SEQ ID NO: 75769 - DNA, 2997 bp, Artificial Sequence
  Description of Artificial Sequence: Synthetic coding sequence
atggccgccgtgaaggagcccctggagttccacgccaagagaccctggagacccgaggaggccgtggaggaccccgacgaggaggacgaggacaacaccagcgaggccgagaacggcttcagcctggaggaggtgctgagactgggcggcaccaagcaggactacctgatgctggccaccctggacgagaacgaggaggtgatcgacggcggcaagaagggcgccatcgacgacctgcagcagggcgagctggaggccttcatccagaacctgaacctggccaagtacaccaaggccagcctggtggaggaggacgagcccgccgagaaggagaacagcagcaagaaggaggtgaagatccccaagatcaacaacaagaacaccgccgagagccagagaaccagcgtgaacaaggtgaagaacaagaacagacccgagccccacagcgacgagaacggcagcaccacccccaaggtgaagaaggacaagcagaacatcttcgagttcttcgagagacagaccctgctgctgagacccggcggcaagtggtacgacctggagtacagcaacgagtacagcctgaagccccagccccaggacgtggtgagcaagtacaagaccctggcccagaagctgtaccagcacgagatcaacctgttcaagagcaagaccaacagccagaagggcgccagcagcacctggatgaaggccatcgtgagcagcggcaccctgggcgacagaatggccgccatgatcctgctgatccaggacgacgccgtgcacaccctgcagttcgtggagaccctggtgaacctggtgaagaagaagggcagcaagcagcagtgcctgatggccctggacaccttcaaggagctgctgatcaccgacctgctgcccgacaacagaaagctgagaatcttcagccagagacccttcgacaagctggagcagctgagcagcggcaacaaggacagcagagacagaagactgatcctgtggtacttcgagcaccagctgaagcacctggtggccgagttcgtgcaggtgctggagaccctgagccacgacaccctggtgaccaccaagaccagagccctgaccgtggcccacgagctgctgtgcaacaagcccgaggaggagaaggccctgctggtgcaggtggtgaacaagctgggcgacccccagaacagaatcgccaccaaggccagccacctgctggagaccctgctgtgcaagcaccccaacatgaagggcgtggtgagcggcgaggtggagagactgctgttcagaagcaacatcagcagcaaggcccagtactacgccatctgcttcctgaaccagatggccctgagccacgaggagagcgagctggccaacaagctgatcaccgtgtacttctgcttcttcagaacctgcgtgaagaagaaggacgtggagagcaagatgctgagcgccctgctgaccggcgtgaacagagcctacccctacagccagaccggcgacgacaaggtgagagagcagatcgacaccctgttcaaggtgctgcacatcgtgaacttcaacaccagcgtgcaggccctgatgctgctgttccaggtgatgaacagccagcagaccatcagcgacagatactacaccgccctgtacagaaagatgctggaccccggcctgatgacctgcagcaagcaggccatgttcctgaacctggtgtacaagagcctgaaggccgacatcgtgctgagaagagtgaaggccttcgtgaagagactgctgcaggtgacctgccagcagatgccccccttcatctgcggcgccctgtacctggtgagcgagatcctgaaggccaagcccggcctgagaagccagctggacgaccaccccgagagcgacgacgaggagaacttcatcgacgccaacgacgacgaggacatggagaagttcaccgacgccgacaaggagaccgagatcgtgaagaagctggagaccgaggagaccgtgcccgagaccgacgtggagaccaagaagcccgaggtggccagctgggtgcacttcgacaacctgaagggcggcaagcagctgaacaagtacgaccccttcagcagaaaccccctgttctgcggcgccgagaacaccagcctgtgggagctgaagaagctgagcgtgcacttccaccccagcgtggccctgttcgccaagaccatcctgcagggcaactacatccagtacagcggcgaccccctgcaggacttcaccctgatgagattcctggacagattcgtgtacagaaaccccaagccccacaagggcaaggagaacaccgacagcgtggtgatgcagcccaagagaaagcacttcatcaaggacatcagacacctgcccgtgaacagcaaggagttcctggccaaggaggagagccagatccccgtggacgaggtgttcttccacagatactacaagaaggtggccgtgaaggagaagcagaagagagacgccgacgaggagagcatcgaggacgtggacgacgaggagttcgaggagctgatcgacaccttcgaggacgacaactgcttcagcagcggcaaggacgacatggacttcgccggcaacgtgaagaagagaaccaagggcgccaaggacaacaccctggacgaggacagcgagggcagcgacgacgagctgggcaacctggacgacgacgaggtgagcctgggcagcatggacgacgaggagttcgccgaggtggacgaggacggcggcaccttcatggacgtgctggacgacgagagcgagagcgtgcccgagctggaggtgcacagcaaggtgagcaccaagaagagcaagagaaagggcaccgacgacttcgacttcgccggcagcttccagggccccagaaagaagaagagaaacctgaacgacagcagcctgttcgtgagcgccgaggagttcggccacctgctggacgagaacatgggcagcaagttcgacaacatcgcctag

SEQ ID NO: 75770 - DNA, 1992 bp, Artificial Sequence
  Description of Artificial Sequence: Synthetic coding sequence
atggccgccaccgagatcagcgtgctgagcgagcagttcaccaagatcaaggagctggagctgatgcccgagaagggcctgaaggaggaggagaaggacggcgtgtgcagagagaaggaccacagaagccccagcgagctggaggccgagagaaccagcggcgccttccaggacagcgtgctggaggaggaggtggagctggtgctggcccccagcgaggagagcgagaagtacatcctgaccctgcagaccgtgcacttcaccagcgaggccgtggagctgcaggacatgagcctgctgagcatccagcagcaggagggcgtgcaggtggtggtgcagcagcccggccccggcctgctgtggctggaggagggccccagacagagcctgcagcagtgcgtggccatcagcatccagcaggagctgtacagcccccaggagatggaggtgctgcagttccacgccctggaggagaacgtgatggtggccagcgaggacagcaagctggccgtgagcctggccgagaccaccggcctgatcaagctggaggaggagcaggagaagaaccagctgctggccgagagaaccaaggagcagctgttcttcgtggagaccatgagcggcgacgagagaagcgacgagatcgtgctgaccgtgagcaacagcaacgtggaggagcaggaggaccagcccaccgccggccaggccgacgccgagaaggccaagagcaccaagaaccagagaaagaccaagggcgccaagggcaccttccactgcgacgtgtgcatgttcaccagcagcagaatgagcagcttcaacagacacatgaagacccacaccagcgagaagccccacctgtgccacctgtgcctgaagaccttcagaaccgtgaccctgctgagaaaccacgtgaacacccacaccggcaccagaccctacaagtgcaacgactgcaacatggccttcgtgaccagcggcgagctggtgagacacagaagatacaagcacacccacgagaagcccttcaagtgcagcatgtgcaagtacgccagcgtggaggccagcaagctgaagagacacgtgagaagccacaccggcgagagacccttccagtgctgccagtgcagctacgccagcagagacacctacaagctgaagagacacatgagaacccacagcggcgagaagccctacgagtgccacatctgccacaccagattcacccagagcggcaccatgaagatccacatcctgcagaagcacggcgagaacgtgcccaagtaccagtgcccccactgcgccaccatcatcgccagaaagagcgacctgagagtgcacatgagaaacctgcacgcctacagcgccgccgagctgaagtgcagatactgcagcgccgtgttccacgagagatacgccctgatccagcaccagaagacccacaagaacgagaagagattcaagtgcaagcactgcagctacgcctgcaagcaggagagacacatgaccgcccacatcagaacccacaccggcgagaagcccttcacctgcctgagctgcaacaagtgcttcagacagaagcagctgctgaacgcccacttcagaaagtaccacgacgccaacttcatccccaccgtgtacaagtgcagcaagtgcggcaagggcttcagcagatggatcaacctgcacagacacagcgagaagtgcggcagcggcgaggccaagagcgccgccagcggcaagggcagaagaaccagaaagagaaagcagaccatcctgaaggaggccaccaagggccagaaggaggccgccaagggctggaaggaggccgccaacggcgacgaggccgccgccgaggaggccagcaccaccaagggcgagcagttccccggcgagatgttccccgtggcctgcagagagaccaccgccagagtgaaggaggaggtggacgagggcgtgacctgcgagatgctgctgaacaccatggacaagtag

SEQ ID NO: 75771 - DNA, 1992 bp, Artificial Sequence; identical to SEQ ID NO: 75770
  Description of Artificial Sequence: Synthetic coding sequence

SEQ ID NO: 75772 - DNA, 1284 bp, Artificial Sequence
  Description of Artificial Sequence: Synthetic coding sequence
atggccgccaccgagatcagcgtgctgagcgagcagttcaccaagatcaaggagctggagctgatgcccgagaagggcctgaaggaggaggagaaggacggcgtgtgcagagagaaggaccacagaagccccagcgagctggaggccgagagaaccagcggcgccttccaggacagcgtgctggaggaggaggtggagctggtgctggcccccagcgaggagagcgagaagtacatcctgaccctgcagaccgtgcacttcaccagcgaggccgtggagctgcaggacatgagcctgctgagcatccagcagcaggagggcgtgcaggtggtggtgcagcagcccggccccggcctgctgtggctggaggagggccccagacagagcctgcagcagtgcgtggccatcagcatccagcaggagctgtacagcccccaggagatggaggtgctgcagttccacgccctggaggagaacgtgatggtggccagcgaggacagcaagctggccgtgagcctggccgagaccaccggcctgatcaagctggaggaggagcaggagaagaaccagctgctggccgagagaaccaaggagcagctgttcttcgtggagaccatgagcggcgacgagagaagcgacgagatcgtgctgaccgtgagcaacagcaacgtggaggagcaggaggaccagcccaccgccggccaggccgacgccgagaaggccaagagcaccaagaaccagagaaagaccaagggcgccaagggcaccttccactgcgacgtgtgcatgttcaccagcagcagaatgagcagcttcaacagacacatgaagacccacaccagcgagaagccccacctgtgccacctgtgcctgaagaccttcagaaccgtgaccctgctgagaaaccacgtgaacacccacaccggcaccagaccctacaagtgcaacgactgcaacatggccttcgtgaccagcggcgagctggtgagacacagaagatacaagcacacccacgagaagcccttcaagtgcagcatgtgcaagtacgccagcgtggaggccagcaagctgaagagacacgtgagaagccacaccggcgagagacccttccagtgctgccagtgcagctacgccagcagagacacctacaagctgaagagacacatgagaacccacagcgaggccaccagcaagagaagcctgcaggagatccccagatgcaagttccaccccgactgcctgcagatgctgcaggtgtggcagagactgttccccctggactag

SEQ ID NO: 75773 - DNA, 1722 bp, Artificial Sequence
  Description of Artificial Sequence: Synthetic coding sequence
atggccgccaccgagatcagcgtgctgagcgagcagttcaccaagatcaaggagctggagctgatgcccgagaagggcctgaaggaggaggagaaggacggcgtgtgcagagagaaggaccacagaagccccagcgagctggaggccgagagaaccagcggcgccttccaggacagcgtgctggaggaggaggtggagctggtgctggcccccagcgaggagagcgagaagtacatcctgaccctgcagaccgtgcacttcaccagcgaggccgtggagctgcaggacatgagcctgctgagcatccagcagcaggagggcgtgcaggtggtggtgcagcagcccggccccggcctgctgtggctggaggagggccccagacagagcctgcagcagtgcgtggccatcagcatccagcaggagctgtacagcccccaggagatggaggtgctgcagttccacgccctggaggagaacgtgatggtggccagcgaggacagcaagctggccgtgagcctggccgagaccaccggcctgatcaagctggaggaggagcaggagaagaaccagctgctggccgagagaaccaaggagcagctgttcttcgtggagaccatgagcggcgacgagagaagcgacgagatcgtgctgaccgtgagcaacagcaacgtggaggagcaggaggaccagcccaccgccggccaggccgacgccgagaaggccaagagcaccaagaaccagagaaagaccaagggcgccaagggcaccttccactgcgacgtgtgcatgttcaccagcagcagaatgagcagcttcaacagacacatgaagacccacaccagcgagaagccccacctgtgccacctgtgcctgaagaccttcagaaccgtgaccctgctgagaaaccacgtgaacacccacaccggcaccagaccctacaagtgcaacgactgcaacatggccttcgtgaccagcggcgagctggtgagacacagaagatacaagcacacccacgagaagcccttcaagtgcagcatgtgcaagtacgccagcgtggaggccagcaagctgaagagacacgtgagaagccacaccggcgagagacccttccagtgctgccagtgcagctacgccagcagagacacctacaagctgaagagacacatgagaacccacagcggcgagaagccctacgagtgccacatctgccacaccagattcacccagagcggcaccatgaagatccacatcctgcagaagcacggcgagaacgtgcccaagtaccagtgcccccactgcgccaccatcatcgccagaaagagcgacctgagagtgcacatgagaaacctgcacgcctacagcgccgccgagctgaagtgcagatactgcagcgccgtgttccacgagagatacgccctgatccagcaccagaagacccacaagaacgagaagagattcaagtgcaagcactgcagctacgcctgcaagcaggagagacacatgaccgcccacatcagaacccacaccggcgagaagcccttcacctgcctgagctgcaacaagtgcttcagacagaagcagctgctgaacgcccacttcagaaagtaccacgacgccaacttcatccccaccgtgtacaagtgcagcaagtgcggcaagggcttcagcagatggatcaccagcaagtggagcggcctgaagccccagaccttcatcacctag

SEQ ID NO: 75774 - DNA, 2103 bp, Artificial Sequence
  Description of Artificial Sequence: Synthetic coding sequence
atggccgccaccgagatcagcgtgctgagcgagcagttcaccaagatcaaggagctggagctgatgcccgagaagggcctgaaggaggaggagaaggacggcgtgtgcagagagaaggaccacagaagccccagcgagctggaggccgagagaaccagcggcgccttccaggacagcgtgctggaggaggaggtggagctggtgctggcccccagcgaggagagcgagaagtacatcctgaccctgcagaccgtgcacttcaccagcgaggccgtggagctgcaggacatgagcctgctgagcatccagcagcaggagggcgtgcaggtggtggtgcagcagcccggccccggcctgctgtggctggaggagggccccagacagagcctgcagcagtgcgtggccatcagcatccagcaggagctgtacagcccccaggagatggaggtgctgcagttccacgccctggaggagaacgtgatggtggccagcgaggacagcaagctggccgtgagcctggccgagaccaccggcctgatcaagctggaggaggagcaggagaagaaccagctgctggccgagagaaccaaggagcagctgttcttcgtggagaccatgagcggcgacgagagaagcgacgagatcgtgctgaccgtgagcaacagcaacgtggaggagcaggaggaccagcccaccgccggccaggccgacgccgagaaggccaagagcaccaagaaccagagaaagaccaagggcgccaagggcaccttccactgcgacgtgtgcatgttcaccagcagcagaatgagcagcttcaacagacacatgaagacccacaccagcgagaagccccacctgtgccacctgtgcctgaagaccttcagaaccgtgaccctgctgagaaaccacgtgaacacccacaccggcaccagaccctacaagtgcaacgactgcaacatggccttcgtgaccagcggcgagctggtgagacacagaagatacaagcacacccacgagaagcccttcaagtgcagcatgtgcaagtacgccagcgtggaggccagcaagctgaagagacacgtgagaagccacaccggcgagagacccttccagtgctgccagtgcagctacgccagcagagacacctacaagctgaagagacacatgagaacccacagcggcgagaagccctacgagtgccacatctgccacaccagattcacccagagcggcaccatgaagatccacatcctgcagaagcacggcgagaacgtgcccaagtaccagtgcccccactgcgccaccatcatcgccagaaagagcgacctgagagtgcacatgagaaacctgcacgcctacagcgccgccgagctgaagtgcagatactgcagcgccgtgttccacgagagatacgccctgatccagcaccagaagacccacaagaacgagaagagattcaagtgcaagcactgcagctacgcctgcaagcaggagagacacatgaccgcccacatcagaacccacaccggcgagaagcccttcacctgcctgagctgcaacaagtgcttcagacagaagcagctgctgaacgcccacttcagaaagtaccacgacgccaacttcatccccaccgtgtacaagtgcagcaagtgcggcaagggcttcagcagatggatcaacctgcacagacacagcgagaagtgcggcagcggcgaggccaagagcgccgccagcggcaagggcagaagaaccagaaagagaaagcagaccatcctgaaggaggccaccaagggccagaaggaggccgccaagggctggaaggaggccgccaacggcgacgaggccgccgccgaggaggccagcaccaccaagggcgagcagttccccggcgagatgttccccgtggcctgcagagagaccaccgccagagtgaaggaggaggtggacgagggcgtgacctgcgagatgctgctgaacaccatggacaacagcgccggctgcaccggcagaatgatgctggtgagcgcctggctgctgggcagaccccaggagacctacaaccagggcagaagaagaagaggcagcagaagagtgacctggtag

SEQ ID NO: 75775 - DNA, 1356 bp, Artificial Sequence
  Description of Artificial Sequence: Synthetic coding sequence
atggccgccaccgagatcagcgtgctgagcgagcagttcaccaagatcaaggagctggagctgatgcccgagaagggcctgaaggaggaggagaaggacggcgtgtgcagagagaaggaccacagaagccccagcgagctggaggccgagagaaccagcggcgccttccaggacagcgtgctggaggaggaggtggagctggtgctggcccccagcgaggagagcgagaagtacatcctgaccctgcagaccgtgcacttcaccagcgaggccgtggagctgcaggacatgagcctgctgagcatccagcagcaggagggcgtgcaggtggtggtgcagcagcccggccccggcctgctgtggctggaggagggccccagacagagcctgcagcagtgcgtggccatcagcatccagcaggagctgtacagcccccaggagatggaggtgctgcagttccacgccctggaggagaacgtgatggtggccagcgaggacagcaagctggccgtgagcctggccgagaccaccggcctgatcaagctggaggaggagcaggagaagaaccagctgctggccgagagaaccaaggagcagctgttcttcgtggagaccatgagcggcgacgagagaagcgacgagatcgtgctgaccgtgagcaacagcaacgtggaggagcaggaggaccagcccaccgccggccaggccgacgccgagaaggccaagagcaccaagaaccagagaaagaccaagggcgccaagggcaccttccactgcgacgtgtgcatgttcaccagcagcagaatgagcagcttcaacagacacatgaagacccacaccagcgagaagccccacctgtgccacctgtgcctgaagaccttcagaaccgtgaccctgctgagaaaccacgtgaacacccacaccggcaccagaccctacaagtgcaacgactgcaacatggccttcgtgaccagcggcgagctggtgagacacagaagatacaagcacacccacgagaagcccttcaagtgcagcatgtgcaagtacgccagcgtggaggccagcaagctgaagagacacgtgagaagccacaccggcgagagacccttccagtgctgccagtgcagctacgccagcagagacacctacaagctgaagagacacatgagaacccacagcggcgagaagccctacgagtgccacatctgccacaccagattcacccagagcggcaccatgaagatccacatcctgcagaagcacggcgagaacgtgcccaagtaccagtgcccccactgcgccaccatcatcgccagaaagagcgacctgagattcctgggcctgcccttcccctag

SEQ ID NO: 75776 - DNA, 1842 bp, Artificial Sequence
  Description of Artificial Sequence: Synthetic coding sequence
atggccgccaccgagatcagcgtgctgagcgagcagttcaccaagatcaaggagctggagctgatgcccgagaagggcctgaaggaggaggagaaggacggcgtgtgcagagagaaggaccacagaagccccagcgagctggaggccgagagaaccagcggcgccttccaggacagcgtgctggaggaggaggtggagctggtgctggcccccagcgaggagagcgagaagtacatcctgaccctgcagaccgtgcacttcaccagcgaggccgtggagctgcaggacatgagcctgctgagcatccagcagcaggagggcgtgcaggtggtggtgcagcagcccggccccggcctgctgtggctggaggagggccccagacagagcctgcagcagtgcgtggccatcagcatccagcaggagctgtacagcccccaggagatggaggtgctgcagttccacgccctggaggagaacgtgatggtggccagcgaggacagcaagctggccgtgagcctggccgagaccaccggcctgatcaagctggaggaggagcaggagaagaaccagctgctggccgagagaaccaaggagcagctgttcttcgtggagaccatgagcggcgacgagagaagcgacgagatcgtgctgaccgtgagcaacagcaacgtggaggagcaggaggaccagcccaccgccggccaggccgacgccgagaaggccaagagcaccaagaaccagagaaagaccaagggcgccaagggcaccttccactgcgacgtgtgcatgttcaccagcagcagaatgagcagcttcaacagacacatgaagacccacaccagcgagaagccccacctgtgccacctgtgcctgaagaccttcagaaccgtgaccctgctgagaaaccacgtgaacacccacaccggcaccagaccctacaagtgcaacgactgcaacatggccttcgtgaccagcggcgagctggtgagacacagaagatacaagcacacccacgagaagcccttcaagtgcagcatgtgcaagtacgccagcgtggaggccagcaagctgaagagacacgtgagaagccacaccggcgagagacccttccagtgctgccagtgcagctacgccagcagagacacctacaagctgaagagacacatgagaacccacagcggcgtgcacatgagaaacctgcacgcctacagcgccgccgagctgaagtgcagatactgcagcgccgtgttccacgagagatacgccctgatccagcaccagaagacccacaagaacgagaagagattcaagtgcaagcactgcagctacgcctgcaagcaggagagacacatgaccgcccacatcagaacccacaccggcgagaagcccttcacctgcctgagctgcaacaagtgcttcagacagaagcagctgctgaacgcccacttcagaaagtaccacgacgccaacttcatccccaccgtgtacaagtgcagcaagtgcggcaagggcttcagcagatggatcaacctgcacagacacagcgagaagtgcggcagcggcgaggccaagagcgccgccagcggcaagggcagaagaaccagaaagagaaagcagaccatcctgaaggaggccaccaagggccagaaggaggccgccaagggctggaaggaggccgccaacggcgacgaggccgccgccgaggaggccagcaccaccaagggcgagcagttccccggcgagatgttccccgtggcctgcagagagaccaccgccagagtgaaggaggaggtggacgagggcgtgacctgcgagatgctgctgaacaccatggacaagtag

SEQ ID NO: 75777 - DNA, 1452 bp, Artificial Sequence
  Description of Artificial Sequence: Synthetic coding sequence
atggccgccaccgagatcagcgtgctgagcgagcagttcaccaagatcaaggagctggagctgatgcccgagaagggcctgaaggaggaggagaaggacggcgtgtgcagagagaaggaccacagaagccccagcgagctggaggccgagagaaccagcggcgccttccaggacagcgtgctggaggaggaggtggagctggtgctggcccccagcgaggagagcgagaagtacatcctgaccctgcagaccgtgcacttcaccagcgaggccgtggagctgcaggacatgagcctgctgagcatccagcagcaggagggcgtgcaggtggtggtgcagcagcccggccccggcctgctgtggctggaggagggccccagacagagcctgcagcagtgcgtggccatcagcatccagcaggagctgtacagcccccaggagatggaggtgctgcagttccacgccctggaggagaacgtgatggtggccagcgaggacagcaagctggccgtgagcctggccgagaccaccggcctgatcaagctggaggaggagcaggagaagaaccagctgctggccgagagaaccaaggagcagctgttcttcgtggagaccatgagcggcgacgagagaagcgacgagatcgtgctgaccgtgagcaacagcaacgtggaggagcaggaggaccagcccaccgccggccaggccgacgccgagaaggccaagagcaccaagaaccagagaaagaccaagggcgccaagggcaccttccactgcgacgtgtgcatgttcaccagcagcagaatgagcagcttcaacagacacatgaagacccacaccagcgagaagccccacctgtgccacctgtgcctgaagaccttcagaaccgtgaccctgctgagaaaccacgtgaacacccacaccggcaccagaccctacaagtgcaacgactgcaacatggccttcgtgaccagcggcgagctggtgagacacagaagatacaagcacacccacgagaagcccttcaagtgcagcatgtgcaagtacgccagcgtggaggagagacacatgaccgcccacatcagaacccacaccggcgagaagcccttcacctgcctgagctgcaacaagtgcttcagacagaagcagctgctgaacgcccacttcagaaagtaccacgacgccaacttcatccccaccgtgtacaagtgcagcaagtgcggcaagggcttcagcagatggatcctgtgggtgggcaacagcgaggtggccgagctgggcggccccggcagcggccccctgctgagactgcagagcggctgcccccccggcctgcaccaccccaaggccggcctgggccccgaggaccccctgcccggccagctgagacacaccaccgccggcaccggcctgagcagcctgctgcagggccccctgtgcagagccgcctag

SEQ ID NO: 75778 - DNA, 1998 bp, Artificial Sequence
  Description of Artificial Sequence: Synthetic coding sequence
atggccgccaccgagatcagcgtgctgagcgagcagttcaccaagatcaaggagctggagctgatgcccgagaagggcctgaaggaggaggagaaggacggcgtgtgcagagagaaggaccacagaagccccagcgagctggaggccgagagaaccagcggcgccttccaggacagcgtgctggaggaggaggtggagctggtgctggcccccagcgaggagagcgagaagtacatcctgaccctgcagaccgtgcacttcaccagcgaggccgtggagctgcaggacatgagcctgctgagcatccagcagcaggagggcgtgcaggtggtggtgcagcagcccggccccggcctgctgtggctggaggagggccccagacagagcctgcagcagtgcgtggccatcagcatccagcaggagctgtacagcccccaggagatggaggtgctgcagttccacgccctggaggagaacgtgatggtggccagcgaggacagcaagctggccgtgagcctggccgagaccaccggcctgatcaagctggaggaggagcaggagaagaaccagctgctggccgagagaaccaaggagcagctgttcttcgtggagaccatgagcggcgacgagagaagcgacgagatcgtgctgaccgtgagcaacagcaacgtggaggagcaggaggaccagcccaccgccggccaggccgacgccgagaaggccaagagcaccaagaaccagagaaagaccaagggcgccaagggcaccttccactgcgacgtgtgcatgttcaccagcagcagaatgagcagcttcaacagacacatgaagacccacaccagcgagaagccccacctgtgccacctgtgcctgaagaccttcagaaccgtgaccctgctgagaaaccacgtgaacacccacaccggcaccagaccctacaagtgcaacgactgcaacatggccttcgtgaccagcggcgagctggtgagacacagaagatacaagcacacccacgagaagcccttcaagtgcagcatgtgcaagtacgccagcgtggaggccagcaagctgaagagacacgtgagaagccacaccggcgagagacccttccagtgctgccagtgcagctacgccagcagagacacctacaagctgaagagacacatgagaacccacagcggcgagaagccctacgagtgccacatctgccacaccagattcacccagagcggcaccatgaagatccacatcctgcagaagcacggcgagaacgtgcccaagtaccagtgcccccactgcgccaccatcatcgccagaaagagcgacctgagagtgcacatgagaaacctgcacgcctacagcgccgccgagctgaagtgcagatactgcagcgccgtgttccacgagagatacgccctgatccagcaccagaagacccacaagaacgagaagagattcaagtgcaagcactgcagctacgcctgcaagcaggagagacacatgaccgcccacatcagaacccacaccggcgagaagcccttcacctgcctgagctgcaacaagtgcttcagacagaagcagctgctgaacgcccacttcagaaagtaccacgacgccaacttcatccccaccgtgtacaagtgcagcaagtgcggcaagggcttcagcagatggatcaacctgcacagacacagcgagaagtgcggcagcggcgaggccaagagcgccgccagcggcaagggcagaagaaccagaaagagaaagcagaccatcctgaaggaggccaccaagggccagaaggaggccgccaagggctggaaggaggccgccaacggcgacggcgtgatcagcgcccacagaaacctgtgcctgctgggcagcagcgacagccacgccagcgtgagcggcgccggcatcaccgacgccagacaccacgcctggctgatcgtgctgctgttcctggtggagatgggcttctaccacgtgagccacagctag

SEQ ID NO: 75779 - DNA, 1212 bp, Artificial Sequence
  Description of Artificial Sequence: Synthetic coding sequence
atgttcaccagcagcagaatgagcagcttcaacagacacatgaagacccacaccagcgagaagccccacctgtgccacctgtgcctgaagaccttcagaaccgtgaccctgctgagaaaccacgtgaacacccacaccggcaccagaccctacaagtgcaacgactgcaacatggccttcgtgaccagcggcgagctggtgagacacagaagatacaagcacacccacgagaagcccttcaagtgcagcatgtgcaagtacgccagcgtggaggccagcaagctgaagagacacgtgagaagccacaccggcgagagacccttccagtgctgccagtgcagctacgccagcagagacacctacaagctgaagagacacatgagaacccacagcggcgagaagccctacgagtgccacatctgccacaccagattcacccagagcggcaccatgaagatccacatcctgcagaagcacggcgagaacgtgcccaagtaccagtgcccccactgcgccaccatcatcgccagaaagagcgacctgagagtgcacatgagaaacctgcacgcctacagcgccgccgagctgaagtgcagatactgcagcgccgtgttccacgagagatacgccctgatccagcaccagaagacccacaagaacgagaagagattcaagtgcaagcactgcagctacgcctgcaagcaggagagacacatgaccgcccacatcagaacccacaccggcgagaagcccttcacctgcctgagctgcaacaagtgcttcagacagaagcagctgctgaacgcccacttcagaaagtaccacgacgccaacttcatccccaccgtgtacaagtgcagcaagtgcggcaagggcttcagcagatggatcaacctgcacagacacagcgagaagtgcggcagcggcgaggccaagagcgccgccagcggcaagggcagaagaaccagaaagagaaagcagaccatcctgaaggaggccaccaagggccagaaggaggccgccaagggctggaaggaggccgccaacggcgacggcgtgatcagcgcccacagaaacctgtgcctgctgggcagcagcgacagccacgccagcgtgagcggcgccggcatcaccgacgccagacaccacgcctggctgatcgtgctgctgttcctggtggagatgggcttctaccacgtgagccacagctag

SEQ ID NO: 75780 - DNA, 1269 bp, Artificial Sequence
  Description of Artificial Sequence: Synthetic coding sequence
atgagcggcgacgagagaagcgacgagatcgtgctgaccgtgagcaacagcaacgtggaggagcaggaggaccagcccaccgccggccaggccgacgccgagaaggccaagagcaccaagaaccagagaaagaccaagggcgccaagggcaccttccactgcgacgtgtgcatgttcaccagcagcagaatgagcagcttcaacagacacatgaagacccacaccagcgagaagccccacctgtgccacctgtgcctgaagaccttcagaaccgtgaccctgctgagaaaccacgtgaacacccacaccggcaccagaccctacaagtgcaacgactgcaacatggccttcgtgaccagcggcgagctggtgagacacagaagatacaagcacacccacgagaagcccttcaagtgcagcatgtgcaagtacgccagcgtggaggccagcaagctgaagagacacgtgagaagccacaccggcgagagacccttccagtgctgccagtgcagctacgccagcagagacacctacaagctgaagagacacatgagaacccacagcggcgagaagccctacgagtgccacatctgccacaccagattcacccagagcggcaccatgaagatccacatcctgcagaagcacggcgagaacgtgcccaagtaccagtgcccccactgcgccaccatcatcgccagaaagagcgacctgagagtgcacatgagaaacctgcacgcctacagcgccgccgagctgaagtgcagatactgcagcgccgtgttccacgagagatacgccctgatccagcaccagaagacccacaagaacgagaagagattcaagtgcaagcactgcagctacgcctgcaagcaggagagacacatgaccgcccacatcagaacccacaccggcgagaagcccttcacctgcctgagctgcaacaagtgcttcagacagaagcagctgctgaacgcccacttcagaaagtaccacgacgccaacttcatccccaccgtgtacaagtgcagcaagtgcggcaagggcttcagcagatggatcctgtgggtgggcaacagcgaggtggccgagctgggcggccccggcagcggccccctgctgagactgcagagcggctgcccccccggcctgcaccaccccaaggccggcctgggccccgaggaccccctgcccggccagctgagacacaccaccgccggcaccggcctgagcagcctgctgcagggccccctgtgcagagccgcctag

SEQ ID NO: 75781 - DNA, 1296 bp, Artificial Sequence
  Description of Artificial Sequence: Synthetic coding sequence
atgttccacagccccagaagactgtgcagcgccctgctgcagagagacgcccccggcctgagaagactgcccgcccccggcctgagaagacccctgagcccccccgccgccgtgcccagacccgccagccccagactgctggccgccgccagcgccgccagcggcgccgccagaagctgcagcagaaccgtgtgcagcatgggcaccggcaccagcagactgtacagcgccctggccaagaccctgaacagcagcgccgccagccagcaccccgagtacctggtgagccccgaccccgagcacctggagcccatcgaccccaaggagctgctggaggagtgcagagccgtgctgcacaccagaccccccagattccagagagacttcgtggacctgagaaccgactgccccagcacccacccccccatcagagtgatgcagtggaacatcctggcccaggccctgggcgagggcaaggacaacttcgtgcagtgccccgtggaggccctgaagtgggaggagagaaagtgcctgatcctggaggagatcctggcctaccagcccgacatcctgtgcctgcaggaggtggaccactacttcgacaccttccagcccctgctgagcagactgggctaccagggcaccttcttccccaagccctggagcccctgcctggacgtggagcacaacaacggccccgacggctgcgccctgttcttcctgcagaacagattcaagctggtgaacagcgccaacatcagactgaccgccatgaccctgaagaccaaccaggtggccatcgcccagaccctggagtgcaaggagagcggcagacagttctgcatcgccgtgacccacctgaaggccagaaccggctgggagagattcagaagcgcccagggctgcgacctgctgcagaacctgcagaacatcacccagggcgccaagatccccctgatcgtgtgcggcgacttcaacgccgagcccaccgaggaggtgtacaagcacttcgccagcagcagcctgaacctgaacagcgcctacaagctgctgagcgccgacggccagagcgagcccccctacaccacctggaagatcagaaccagcggcgagtgcagacacaccctggactacatctggtacagcaagcacgccctgaacgtgagaagcgccctggacctgctgaccgaggagcagatcggccccaacagactgcccagcttcaactaccccagcgaccacctgagcctggtgtgcgacttcagcttcaccgaggagagcgacggcctgagctag

SEQ ID NO: 75782 - DNA, 2133 bp, Artificial Sequence
  Description of Artificial Sequence: Synthetic coding sequence
atgagcagaagccccgacgccaaggaggaccccgtggagtgccccctgtgcatggagcccctggagatcgacgacatcaacttcttcccctgcacctgcggctaccagatctgcagattctgctggcacagaatcagaaccgacgagaacggcctgtgccccgcctgcagaaagccctaccccgaggaccccgccgtgtacaagcccctgagccaggaggagctgcagagaatcaagaacgagaagaagcagaagcagaacgagagaaagcagaagatcagcgagaacagaaagcacctggccagcgtgagagtggtgcagaagaacctggtgttcgtggtgggcctgagccagagactggccgaccccgaggtgctgaagagacccgagtacttcggcaagttcggcaagatccacaaggtggtgatcaacaacagcaccagctacgccggcagccagggccccagcgccagcgcctacgtgacctacatcagaagcgaggacgccctgagagccatccagtgcgtgaacaacgtggtggtggacggcagaaccctgaaggccagcctgggcaccaccaagtactgcagctacttcctgaagaacatgcagtgccccaagcccgactgcatgtacctgcacgagctgggcgacgaggccgccagcttcaccaaggaggagatgcaggccggcaagcaccaggagtacgagcagaagctgctgcaggagctgtacaagctgaaccccaacttcctgcagctgagcaccggcagcgtggacaagaacaagaacaaggtgacccccctgcagagccccatcgacaagcccagcgacagcctgagcatcggcaacggcgacaacagccagcagatcagcaacagcgacacccccagccccccccccggcctgagcaagagcaaccccgtgatccccatcagcagcagcaaccacagcgccagaagccccttcgagggcgccgtgaccgagagccagagcctgttcagcgacaacttcagacaccccaaccccatccccagcggcctgccccccttccccagcagcccccagaccagcagcgactggcccaccgcccccgagccccagagcctgttcaccagcgagaccatccccgtgagcagcagcaccgactggcaggccgccttcggcttcggcagcagcaagcagcccgaggacgacctgggcttcgaccccttcgacgtgaccagaaaggccctggccgacctgatcgagaaggagctgagcgtgcaggaccagcccagcctgagccccaccagcctgcagaacagcagcagccacaccaccaccgccaagggccccggcagcggcttcctgcaccccgccgccgccaccaacgccaacagcctgaacagcaccttcagcgtgctgccccagagattcccccagttccagcagcacagagccgtgtacaacagcttcagcttccccggccaggccgccagatacccctggatggccttccccagaaacagcatcatgcacctgaaccacaccgccaaccccaccagcaacagcaacttcctggacctgaacctgcccccccagcacaacaccggcctgggcggcatccccgtggccgacaacagcagcagcgtggagagcctgaacatgaaggagtggcaggacggcctgagagccctgctgcccaacatcaacatcaacttcggcggcctgcccaacagcagcagccccagcaacgccaaccacagcgcccccaccagcaacaccgccaccaccgacagcctgagctgggacagccccggcagctggaccgaccccgccatcatcaccggcatccccgccagcagcggcaacagcctggacagcctgcaggacgacaaccccccccactggctgaagagcctgcaggccctgaccgagatggacggccccagcgccgcccccagccagacccaccacagcgcccccttcagcacccagatccccctgcacagagccagctggaacccctaccccccccccagcaaccccagcagcttccacagccccccccccggcttccagaccgccttcagaccccccagcaagacccccaccgacctgctgcagagcagcaccctggacagacactag

SEQ ID NO: 75783 - DNA, 3684 bp, Artificial Sequence
  Description of Artificial Sequence: Synthetic coding sequence
atgacccagaaggtggaggagctgaaggagaccgtgaaggaggagttcatgccctgggtgagccagtacctggtgatgaagagagtgagcatcgagcccaacttccacagcctgtacagcaacttcctggacaccctgaagaaccccgagttcaacaagatggtgctgaacgagacctacagaaacatcaaggacctggacgtgaagagcctgctgctggaggcctacgtgaagggccagcaggagctgctgtacgtggtgcccttcgtggccaaggtgctggagagcagcatcagaagcgtggtgttcagaccccccaacccctggaccatggccatcatgaacgtgctggccgagctgcaccaggagcacgacctgaagctgaacctgaagttcgagatcgaggtgctgtgcaagaacctggccctggacatcaacgagctgaagcccggcaacctgctgaaggacaaggacagactgaagaacctggacgagcagctgagcgcccccaagaaggacgtgaagcagcccgaggagctgccccccatcaccaccaccaccaccagcaccacccccgccaccaacaccacctgcaccgccaccgtgcccccccagccccagtacagctaccacgacatcaacgtgtacagcctggccggcctggccccccacatcaccctgaaccccaccatccccctgttccaggcccacccccagctgaagcagtgcgtgagacaggccatcgagagagccgtgcaggagctggtgcaccccgtggtggacagaagcatcaagatcgccatgaccacctgcgagcagatcgtgagaaaggacttcgccctggacagcgaggagagcagaatgagaatcgccgcccaccacatgatgagaaacctgaccgccggcatggccatgatcacctgcagagagcccctgctgatgagcatcagcaccaacctgaagaacagcttcgccagcgccctgagaaccgccagcccccagcagagagagatgatggaccaggccgccgcccagctggcccaggacaactgcgagctggcctgctgcttcatccagaagaccgccgtggagaaggccggccccgagatggacaagagactggccaccgagttcgagctgagaaagcacgccagacaggagggcagaagatactgcgaccccgtggtgctgacctaccaggccgagagaatgcccgagcagatcagactgaaggtgggcggcgtggaccccaagcagctggccgtgtacgaggagttcgccagaaacgtgcccggcttcctgcccaccaacgacctgagccagcccaccggcttcctggcccagcccatgaagcaggcctgggccaccgacgacgtggcccagatctacgacaagtgcatcaccgagctggagcagcacctgcacgccatcccccccaccctggccatgaacccccaggcccaggccctgagaagcctgctggaggtggtggtgctgagcagaaacagcagagacgccatcgccgccctgggcctgctgcagaaggccgtggagggcctgctggacgccaccagcggcgccgacgccgacctgctgctgagatacagagagtgccacctgctggtgctgaaggccctgcaggacggcagagcctacggcagcccctggtgcaacaagcagatcaccagatgcctgatcgagtgcagagacgagtacaagtacaacgtggaggccgtggagctgctgatcagaaaccacctggtgaacatgcagcagtacgacctgcacctggcccagagcatggagaacggcctgaactacatggccgtggccttcgccatgcagctggtgaagatcctgctggtggacgagagaagcgtggcccacgtgaccgaggccgacctgttccacaccatcgagaccctgatgagaatcaacgcccacagcagaggcaacgcccccgagggcctgccccagctgatggaggtggtgagaagcaactacgaggccatgatcgacagagcccacggcggccccaacttcatgatgcacagcggcatcagccaggccagcgagtacgacgacccccccggcctgagagagaaggccgagtacctgctgagagagtgggtgaacctgtaccacagcgccgccgccggcagagacagcaccaaggccttcagcgccttcgtgggccagatgcaccagcagggcatcctgaagaccgacgacctgatcaccagattcttcagactgtgcaccgagatgtgcgtggagatcagctacagagcccaggccgagcagcagcacaaccccgccgccaaccccaccatgatcagagccaagtgctaccacaacctggacgccttcgtgagactgatcgccctgctggtgaagcacagcggcgaggccaccaacaccgtgaccaagatcaacctgctgaacaaggtgctgggcatcgtggtgggcgtgctgctgcaggaccacgacgtgagacagagcgagttccagcagctgccctaccacagaatcttcatcatgctgctgctggagctgaacgcccccgagcacgtgctggagaccatcaacttccagaccctgaccgccttctgcaacaccttccacatcctgagacccaccaaggcccccggcttcgtgtacgcctggctggagctgatcagccacagaatcttcatcgccagaatgctggcccacaccccccagcagaagggctggcccatgtacgcccagctgctgatcgacctgttcaagtacctggcccccttcctgagaaacgtggagctgaccaagcccatgcagatcctgtacaagggcaccctgagagtgctgctggtgctgctgcacgacttccccgagttcctgtgcgactaccactacggcttctgcgacgtgatcccccccaactgcatccagctgagaaacctgatcctgagcgccttccccagaaacatgagactgcccgaccccttcacccccaacctgaaggtggacatgctgagcgagatcaacatcgcccccagaatcctgaccaacttcaccggcgtgatgcccccccagttcaagaaggacctggacagctacctgaagaccagaagccccgtgaccttcctgagcgacctgagaagcaacctgcaggtgagcaacgagcccggcaacagatacaacctgcagctgatcaacgccctggtgctgtacgtgggcacccaggccatcgcccacatccacaacaagggcagcacccccagcatgagcaccatcacccacagcgcccacatggacatcttccagaacctggccgtggacctggacaccgagggcagatacctgttcctgaacgccatcgccaaccagctgagataccccaacagccacacccactacttcagctgcaccatgctgtacctgttcgccgaggccaacaccgaggccatccaggagcagatcaccagagtgctgctggagagactgatcgtgaacagaccccacccctggggcctgctgatcaccttcatcgagctgatcaagaaccccgccttcaagttctggaaccacgagttcgtgcactgcgcccccgagatcgagaagctgttccagagcgtggcccagtgctgcatgggccagaagcaggcccagcaggtgatggagggcaccggcgccagctag

SEQ ID NO: 75784 - DNA, 7131 bp, Artificial Sequence
  Description of Artificial Sequence: Synthetic coding sequence
atgaacctggacagcctgagcctggccctgagccagatcagctacctggtggacaacctgaccaagaagaactacagagccagccagcaggagatccagcacatcgtgaacagacacggccccgaggccgacagacacctgctgagatgcctgttcagccacgtggacttcagcggcgacggcaagagcagcggcaaggacttccaccagacccagttcctgatccaggagtgcgccctgctgatcaccaagcccaacttcatcagcaccctgagctacgccatcgacaaccccctgcactaccagaagagcctgaagcccgccccccacctgttcgcccagctgagcaaggtgctgaagctgagcaaggtgcaggaggtgatcttcggcctggccctgctgaacagcagcagcagcgacctgagaggcttcgccgcccagttcatcaagcagaagctgcccgacctgctgagaagctacatcgacgccgacgtgagcggcaaccaggagggcggcttccaggacatcgccatcgaggtgctgcacctgctgctgagccacctgctgttcggccagaagggcgccttcggcgtgggccaggagcagatcgacgccttcctgaagaccctgagaagagacttcccccaggagagatgccccgtggtgctggcccccctgctgtaccccgagaagagagacatcctgatggacagaatcctgcccgacagcggcggcgtggccaagaccatgatggagagcagcctggccgacttcatgcaggaggtgggctacggcttctgcgccagcatcgaggagtgcagaaacatcatcgtgcagttcggcgtgagagaggtgaccgccgcccaggtggccagagtgctgggcatgatggccagaacccacagcggcctgaccgacggcatccccctgcagagcatcagcgcccccggcagcggcatctggagcgacggcaaggacaagagcgacggcgcccaggcccacacctggaacgtggaggtgctgatcgacgtgctgaaggagctgaaccccagcctgaacttcaaggaggtgacctacgagctggaccaccccggcttccagatcagagacagcaagggcctgcacaacgtggtgtacggcatccagagaggcctgggcatggaggtgttccccgtggacctgatctacagaccctggaagcacgccgagggccagctgagcttcatccagcacagcctgatcaaccccgagatcttctgcttcgccgactacccctgccacaccgtggccaccgacatcctgaaggccccccccgaggacgacaacagagagatcgccacctggaagagcctggacctgatcgagagcctgctgagactggccgaggtgggccagtacgagcaggtgaagcagctgttcagcttccccatcaagcactgccccgacatgctggtgctggccctgctgcagatcaacaccagctggcacaccctgagacacgagctgatcagcaccctgatgcccatcttcctgggcaaccaccccaacagcgccatcatcctgcactacgcctggcacggccagggccagagccccagcatcagacagctgatcatgcacgccatggccgagtggtacatgagaggcgagcagtacgaccaggccaagctgagcagaatcctggacgtggcccaggacctgaaggccctgagcatgctgctgaacggcacccccttcgccttcgtgatcgacctggccgccctggccagcagaagagagtacctgaagctggacaagtggctgaccgacaagatcagagagcacggcgagcccttcatccaggcctgcatgaccttcctgaagagaagatgccccagcatcctgggcggcctggcccccgagaaggaccagcccaagagcgcccagctgccccccgagaccctggccaccatgctggcctgcctgcaggcctgcgccggcagcgtgagccaggagctgagcgagaccatcctgaccatggtggccaactgcagcaacgtgatgaacaaggccagacagcccccccccggcgtgatgcccaagggcagaccccccagcgccagcagcctggacgccatcagccccgtgcagatcgaccccctggccggcatgaccagcctgagcatcggcggcagcgccgccccccacacccagagcatgcagggcttcccccccaacctgggcagcgccttcagcaccccccagagccccgccaaggccttcccccccctgagcacccccaaccagaccaccgccttcagcggcatcggcggcctgagcagccagctgcccgtgggcggcctgggcaccggcagcctgaccggcatcggcaccggcgccctgggcctgcccgccgtgaacaacgaccccttcgtgcagagaaagctgggcaccagcggcctgaaccagcccaccttccagcagagcaagatgaagcccagcgacctgagccaggtgtggcccgaggccaaccagcacttcagcaaggagatcgacgacgaggccaacagctacttccagagaatctacaaccaccccccccaccccaccatgagcgtggacgaggtgctggagatgctgcagagattcaaggacagcaccatcaagagagagagagaggtgttcaactgcatgctgagaaacctgttcgaggagtacagattcttcccccagtaccccgacaaggagctgcacatcaccgcctgcctgttcggcggcatcatcgagaagggcctggtgacctacatggccctgggcctggccctgagatacgtgctggaggccctgagaaagcccttcggcagcaagatgtactacttcggcatcgccgccctggacagattcaagaacagactgaaggactacccccagtactgccagcacctggccagcatcagccacttcatgcagttcccccaccacctgcaggagtacatcgagtacggccagcagagcagagacccccccgtgaagatgcagggcagcatcaccacccccggcagcatcgccctggcccaggcccaggcccaggcccaggtgcccgccaaggcccccctggccggccaggtgagcaccatggtgaccaccagcaccaccaccaccgtggccaagaccgtgaccgtgaccagacccaccggcgtgagcttcaagaaggacgtgccccccagcatcaacaccaccaacatcgacaccctgctggtggccaccgaccagaccgagagaatcgtggagccccccgagaacatccaggagaagatcgccttcatcttcaacaacctgagccagagcaacatgacccagaaggtggaggagctgaaggagaccgtgaaggaggagttcatgccctgggtgagccagtacctggtgatgaagagagtgagcatcgagcccaacttccacagcctgtacagcaacttcctggacaccctgaagaaccccgagttcaacaagatggtgctgaacgagacctacagaaacatcaaggtgctgctgaccagcgacaaggccgccgccaacttcagcgacagaagcctgctgaagaacctgggccactggctgggcatgatcaccctggccaagaacaagcccatcctgcacaccgacctggacgtgaagagcctgctgctggaggcctacgtgaagggccagcaggagctgctgtacgtggtgcccttcgtggccaaggtgctggagagcagcatcagaagcgtggtgttcagaccccccaacccctggaccatggccatcatgaacgtgctggccgagctgcaccaggagcacgacctgaagctgaacctgaagttcgagatcgaggtgctgtgcaagaacctggccctggacatcaacgagctgaagcccggcaacctgctgaaggacaaggacagactgaagaacctggacgagcagctgagcgcccccaagaaggacgtgaagcagcccgaggagctgccccccatcaccaccaccaccaccagcaccacccccgccaccaacaccacctgcaccgccaccgtgcccccccagccccagtacagctaccacgacatcaacgtgtacagcctggccggcctggccccccacatcaccctgaaccccaccatccccctgttccaggcccacccccagctgaagcagtgcgtgagacaggccatcgagagagccgtgcaggagctggtgcaccccgtggtggacagaagcatcaagatcgccatgaccacctgcgagcagatcgtgagaaaggacttcgccctggacagcgaggagagcagaatgagaatcgccgcccaccacatgatgagaaacctgaccgccggcatggccatgatcacctgcagagagcccctgctgatgagcatcagcaccaacctgaagaacagcttcgccagcgccctgagaaccgccagcccccagcagagagagatgatggaccaggccgccgcccagctggcccaggacaactgcgagctggcctgctgcttcatccagaagaccgccgtggagaaggccggccccgagatggacaagagactggccaccgagttcgagctgagaaagcacgccagacaggagggcagaagatactgcgaccccgtggtgctgacctaccaggccgagagaatgcccgagcagatcagactgaaggtgggcggcgtggaccccaagcagctggccgtgtacgaggagttcgccagaaacgtgcccggcttcctgcccaccaacgacctgagccagcccaccggcttcctggcccagcccatgaagcaggcctgggccaccgacgacgtggcccagatctacgacaagtgcatcaccgagctggagcagcacctgcacgccatcccccccaccctggccatgaacccccaggcccaggccctgagaagcctgctggaggtggtggtgctgagcagaaacagcagagacgccatcgccgccctgggcctgctgcagaaggccgtggagggcctgctggacgccaccagcggcgccgacgccgacctgctgctgagatacagagagtgccacctgctggtgctgaaggccctgcaggacggcagagcctacggcagcccctggtgcaacaagcagatcaccagatgcctgatcgagtgcagagacgagtacaagtacaacgtggaggccgtggagctgctgatcagaaaccacctggtgaacatgcagcagtacgacctgcacctggcccagagcatggagaacggcctgaactacatggccgtggccttcgccatgcagctggtgaagatcctgctggtggacgagagaagcgtggcccacgtgaccgaggccgacctgttccacaccatcgagaccctgatgagaatcaacgcccacagcagaggcaacgcccccgagggcctgccccagctgatggaggtggtgagaagcaactacgaggccatgatcgacagagcccacggcggccccaacttcatgatgcacagcggcatcagccaggccagcgagtacgacgacccccccggcctgagagagaaggccgagtacctgctgagagagtgggtgaacctgtaccacagcgccgccgccggcagagacagcaccaaggccttcagcgccttcgtgggccagatgcaccagcagggcatcctgaagaccgacgacctgatcaccagattcttcagactgtgcaccgagatgtgcgtggagatcagctacagagcccaggccgagcagcagcacaaccccgccgccaaccccaccatgatcagagccaagtgctaccacaacctggacgccttcgtgagactgatcgccctgctggtgaagcacagcggcgaggccaccaacaccgtgaccaagatcaacctgctgaacaaggtgctgggcatcgtggtgggcgtgctgctgcaggaccacgacgtgagacagagcgagttccagcagctgccctaccacagaatcttcatcatgctgctgctggagctgaacgcccccgagcacgtgctggagaccatcaacttccagaccctgaccgccttctgcaacaccttccacatcctgagacccaccaaggcccccggcttcgtgtacgcctggctggagctgatcagccacagaatcttcatcgccagaatgctggcccacaccccccagcagaagggctggcccatgtacgcccagctgctgatcgacctgttcaagtacctggcccccttcctgagaaacgtggagctgaccaagcccatgcagatcctgtacaagggcaccctgagagtgctgctggtgctgctgcacgacttccccgagttcctgtgcgactaccactacggcttctgcgacgtgatcccccccaactgcatccagctgagaaacctgatcctgagcgccttccccagaaacatgagactgcccgaccccttcacccccaacctgaaggtggacatgctgagcgagatcaacatcgcccccagaatcctgaccaacttcaccggcgtgatgcccccccagttcaagaaggacctggacagctacctgaagaccagaagccccgtgaccttcctgagcgacctgagaagcaacctgcaggtgagcaacgagcccggcaacagatacaacctgcagctgatcaacgccctggtgctgtacgtgggcacccaggccatcgcccacatccacaacaagggcagcacccccagcatgagcaccatcacccacagcgcccacatggacatcttccagaacctggccgtggacctggacaccgagggcagatacctgttcctgaacgccatcgccaaccagctgagataccccaacagccacacccactacttcagctgcaccatgctgtacctgttcgccgaggccaacaccgaggccatccaggagcagatcaccagagtgctgctggagagactgatcgtgaacagaccccacccctggggcctgctgatcaccttcatcgagctgatcaagaaccccgccttcaagttctggaaccacgagttcgtgcactgcgcccccgagatcgagaagctgttccagagcgtggcccagtgctgcatgggccagaagcaggcccagcaggtgatggagggcaccggcgccagctag

SEQ ID NO: 75785 - DNA, 6453 bp, Artificial Sequence
  Description of Artificial Sequence: Synthetic coding sequence
atgaacctggacagcctgagcctggccctgagccagatcagctacctggtggacaacctgaccaagaagaactacagagccagccagcaggagatccagcacatcgtgaacagacacggccccgaggccgacagacacctgctgagatgcctgttcagccacgtggacttcagcggcgacggcaagagcagcggcaaggacttccaccagacccagttcctgatccaggagtgcgccctgctgatcaccaagcccaacttcatcagcaccctgagctacgccatcgacaaccccctgcactaccagaagagcctgaagcccgccccccacctgttcgcccagctgagcaaggtgctgaagctgagcaaggtgcaggaggtgatcttcggcctggccctgctgaacagcagcagcagcgacctgagaggcttcgccgcccagttcatcaagcagaagctgcccgacctgctgagaagctacatcgacgccgacgtgagcggcaaccaggagggcggcttccaggacatcgccatcgaggtgctgcacctgctgctgagccacctgctgttcggccagaagggcgccttcggcgtgggccaggagcagatcgacgccttcctgaagaccctgagaagagacttcccccaggagagatgccccgtggtgctggcccccctgctgtaccccgagaagagagacatcctgatggacagaatcctgcccgacagcggcggcgtggccaagaccatgatggagagcagcctggccgacttcatgcaggaggtgggctacggcttctgcgccagcatcgaggagtgcagaaacatcatcgtgcagttcggcgtgagagaggtgaccgccgcccaggtggccagagtgctgggcatgatggccagaacccacagcggcctgaccgacggcatccccctgcagagcatcagcgcccccggcagcggcatctggagcgacggcaaggacaagagcgacggcgcccaggcccacacctggaacgtggaggtgctgatcgacgtgctgaaggagctgaaccccagcctgaacttcaaggaggtgacctacgagctggaccaccccggcttccagatcagagacagcaagggcctgcacaacgtggtgtacggcatccagagaggcctgggcatggaggtgttccccgtggacctgatctacagaccctggaagcacgccgagggccagctgagcttcatccagcacagcctgatcaaccccgagatcttctgcttcgccgactacccctgccacaccgtggccaccgacatcctgaaggccccccccgaggacgacaacagagagatcgccacctggaagagcctggacctgatcgagagcctgctgagactggccgaggtgggccagtacgagcaggtgaagcagctgttcagcttccccatcaagcactgccccgacatgctggtgctggccctgctgcagatcaacaccagctggcacaccctgagacacgagctgatcagcaccctgatgcccatcttcctgggcaaccaccccaacagcgccatcatcctgcactacgcctggcacggccagggccagagccccagcatcagacagctgatcatgcacgccatggccgagtggtacatgagaggcgagcagtacgaccaggccaagctgagcagaatcctggacgtggcccaggacctgaaggccctgagcatgctgctgaacggcacccccttcgccttcgtgatcgacctggccgccctggccagcagaagagagtacctgaagctggacaagtggctgaccgacaagatcagagagcacggcgagcccttcatccaggcctgcatgaccttcctgaagagaagatgccccagcatcctgggcggcctggcccccgagaaggaccagcccaagagcgcccagctgccccccgagaccctggccaccatgctggcctgcctgcaggcctgcgccggcagcgtgagccaggagctgagcgagaccatcctgaccatggtggccaactgcagcaacgtgatgaacaaggccagacagcccccccccggcgtgatgcccaagggcagaccccccagcgccagcagcctggacgccatcagccccgtgcagatcgaccccctggccggcatgaccagcctgagcatcggcggcagcgccgccccccacacccagagcatgcagggcttcccccccaacctgggcagcgccttcagcaccccccagagccccgccaaggccttcccccccctgagcacccccaaccagaccaccgccttcagcggcatcggcggcctgagcagccagctgcccgtgggcggcctgggcaccggcagcctgaccggcatcggcaccggcgccctgggcctgcccgccgtgaacaacgaccccttcgtgcagagaaagctgggcaccagcggcctgaaccagcccaccttccagcagaccgacctgagccaggtgtggcccgaggccaaccagcacttcagcaaggagatcgacgacgaggccaacagctacttccagagaatctacaaccaccccccccaccccaccatgagcgtggacgaggtgctggagatgctgcagagattcaaggacagcaccatcaagagagagagagaggtgttcaactgcatgctgagaaacctgttcgaggagtacagattcttcccccagtaccccgacaaggagctgcacatcaccgcctgcctgttcggcggcatcatcgagaagggcctggtgacctacatggccctgggcctggccctgagatacgtgctggaggccctgagaaagcccttcggcagcaagatgtactacttcggcatcgccgccctggacagattcaagaacagactgaaggactacccccagtactgccagcacctggccagcatcagccacttcatgcagttcccccaccacctgcaggagtacatcgagtacggccagcagagcagagacccccccgtgaagatgcagggcagcatcaccacccccggcagcatcgccctggcccaggcccaggcccaggcccaggtgcccgccaaggcccccctggccggccaggtgagcaccatggtgaccaccagcaccaccaccaccgtggccaagaccgtgaccgtgaccagacccaccggcgtgagcttcaagaaggacgtgccccccagcatcaacaccaccaacatcgacaccctgctggtggccaccgaccagaccgagagaatcgtggagccccccgagaacatccaggagaagatcgccttcatcttcaacaacctgagccagagcaacatgacccagaaggtggaggagctgaaggagaccgtgaaggaggagttcatgccctgggtgagccagtacctggtgatgaagagagtgagcatcgagcccaacttccacagcctgtacagcaacttcctggacaccctgaagaaccccgagttcaacaagatggtgctgaacgagacctacagaaacatcaaggtgctgctgaccagcgacaaggccgccgccaacttcagcgacagaagcctgctgaagaacctgggccactggctgggcatgatcaccctggccaagaacaagcccatcctgcacaccgacctggacgtgaagagcctgctgctggaggcctacgtgaagggccagcaggagctgctgtacgtggtgcccttcgtggccaaggtgctggagagcagcatcagaagcgtggtgttcagaccccccaacccctggaccatggccatcatgaacgtgctggccgagctgcaccaggagcacgacctgaagctgaacctgaagttcgagatcgaggtgctgtgcaagaacctggccctggacatcaacgagctgaagcccggcaacctgctgaaggacaaggacagactgaagaacctggacgagcagctgagcgcccccaagaaggacgtgaagcagcccgaggagctgccccccatcaccaccaccaccaccagcaccacccccgccaccaacaccacctgcaccgccaccgtgcccccccagccccagtacagctaccacgacatcaacgtgtacagcctggccggcctggccccccacatcaccctgaaccccaccatccccctgttccaggcccacccccagctgaagcagtgcgtgagacaggccatcgagagagccgtgcaggagctggtgcaccccgtggtggacagaagcatcaagatcgccatgaccacctgcgagcagatcgtgagaaaggacttcgccctggacagcgaggagagcagaatgagaatcgccgcccaccacatgatgagaaacctgaccgccggcatggccatgatcacctgcagagagcccctgctgatgagcatcagcaccaacctgaagaacagcttcgccagcgccctgagaaccgccagcccccagcagagagagatgatggaccaggccgccgcccagctggcccaggacaactgcgagctggcctgctgcttcatccagaagaccgccgtggagaaggccggccccgagatggacaagagactggccaccgagttcgagctgagaaagcacgccagacaggagggcagaagatactgcgaccccgtggtgctgacctaccaggccgagagaatgcccgagcagatcagactgaaggtgggcggcgtggaccccaagcagctggccgtgtacgaggagttcgccagaaacgtgcccggcttcctgcccaccaacgacctgagccagcccaccggcttcctggcccagcccatgaagcaggcctgggccaccgacgacgtggcccagatctacgacaagtgcatcaccgagctggagcagcacctgcacgccatcccccccaccctggccatgaacccccaggcccaggccctgagaagcctgctggaggtggtggtgctgagcagaaacagcagagacgccatcgccgccctgggcctgctgcagaaggccgtggagggcctgctggacgccaccagcggcgccgacgccgacctgctgctgagatacagagagtgccacctgctggtgctgaaggccctgcaggacggcagagcctacggcagcccctggtgcaacaagcagatcaccagatgcctgatcgagtgcagagacgagtacaagtacaacgtggaggccgtggagctgctgatcagaaaccacctggtgaacatgcagcagtacgacctgcacctggcccagagcatggagaacggcctgaactacatggccgtggccttcgccatgcagctggtgaagatcctgctggtggacgagagaagcgtggcccacgtgaccgaggccgacctgttccacaccatcgagaccctgatgagaatcaacgcccacagcagaggcaacgcccccgagggcctgccccagctgatggaggtggtgagaagcaactacgaggccatgatcgacagagcccacggcggccccaacttcatgatgcacagcggcatcagccaggccagcgagtacgacgacccccccggcctgagagagaaggccgagtacctgctgagagagtgggtgaacctgtaccacagcgccgccgccggcagagacagcaccaaggccttcagcgccttcgtgggccagatgcaccagcagggcatcctgaagaccgacgacctgatcaccagattcttcagactgtgcaccgagatgtgcgtggagatcagctacagagcccaggccgagcagcagcacaaccccgccgccaaccccaccatgatcagagccaagtgctaccacaacctggacgccttcgtgagactgatcgccctgctggtgaagcacagcggcgaggccaccaacaccgtgaccaagatcaacctgctgaacaaggtgctgggcatcgtggtgggcgtgctgctgcaggaccacgacgtgagacagagcgagttccagcagctgccctaccacagaatcttcatcatgctgctgctggagctgaacgcccccgagcacgtgctggagaccatcaacttccagaccctgaccgccttctgcaacaccttccacatcctgagacccaccaaggcccccggcttcgtgtacgcctggctggagctgatcagccacagaatcttcatcgccagaatgctggcccacaccccccagcagaagggctggcccatgtacgcccagctgctgatcgacctgttcaagtacctggcccccttcctgagaaacgtggagctgaccaagcccatgcagatcctgtacaagggcaccctgagagtgctgctggtgctgctgcacgacttccccgagttcctgtgcgactaccactacggcttctgcgacgtgatcccccccaactgcatccagctgagaaacctgatcctgagcgccttccccagaaacatgagactgcccgaccccttcacccccaacctgaaggagatcatgctgtag

SEQ ID NO: 75786 - DNA, 3213 bp, Artificial Sequence
  Description of Artificial Sequence: Synthetic coding sequence
atgctgctgaacggcacccccttcgccttcgtgatcgacctggccgccctggccagcagaagagagtacctgaagctggacaagtggctgaccgacaagatcagagagcacggcgagcccttcatccaggcctgcatgaccttcctgaagagaagatgccccagcatcctgggcggcctggcccccgagaaggaccagcccaagagcgcccagctgccccccgagaccctggccaccatgctggcctgcctgcaggcctgcgccggcagcgtgagccaggagctgagcgagaccatcctgaccatggtggccaactgcagcaacgtgatgaacaaggccagacagcccccccccggcgtgatgcccaagggcagaccccccagcgccagcagcctggacgccatcagccccgtgcagatcgaccccctggccggcatgaccagcctgagcatcggcggcagcgccgccccccacacccagagcatgcagggcttcccccccaacctgggcagcgccttcagcaccccccagagccccgccaaggccttcccccccctgagcacccccaaccagaccaccgccttcagcggcatcggcggcctgagcagccagctgcccgtgggcggcctgggcaccggcagcctgaccggcatcggcaccggcgccctgggcctgcccgccgtgaacaacgaccccttcgtgcagagaaagctgggcaccagcggcctgaaccagcccaccttccagcagagcaagatgaagcccagcgacctgagccaggtgtggcccgaggccaaccagcacttcagcaaggagatcgacgacgaggccaacagctacttccagagaatctacaaccaccccccccaccccaccatgagcgtggacgaggtgctggagatgctgcagagattcaaggacagcaccatcaagagagagagagaggtgttcaactgcatgctgagaaacctgttcgaggagtacagattcttcccccagtaccccgacaaggagctgcacatcaccgcctgcctgttcggcggcatcatcgagaagggcctggtgacctacatggccctgggcctggccctgagatacgtgctggaggccctgagaaagcccttcggcagcaagatgtactacttcggcatcgccgccctggacagattcaagaacagactgaaggactacccccagtactgccagcacctggccagcatcagccacttcatgcagttcccccaccacctgcaggagtacatcgagtacggccagcagagcagagacccccccgtgaagatgcagggcagcatcaccacccccggcagcatcgccctggcccaggcccaggcccaggcccaggtgcccgccaaggcccccctggccggccaggtgagcaccatggtgaccaccagcaccaccaccaccgtggccaagaccgtgaccgtgaccagacccaccggcgtgagcttcaagaaggacgtgccccccagcatcaacaccaccaacatcgacaccctgctggtggccaccgaccagaccgagagaatcgtggagccccccgagaacatccaggagaagatcgccttcatcttcaacaacctgagccagagcaacatgacccagaaggtggaggagctgaaggagaccgtgaaggaggagttcatgccctgggtgagccagtacctggtgatgaagagagtgagcatcgagcccaacttccacagcctgtacagcaacttcctggacaccctgaagaacctgatcaccagattcttcagactgtgcaccgagatgtgcgtggagatcagctacagagcccaggccgagcagcagcacaaccccgccgccaaccccaccatgatcagagccaagtgctaccacaacctggacgccttcgtgagactgatcgccctgctggtgaagcacagcggcgaggccaccaacaccgtgaccaagatcaacctgctgaacaaggtgctgggcatcgtggtgggcgtgctgctgcaggaccacgacgtgagacagagcgagttccagcagctgccctaccacagaatcttcatcatgctgctgctggagctgaacgcccccgagcacgtgctggagaccatcaacttccagaccctgaccgccttctgcaacaccttccacatcctgagacccaccaaggcccccggcttcgtgtacgcctggctggagctgatcagccacagaatcttcatcgccagaatgctggcccacaccccccagcagaagggctggcccatgtacgcccagctgctgatcgacctgttcaagtacctggcccccttcctgagaaacgtggagctgaccaagcccatgcagatcctgtacaagggcaccctgagagtgctgctggtgctgctgcacgacttccccgagttcctgtgcgactaccactacggcttctgcgacgtgatcccccccaactgcatccagctgagaaacctgatcctgagcgccttccccagaaacatgagactgcccgaccccttcacccccaacctgaaggtggacatgctgagcgagatcaacatcgcccccagaatcctgaccaacttcaccggcgtgatgcccccccagttcaagaaggacctggacagctacctgaagaccagaagccccgtgaccttcctgagcgacctgagaagcaacctgcaggtgagcaacgagcccggcaacagatacaacctgcagctgatcaacgccctggtgctgtacgtgggcacccaggccatcgcccacatccacaacaagggcagcacccccagcatgagcaccatcacccacagcgcccacatggacatcttccagaacctggccgtggacctggacaccgagggcagatacctgttcctgaacgccatcgccaaccagctgagataccccaacagccacacccactacttcagctgcaccatgctgtacctgttcgccgaggccaacaccgaggccatccaggagcagatcaccagagtgctgctggagagactgatcgtgaacagaccccacccctggggcctgctgatcaccttcatcgagctgatcaagaaccccgccttcaagttctggaaccacgagttcgtgcactgcgcccccgagatcgagaagctgttccagagcgtggcccagtgctgcatgggccagaagcaggcccagcaggtgatggagggcaccggcgccagctag

SEQ ID NO: 75787 - DNA, 4656 bp, Artificial Sequence
  Description of Artificial Sequence: Synthetic coding sequence
atgaacctggacagcctgagcctggccctgagccagatcagctacctggtggacaacctgaccaagaagaactacagagccagccagcaggagatccagcacatcgtgaacagacacggccccgaggccgacagacacctgctgagatgcctgttcagccacgtggacttcagcggcgacggcaagagcagcggcaaggacttccaccagacccagttcctgatccaggagtgcgccctgctgatcaccaagcccaacttcatcagcaccctgagctacgccatcgacaaccccctgcactaccagaagagcctgaagcccgccccccacctgttcgcccagctgagcaaggtgctgaagctgagcaaggtgcaggaggtgatcttcggcctggccctgctgaacagcagcagcagcgacctgagaggcttcgccgcccagttcatcaagcagaagctgcccgacctgctgagaagctacatcgacgccgacgtgagcggcaaccaggagggcggcttccaggacatcgccatcgaggtgctgcacctgctgctgagccacctgctgttcggccagaagggcgccttcggcgtgggccaggagcagatcgacgccttcctgaagaccctgagaagagacttcccccaggagagatgccccgtggtgctggcccccctgctgtaccccgagaagagagacatcctgatggacagaatcctgcccgacagcggcggcgtggccaagaccatgatggagagcagcctggccgacttcatgcaggaggtgggctacggcttctgcgccagcatcgaggagtgcagaaacatcatcgtgcagttcggcgtgagagaggtgaccgccgcccaggtggccagagtgctgggcatgatggccagaacccacagcggcctgaccgacggcatccccctgcagagcatcagcgcccccggcagcggcatctggagcgacggcaaggacaagagcgacggcgcccaggcccacacctggaacgtggaggtgctgatcgacgtgctgaaggagctgaaccccagcctgaacttcaaggaggtgacctacgagctggaccaccccggcttccagatcagagacagcaagggcctgcacaacgtggtgtacggcatccagagaggcctgggcatggaggtgttccccgtggacctgatctacagaccctggaagcacgccgagggccagctgagcttcatccagcacagcctgatcaaccccgagatcttctgcttcgccgactacccctgccacaccgtggccaccgacatcctgaaggccccccccgaggacgacaacagagagatcgccacctggaagagcctggacctgatcgagagcctgctgagactggccgaggtgggccagtacgagcaggtgaagcagctgttcagcttccccatcaagcactgccccgacatgctggtgctggccctgctgcagatcaacaccagctggcacaccctgagacacgagctgatcagcaccctgatgcccatcttcctgggcaaccaccccaacagcgccatcatcctgcactacgcctggcacggccagggccagagccccagcatcagacagctgatcatgcacgccatggccgagtggtacatgagaggcgagcagtacgaccaggccaagctgagcagaatcctggacgtggcccaggacctgaaggccctgagcatgctgctgaacggcacccccttcgccttcgtgatcgacctggccgccctggccagcagaagagagtacctgaagctggacaagtggctgaccgacaagatcagagagcacggcgagcccttcatccaggcctgcatgaccttcctgaagagaagatgccccagcatcctgggcggcctggcccccgagaaggaccagcccaagagcgcccagctgccccccgagaccctggccaccatgctggcctgcctgcaggcctgcgccggcagcgtgagccaggagctgagcgagaccatcctgaccatggtggccaactgcagcaacgtgatgaacaaggccagacagcccccccccggcgtgatgcccaagggcagaccccccagcgccagcagcctggacgccatcagccccgtgcagatcgaccccctggccggcatgaccagcctgagcatcggcggcagcgccgccccccacacccagagcatgcagggcttcccccccaacctgggcagcgccttcagcaccccccagagccccgccaaggccttcccccccctgagcacccccaaccagaccaccgccttcagcggcatcggcggcctgagcagccagctgcccgtgggcggcctgggcaccggcagcctgaccggcatcggcaccggcgccctgggcctgcccgccgtgaacaacgaccccttcgtgcagagaaagctgggcaccagcggcctgaaccagcccaccttccagcagagcaagatgaagcccagcgacctgagccaggtgtggcccgaggccaaccagcacttcagcaaggagatcgacgacgaggccaacagctacttccagagaatctacaaccaccccccccaccccaccatgagcgtggacgaggtgctggagatgctgcagagattcaaggacagcaccatcaagagagagagagaggtgttcaactgcatgctgagaaacctgttcgaggagtacagattcttcccccagtaccccgacaaggagctgcacatcaccgcctgcctgttcggcggcatcatcgagaagggcctggtgacctacatggccctgggcctggccctgagatacgtgctggaggccctgagaaagcccttcggcagcaagatgtactacttcggcatcgccgccctggacagattcaagaacagactgaaggactacccccagtactgccagcacctggccagcatcagccacttcatgcagttcccccaccacctgcaggagtacatcgagtacggccagcagagcagagacccccccgtgaagatgcagggcagcatcaccacccccggcagcatcgccctggcccaggcccaggcccaggcccaggtgcccgccaaggcccccctggccggccaggtgagcaccatggtgaccaccagcaccaccaccaccgtggccaagaccgtgaccgtgaccagacccaccggcgtgagcttcaagaaggacgtgccccccagcatcaacaccaccaacatcgacaccctgctggtggccaccgaccagaccgagagaatcgtggagccccccgagaacatccaggagaagatcgccttcatcttcaacaacctgagccagagcaacatgacccagaaggtggaggagctgaaggagaccgtgaaggaggagttcatgccctgggtgagccagtacctggtgatgaagagagtgagcatcgagcccaacttccacagcctgtacagcaacttcctggacaccctgaagaaccccgagttcaacaagatggtgctgaacgagacctacagaaacatcaaggtgctgctgaccagcgacaaggccgccgccaacttcagcgacagaagcctgctgaagaacctgggccactggctgggcatgatcaccctggccaagaacaagcccatcctgcacaccgacctggacgtgaagagcctgctgctggaggcctacgtgaagggccagcaggagctgctgtacgtggtgcccttcgtggccaaggtgctggagagcagcatcagaagcgtggtgttcagaccccccaacccctggaccatggccatcatgaacgtgctggccgagctgcaccaggagcacgacctgaagctgaacctgaagttcgagatcgaggtgctgtgcaagaacctggccctggacatcaacgagctgaagcccggcaacctgctgaaggacaaggacagactgaagaacctggacgagcagctgagcgcccccaagaaggacgtgaagcagcccgaggagctgccccccatcaccaccaccaccaccagcaccacccccgccaccaacaccacctgcaccgccaccgtgcccccccagccccagtacagctaccacgacatcaacgtgtacagcctggccggcctggccccccacatcaccctgaaccccaccatccccctgttccaggcccacccccagctgaagcagtgcgtgagacaggccatcgagagagccgtgcaggagctggtgcaccccgtggtggacagaagcatcaagatcgccatgaccacctgcgagcagatcgtgagaaaggacttcgccctggacagcgaggagagcagaatgagaatcgccgcccaccacatgatgagaaacctgaccgccggcatggccatgatcacctgcagagagcccctgctgatgagcatcagcaccaacctgaagaacagcttcgccagcgccctgagagtgagctggctgttcccctggtacagatacaagacctactactgcctgagcgtgatcatcttcttcttcgtgtacatctggcactgggccctgcccctgatcctgaacaaccaccacatctgcctgatgagcagcatcatcctggactgcaacagcgtgagacagagcatcatgagcgtgtgcttcttcttcttcctgctgtacagccagcacgacgtgtag

SEQ ID NO: 75788 - DNA, 951 bp, Artificial Sequence
  Description of Artificial Sequence: Synthetic coding sequence
atgctgctgctggagctgaacgcccccgagcacgtgctggagaccatcaacttccagaccctgaccgccttctgcaacaccttccacatcctgagacccaccaaggcccccggcttcgtgtacgcctggctggagctgatcagccacagaatcttcatcgccagaatgctggcccacaccccccagcagaagggctggcccatgtacgcccagctgctgatcgacctgttcaagtacctggcccccttcctgagaaacgtggagctgaccaagcccatgcagatcctgtacaagggcaccctgagagtgctgctggtgctgctgcacgacttccccgagttcctgtgcgactaccactacggcttctgcgacgtgatcccccccaactgcatccagctgagaaacctgatcctgagcgccttccccagaaacatgagactgcccgaccccttcacccccaacctgaaggtggacatgctgagcgagatcaacatcgcccccagaatcctgaccaacttcaccggcgtgatgcccccccagttcaagaaggacctggacagctacctgaagaccagaagccccgtgaccttcctgagcgacctgagaagcaacctgcaggtgagcaacgagcccggcaacagatacaacctgcagctgatcaacgccctggtgctgtacgtgggcacccaggccatcgcccacatccacaacaagggcagcacccccagcatgagcaccatcacccacagcgcccacatggacatcttccagaacctggccgtggacctggacaccgagggcagatacctgttcctgaacgccatcgccaaccagagcggcacccagatcgccaccctgaccaccagcgtggccccctgctgcaccttcctgcagagacccatcagaaagcccagcaagaacagaagccaggagttcagctggaacggctag

SEQ ID NO: 75789 - DNA, 2778 bp, Artificial Sequence
  Description of Artificial Sequence: Synthetic coding sequence
atggacagaagcggcttcggcgagatcagcagccccgtgatcagagaggccgaggtgaccagaaccgccagaaagcagagcgcccagaagagagtgctgctgcaggccagccaggacgagaacttcggcaacaccacccccagaaaccaggtgatccccagaacccccagcagcttcagacagcccttcacccccaccagcagaagcctgctgagacagcccgacatcagctgcatcctgggcaccggcggcaagagccccagactgacccagagcagcggcttcttcggcaacctgagcatggtgaccaacctggacgacagcaactgggccgccgccttcagcagccagagaagcggcctgttcaccaacaccgagccccacagcatcaccgaggacgtgaccatcagcgccgtgatgctgagagaggacgaccccggcgaggccgccagcatgagcatgttcagcgacttcctgcagagcttcctgaagcacagcagcagcaccgtgttcgacctggtggaggagtacgagaacatctgcggcagccaggtgaacatcctgagcaagatcgtgagcagagccacccccggcctgcagaagttcagcaagaccgccagcatgctgtggctgctgcagcaggagatggtgacctggagactgctggccagcctgtacagagacagaatccagagcgccctggaggaggagagcgtgttcgccgtgaccgccgtgaacgccagcgagaagaccgtggtggaggccctgttccagagagacagcctggtgagacagagccagctggtggtggactggctggagagcatcgccaaggacgagatcggcgagttcagcgacaacatcgagttctacgccaagagcgtgtactgggagaacaccctgcacaccctgaagcagagacagctgaccagctacgtgggcagcgtgagacccctggtgaccgagctggaccccgacgcccccatcagacagaagatgcccctggacgacctggacagagaggacgaggtgagactgctgaagtacctgttcaccctgatcagagccggcatgaccgaggaggcccagagactgtgcaagagatgcggccaggcctggagagccgccaccctggagggctggaagctgtaccacgaccccaacgtgaacggcggcaccgagctggagcccgtggagggcaacccctacagaagaatctggaagatcagctgctggagaatggccgaggacgagctgttcaacagatacgagagagccatctacgccgccctgagcggcaacctgaagcagctgctgcccgtgtgcgacacctgggaggacaccgtgtgggcctacttcagagtgatggtggacagcctggtggagcaggagatccagaccagcgtggccaccctggacgagaccgaggagctgcccagagagtacctgggcgccaactggaccctggagaaggtgttcgaggagctgcaggccaccgacaagaagagagtgctggaggagaaccaggagcactaccacatcgtgcagaagttcctgatcctgggcgacatcgacggcctgatggacgagttcagcaagtggctgagcaagagcagaaacaacctgcccggccacctgctgagattcatgacccacctgatcctgttcttcagaaccctgggcctgcagaccaaggaggaggtgagcatcgaggtgctgaagacctacatccagctgctgatcagagagaagcacaccaacctgatcgccttctacacctgccacctgccccaggacctggccgtggcccagtacgccctgttcctggagagcgtgaccgagttcgagcagagacaccactgcctggagctggccaaggaggccgacctggacgtggccaccatcaccaagaccgtggtggagaacatcagaaagaaggacaacggcgagttcagccaccacgacctggcccccgccctggacaccggcaccaccgaggaggacagactgaagatcgacgtgatcgactggctggtgttcgaccccgcccagagagccgaggccctgaagcagggcaacgccatcatgagaaagttcctggccagcaagaagcacgaggccgccaaggaggtgttcgtgaagatcccccaggacagcatcgccgagatctacaaccagtgcgaggagcagggcatggagagccccctgcccgccgaggacgacaacgccatcagagagcacctgtgcatcagagcctacctggaggcccacgagaccttcaacgagtggttcaagcacatgaacagcgtgccccagaagcccgccctgatcccccagcccaccttcaccgagaaggtggcccacgagcacaaggagaagaagtacgagatggacttcggcatctggaagggccacctggacgccctgaccgccgacgtgaaggagaagatgtacaacgtgctgctgttcgtggacggcggctggatggtggacgtgagagaggacgccaaggaggaccacgagagaacccaccagatggtgctgctgagaaagctgtgcctgcccatgctgtgcttcctgctgcacaccatcctgcacagcaccggccagtaccaggagtgcctgcagctggccgacatggtgagcagcgagagacacaagctgtacctggtgttcagcaaggaggagctgagaaagctgctgcagaagctgagagagagcagcctgatgctgctggaccagggcctggaccccctgggctacgagatccagctgtag

SEQ ID NO: 75790 - DNA, 1623 bp, Artificial Sequence
  Description of Artificial Sequence: Synthetic coding sequence
atggtgagaaccgacggccacaccctgagcgagaagagaaactaccaggtgaccaacagcatgttcggcgccagcagaaagaagttcgtggagggcgtggacagcgactaccacgacgagaacatgtactacagccagagcagcatgttcccccacagaagcgagaaggacatgctggccagccccagcaccagcggccagctgagccagttcggcgccagcctgtacggccagcagagcgccctgggcctgcccatgagaggcatgagcaacaacaccccccagctgaacagaagcctgagccagggcacccagctgcccagccacgtgacccccaccaccggcgtgcccaccatgagcctgcacaccccccccagccccagcagaggcatcctgcccatgaaccccagaaacatgatgaaccacagccaggtgggccagggcatcggcatccccagcagaaccaacagcatgagcagcagcggcctgggcagccccaacagaagcagccccagcatcatctgcatgcccaagcagcagcccagcagacagcccttcaccgtgaacagcatgagcggcttcggcatgaacagaaaccaggccttcggcatgaacaacagcctgagcagcaacatcttcaacggcaccgacggcagcgagaacgtgaccggcctggacctgagcgacttccccgccctggccgacagaaacagaagagagggcagcggcaaccccacccccctgatcaaccccctggccggcagagccccctacgtgggcatggtgaccaagcccgccaacgagcagagccaggacttcagcatccacaacgaggacttccccgccctgcccggcagcagctacaaggaccccaccagcagcaacgacgacagcaagagcaacctgaacaccagcggcaagaccaccagcagcaccgacggccccaagttccccggcgacaagagcagcaccacccagaacaacaaccagcagaagaagggcatccaggtgctgcccgacggcagagtgaccaacatcccccagggcatggtgaccgaccagttcggcatgatcggcctgctgaccttcatcagagccgccgagaccgaccccggcatggtgcacctggccctgggcagcgacctgaccaccctgggcctgaacctgaacagccccgagaacctgtaccccaagttcgccagcccctgggccagcagcccctgcagaccccaggacatcgacttccacgtgcccagcgagtacctgaccaacatccacatcagagacaagctggccgccatcaagctgggcagatacggcgaggacctgctgttctacctgtactacatgaacggcggcgacgtgctgcagctgctggccgccgtggagctgttcaacagagactggagataccacaaggaggagagagtgtggatcaccagagcccccggcatggagcccaccatgaagaccaacacctacgagagaggcacctactacttcttcgactgcctgaactggagaaaggtggccaaggagttccacctggagtacgacaagctggaggagagaccccacctgcccagcaccttcaactacaaccccgcccagcaggccttctag

SEQ ID NO: 75791 - DNA, 78 bp, Artificial Sequence
  Description of Artificial Sequence: Synthetic coding sequence
atggtgagaaccgacggccacaccctgagcgagaagagaaactaccaggtgaccaacagcatgttcggcgccagctag

SEQ ID NO: 75792 - DNA, 552 bp, Artificial Sequence
  Description of Artificial Sequence: Synthetic coding sequence
atggtgagaaccgacggccacaccctgagcgagaagagaaactaccaggtgaccaacagcatgttcggcgccagcagaaagaagttcgtggagggcgtggacagcgactaccacgacgagaacatgtactacagccagagcagcatgttcccccacagaagcgagaaggacatgctggccagccccagcaccagcggccagctgagccagttcggcgccagcctgtacggccagcagagcgccctgggcctgcccatgagaggcatgagcaacaacaccccccagctgaacagaagcctgagccagggcacccagctgcccagccacgtgacccccaccaccggcgtgcccaccatgagcctgcacaccccccccagccccagcagaggcatcctgcccatgaaccccagaaacatgatgaaccacagccaggtgggccagggcatcggcatccccagcagaaccaacagcatgagcagcagcggcctgggcagccccaacagaagcagccccagcatcatctgcatgcccaagcagcagcccagcagatag

SEQ ID NO: 75793 - DNA, 1623 bp, Artificial Sequence; identical to SEQ ID NO: 75790
  Description of Artificial Sequence: Synthetic coding sequence

SEQ ID NO: 75794 - DNA, 576 bp, Artificial Sequence
  Description of Artificial Sequence: Synthetic coding sequence
atggtgaccgaccagttcggcatgatcggcctgctgaccttcatcagagccgccgagaccgaccccggcatggtgcacctggccctgggcagcgacctgaccaccctgggcctgaacctgaacagccccgagaacctgtaccccaagttcgccagcccctgggccagcagcccctgcagaccccaggacatcgacttccacgtgcccagcgagtacctgaccaacatccacatcagagacaagctggccgccatcaagctgggcagatacggcgaggacctgctgttctacctgtactacatgaacggcggcgacgtgctgcagctgctggccgccgtggagctgttcaacagagactggagataccacaaggaggagagagtgtggatcaccagagcccccggcatggagcccaccatgaagaccaacacctacgagagaggcacctactacttcttcgactgcctgaactggagaaaggtggccaaggagttccacctggagtacgacaagctggaggagagaccccacctgcccagcaccttcaactacaaccccgcccagcaggccttctag

SEQ ID NO: 75795 - DNA, 966 bp, Artificial Sequence
  Description of Artificial Sequence: Synthetic coding sequence
atggtgagaaccgacggccacaccctgagcgagaagagaaactaccaggtgaccaacagcatgttcggcgccagcagaaagaagttcgtggagggcgtggacagcgactaccacgacgagaacatgtactacagccagagcagcatgttcccccacagaagcgagaaggacatgctggccagccccagcaccagcggccagctgagccagttcggcgccagcctgtacggccagcagagcgccctgggcctgcccatgagaggcatgagcaacaacaccccccagctgaacagaagcctgagccagggcacccagctgcccagccacgtgacccccaccaccggcgtgcccaccatgagcctgcacaccccccccagccccagcagaggcatcctgcccatgaaccccagaaacatgatgaaccacagccaggtgggccagggcatcggcatccccagcagaaccaacagcatgagcagcagcggcctgggcagccccaacagaagcagccccagcatcatctgcatgcccaagcagcagcccagcagacagcccttcaccgtgaacagcatgagcggcttcggcatgaacagaaaccaggccttcggcatgaacaacagcctgagcagcaacatcttcaacggcaccgacggcagcgagaacgtgaccggcctggacctgagcgacttccccgccctggccgacagaaacagaagagagggcagcggcaaccccacccccctgatcaaccccctggccggcagagccccctacgtgggcatggtgaccaagcccgccaacgagcagagccaggacttcagcatccacaacgaggacttccccgccctgcccggcagcagctacaaggaccccaccagcagcaacgacgacagcaagagcaacctgaacaccagcggcaagaccaccagcagcaccgacggccccaagttccccggcgacaagtag

SEQ ID NO: 75796 - DNA, 978 bp, Artificial Sequence
  Description of Artificial Sequence: Synthetic coding sequence
atgagcaccgccagagagcagcccatcttcagcaccagagcccacgtgttccagatcgaccccgccaccaagagaaactggatccccgccggcaagcacgccctgaccgtgagctacttctacgacgccaccagaaacgtgtacagaatcatcagcatcggcggcgccaaggccatcatcaacagcaccgtgacccccaacatgaccttcaccaagaccagccagaagttcggccagtgggccgacagcagagccaacaccgtgtacggcctgggcttcgccagcgagcagcacctgacccaggtgccccccagccccctggtgagcgccaacggccccggcgaggagaagctgttcagaagccagagcgccgacgcccccggccccaccgagagagagagactgaagaagatgctgagcgagggcagcgtgggcgaggtgcagtgggaggccgagttcttcgccctgcaggacagcaacaacaagctggccggcgccctgagagaggccaacgccgccgccgcccagtggagacagcagctggaggcccagagagccgaggccgagagactgagacagagagtggccgagctggaggcccaggccgccagcgaggtgacccccaccggcgagaaggagggcctgggccagggccagagcctggagcagctggaggccctggtgcagaccaaggaccaggagatccagaccctgaagagccagaccggcggccccagagaggccctggaggccgccgagagagaggagacccagcagaaggtgcaggacctggagaccagaaacgccgagctggagcaccagctgagagccatggagagaagcctggaggaggccagagccgagagagagagagccagagccgaggtgggcagagccgcccagctgctggacgtgagcctgttcgagctgagcgagctgagagagggcctggccagactggccgaggccgccccctag

SEQ ID NO: 75797 - DNA, 1716 bp, Artificial Sequence
  Description of Artificial Sequence: Synthetic coding sequence
atgctggagaccatcctgagaatgctggacaacgacagcatcctggtggacgccatcagaaagatcaaggacgacgtggagtactacgtggacagcagccaggaccccgacttcgaggagaacgagttcctgtacgacgacctggacctggaggacatcccccaggccctggtggccaccagcccccccagccacagccacatggaggacgagatcttcaaccagagcagcagcacccccaccagcaccaccagcagcagccccatcccccccagccccgccaactgcaccaccgagaacagcgaggacgacaagaagagaggcagaagcaccgacagcgaggtgagccagagccccgccaagaacggcagcaagcccgtgcacagcaaccagcacccccagagccccgccgtgccccccacctaccccagcggccccccccccgccgccagcgccctgagcaccacccccggcaacaacggcgtgcccgcccccgccgccccccccagcgccctgggccccaaggccagccccgcccccagccacaacagcggcacccccgccccctacgcccaggccgtggccccccccgcccccagcggccccagcaccacccagcccagaccccccagcgtgcagcccagcggcggcggcggcggcggcagcggcggcggcggcagcagcagcagcagcaacagcagcgccggcggcggcgccggcaagcagaacggcgccaccagctacagcagcgtggtggccgacagccccgccgaggtggccctgagcagcagcggcggcaacaacgccagcagccaggccctgggcccccccagcggcccccacaaccccccccccagcaccagcaaggagcccagcgccgccgcccccaccggcgccggcggcgtggcccccggcagcggcaacaacagcggcggccccagcctgctggtgcccctgcccgtgaacccccccagcagccccacccccagcttcagcgacgccaaggccgccggcgccctgctgaacggccccccccagttcagcaccgcccccgagatcaaggcccccgagcccctgagcagcctgaagagcatggccgagagagccgccatcagcagcggcatcgaggaccccgtgcccaccctgcacctgaccgagagagacatcatcctgagcagcaccagcgccccccccgccagcgcccagccccccctgcagctgagcgaggtgaacatccccctgagcctgggcgtgtgccccctgggccccgtgcccctgaccaaggagcagctgtaccagcaggccatggaggaggccgcctggcaccacatgccccaccccagcgacagcgagagaatcagacagtacctgcccagaaacccctgccccacccccccctaccaccaccagatgccccccccccacagcgacaccgtggagttctaccagagactgagcaccgagaccctgttcttcatcttctactacctggagcccagagacgtgagaaccgcctgggtggacagcgaggccggccccctgagacacaccagcgcccccctgcccgtggcccactggctgaccagaggccccagccccgccctgctgcagcagccccagagcagacccacccccctgtgcagcagcgcccacagccaggccagcctggagaccaccggcgagctgagcagccccctgcccacccccctgctgtag

SEQ ID NO: 75798 - DNA, 2262 bp, Artificial Sequence
  Description of Artificial Sequence: Synthetic coding sequence
atggccgacaagagaaagctgcagggcgagatcgacagatgcctgaagaaggtgagcgagggcgtggagcagttcgaggacatctggcagaagctgcacaacgccgccaacgccaaccagaaggagaagtacgaggccgacctgaagaaggagatcaagaagctgcagagactgagagaccagatcaagacctgggtggccagcaacgagatcaaggacaagagacagctgatcgacaacagaaagctgatcgagacccagatggagagattcaaggtggtggagagagagaccaagaccaaggcctacagcaaggagggcctgggcctggcccagaaggtggaccccgcccagaaggagaaggaggaggtgggccagtggctgaccaacaccatcgacaccctgaacatgcaggtggaccagttcgagagcgaggtggagagcctgagcgtgcagaccagaaagaagaagggcgacaaggacaagcaggacagaatcgagggcctgaagagacacatcgagaagcacagataccacgtgagaatgctggagaccatcctgagaatgctggacaacgacagcatcctggtggacgccatcagaaagatcaaggacgacgtggagtactacgtggacagcagccaggaccccgacttcgaggagaacgagttcctgtacgacgacctggacctggaggacatcccccaggccctggtggccaccagcccccccagccacagccacatggaggacgagatcttcaaccagagcagcagcacccccaccagcaccaccagcagcagccccatcccccccagccccgccaactgcaccaccgagaacagcgaggacgacaagaagagaggcagaagcaccgacagcgaggtgagccagagccccgccaagaacggcagcaagcccgtgcacagcaaccagcacccccagagccccgccgtgccccccacctaccccagcggccccccccccgccgccagcgccctgagcaccacccccggcaacaacggcgtgcccgcccccgccgccccccccagcgccctgggccccaaggccagccccgcccccagccacaacagcggcacccccgccccctacgcccaggccgtggccccccccgcccccagcggccccagcaccacccagcccagaccccccagcgtgcagcccagcggcggcggcggcggcggcagcggcggcggcggcagcagcagcagcagcaacagcagcgccggcggcggcgccggcaagcagaacggcgccaccagctacagcagcgtggtggccgacagccccgccgaggtggccctgagcagcagcggcggcaacaacgccagcagccaggccctgggcccccccagcggcccccacaaccccccccccagcaccagcaaggagcccagcgccgccgcccccaccggcgccggcggcgtggcccccggcagcggcaacaacagcggcggccccagcctgctggtgcccctgcccgtgaacccccccagcagccccacccccagcttcagcgacgccaaggccgccggcgccctgctgaacggccccccccagttcagcaccgcccccgagatcaaggcccccgagcccctgagcagcctgaagagcatggccgagagagccgccatcagcagcggcatcgaggaccccgtgcccaccctgcacctgaccgagagagacatcatcctgagcagcaccagcgccccccccgccagcgcccagccccccctgcagctgagcgaggtgaacatccccctgagcctgggcgtgtgccccctgggccccgtgcccctgaccaaggagcagctgtaccagcaggccatggaggaggccgcctggcaccacatgccccaccccagcgacagcgagagaatcagacagtacctgcccagaaacccctgccccacccccccctaccaccaccagatgccccccccccacagcgacaccgtggagttctaccagagactgagcaccgagaccctgttcttcatcttctactacctggagggcaccaaggcccagtacctggccgccaaggccctgaagaagcagagctggagattccacaccaagtacatgatgtggttccagagacacgaggagcccaagaccatcaccgacgagttcgagcagggcacctacatctacttcgactacgagaagtggggccagagaaagaaggagggcttcaccttcgagtacagatacctggaggacagagacctgcagtag

SEQ ID NO: 75799 - DNA, 867 bp, Artificial Sequence
  Description of Artificial Sequence: Synthetic coding sequence
tgaaaggagcccagcgccgccgcccccaccggcgccggcggcgtggcccccggcagcggcaacaacagcggcggccccagcctgctggtgcccctgcccgtgaacccccccagcagccccacccccagcttcagcgacgccaaggccgccggcgccctgctgaacggccccccccagttcagcaccgcccccgagatcaaggcccccgagcccctgagcagcctgaagagcatggccgagagagccgccatcagcagcggcatcgaggaccccgtgcccaccctgcacctgaccgagagagacatcatcctgagcagcaccagcgccccccccgccagcgcccagccccccctgcagctgagcgaggtgaacatccccctgagcctgggcgtgtgccccctgggccccgtgcccctgaccaaggagcagctgtaccagcaggccatggaggaggccgcctggcaccacatgccccaccccagcgacagcgagagaatcagacagtacctgcccagaaacccctgccccacccccccctaccaccaccagatgccccccccccacagcgacaccgtggagttctaccagagactgagcaccgagaccctgttcttcatcttctactacctggagggcaccaaggcccagtacctggccgccaaggccctgaagaagcagagctggagattccacaccaagtacatgatgtggttccagagacacgaggagcccaagaccatcaccgacgagttcgagcagctggcccagagcctgagcctgaccaagtacagcagcctgtggctgagcgcccagcccggcaccccccccagccacccccccctgggccagctgctgggcctgctgtag

SEQ ID NO: 75800 - DNA, 2304 bp, Artificial Sequence
  Description of Artificial Sequence: Synthetic coding sequence
atgagcagaagccccgacgccaaggaggaccccgtggagtgccccctgtgcatggagcccctggagatcgacgacatcaacttcttcccctgcacctgcggctaccagatctgcagattctgctggcacagaatcagaaccgacgagaacggcctgtgccccgcctgcagaaagccctaccccgaggaccccgccgtgtacaagcccctgagccaggaggagctgcagagaatcaagaacgagaagaagcagaagcagaacgagagaaagcagaagatcagcgagaacagaaagcacctggccagcgtgagagtggtgcagaagaacctggtgttcgtggtgggcctgagccagagactggccgaccccgaggtgctgaagagacccgagtacttcggcaagttcggcaagatccacaaggtggtgatcaacaacagcaccagctacgccggcagccagggccccagcgccagcgcctacgtgacctacatcagaagcgaggacgccctgagagccatccagtgcgtgaacaacgtggtggtggacggcagaaccctgaaggccagcctgggcaccaccaagtactgcagctacttcctgaagaacatgcagtgccccaagcccgactgcatgtacctgcacgagctgggcgacgaggccgccagcttcaccaaggaggagatgcaggccggcaagcaccaggagtacgagcagaagctgctgcaggagctgtacaagctgaaccccaacttcctgcagctgagcaccggcagcgtggacaagaacaagaacaaggtgacccccctgcagagatacgacacccccatcgacaagcccagcgacagcctgagcatcggcaacggcgacaacagccagcagatcagcaacagcgacacccccagccccccccccggcctgagcaagagcaaccccgtgatccccatcagcagcagcaaccacagcgccagaagccccttcgagggcgccgtgaccgagagccagagcctgttcagcgacaacttcagacaccccaaccccatccccagcggcctgccccccttccccagcagcccccagaccagcagcgactggcccaccgcccccgagccccagagcctgttcaccagcgagaccatccccgtgagcagcagcaccgactggcaggccgccttcggcttcggcagcagcaagcagcccgaggacgacctgggcttcgaccccttcgacgtgaccagaaaggccctggccgacctgatcgagaaggagctgagcgtgcaggaccagcccagcctgagccccaccagcctgcagaacagcagcagccacaccaccaccgccaagggccccggcagcggcttcctgcaccccgccgccgccaccaacgccaacagcctgaacagcaccttcagcgtgctgccccagagattcccccagttccagcagcacagagccgtgtacaacagcttcagcttccccggccaggccgccagatacccctggatggccttccccagaaacagcatcatgcacctgaaccacaccgccaaccccaccagcaacagcaacttcctggacctgaacctgcccccccagcacaacaccggcctgggcggcatccccgtggccgacaacagcagcagcgtggagagcctgaacatgaaggagtggcaggacggcctgagagccctgctgcccaacatcaacatcaacttcggcggcctgcccaacagcagcagccccagcaacgccaaccacagcgcccccaccagcaacaccgccaccaccgacagcctgagctgggacagccccggcagctggaccgaccccgccatcatcaccggcatccccgccagcagcggcaacagcctggacagcctgcaggacgacaaccccccccactggctgaagagcctgcaggccctgaccgagatggacggccccagcgccgcccccagccagacccaccacagcgcccccttcagcacccagatccccctgcacagagccagctggaacccctaccccccccccagcaaccccagcagcttccacagccccccccccggcatctactacagagtgcagcactggaccgccatcagacagagaggcgccaccatcagaaagtgcagaatctgccccaccctgttcagccccagccagcccaccacccacagcagcctgctgatcagctacgtgctgaagaaccccgtgcccgaccagttcttcttcagcctgacccccgacgccatgagaagccagggccactaccacctgttcatcaactgcaagaacttctgctag

SEQ ID NO: 75801 - DNA, 1728 bp, Artificial Sequence
  Description of Artificial Sequence: Synthetic coding sequence
atgagcagaagccccgacgccaaggaggaccccgtggagtgccccctgtgcatggagcccctggagatcgacgacatcaacttcttcccctgcacctgcggctaccagatctgcagattctgctggcacagaatcagaaccgacgagaacggcctgtgccccgcctgcagaaagccctaccccgaggaccccgccgtgtacaagcccctgagccaggaggagctgcagagaatcaagaacgagaagaagcagaagcagaacgagagaaagcagaagatcagcgagaacagaaagcacctggccagcgtgagagtggtgcagaagaacctggtgttcgtggtgggcctgagccagagactggccgaccccgaggtgctgaagagacccgagtacttcggcaagttcggcaagatccacaaggtggtgatcaacaacagcaccagctacgccggcagccagggccccagcgccagcgcctacgtgacctacatcagaagcgaggacgccctgagagccatccagtgcgtgaacaacgtggtggtggacggcagaaccctgaaggccagcctgggcaccaccaagtactgcagctacttcctgaagaacatgcagtgccccaagcccgactgcatgtacctgcacgagctgggcgacgaggccgccagcttcaccaaggaggagatgcaggccggcaagcaccaggagtacgagcagaagctgctgcaggagctgtacaagctgaaccccaacttcctgcagctgagcaccggcagcgtggacaagaacaagaacaaggtgacccccctgcagagatacgacacccccatcgacaagcccagcgacagcctgagcatcggcaacggcgacaacagccagcagatcagcaacagcgacacccccagccccccccccggcctgagcaagagcaaccccgtgatccccatcagcagcagcaaccacagcgccagaagccccttcgagggcgccgtgaccgagagccagagcctgttcagcgacaacttcagacaccccaaccccatccccagcggcctgccccccttccccagcagcccccagaccagcagcgactggcccaccgcccccgagccccagagcctgttcaccagcgagaccatccccgtgagcagcagcaccgactggcaggccgccttcggcttcggcagcagcaagcagcccgaggacgacctgggcttcgaccccttcgacgtgaccagaaaggccctggccgacctgatcgagaaggagctgagcgtgcaggaccagcccagcctgagccccaccagcctgcagaacagcagcagccacaccaccaccgccaagggccccggcagcggcttcctgcaccccgccgccgccaccaacgccaacagcctgaacagcaccttcagcgtgctgccccagagattcccccagttccagcagcacagagccgtgtacaacagcttcagcttccccggccaggccgccagatacccctggatggccttccccagaaacagcatcatgcacctgaaccacaccgccaaccccaccagcaacagcaacttcctggacctgaacctgcccccccagcacaacaccggcctgggcggcatccccgtggccggcgaggaggaggtgaaggtgagcaccatgcccctgagcaccagcagccacagcctgcagcagggccagcagcccaccagcctgcacaccaccgtggcctag

SEQ ID NO: 75802 - DNA, 1302 bp, Artificial Sequence
  Description of Artificial Sequence: Synthetic coding sequence
atgagcagaagccccgacgccaaggaggaccccgtggagtgccccctgtgcatggagcccctggagatcgacgacatcaacttcttcccctgcacctgcggctaccagatctgcagattctgctggcacagaatcagaaccgacgagaacggcctgtgccccgcctgcagaaagccctaccccgaggaccccgccgtgtacaagcccctgagccaggaggagctgcagagaatcaagaacgagaagaagcagaagcagaacgagagaaagcagaagatcagcgagaacagaaagcacctggccagcgtgagagtggtgcagaagaacctggtgttcgtggtgggcctgagccagagactggccgaccccgaggtgctgaagagacccgagtacttcggcaagttcggcaagatccacaaggtggtgatcaacaacagcaccagctacgccggcagccagggccccagcgccagcgcctacgtgacctacatcagaagcgaggacgccctgagagccatccagtgcgtgaacaacgtggtggtggacggcagaaccctgaaggccagcctgggcaccaccaagtactgcagctacttcctgaagaacatgcagtgccccaagcccgactgcatgtacctgcacgagctgggcgacgaggccgccagcttcaccaaggaggagatgcaggccggcaagcaccaggagtacgagcagaagctgctgcaggagctgtacaagctgaaccccaacttcctgcagctgagcaccggcagcgtggacaagaacaagaacaaggtgacccccctgcagagatacgacacccccatcgacaagcccagcgacagcctgagcatcggcaacggcgacaacagccagcagatcagcaacagcgacacccccagccccccccccggcctgagcaagagcaaccccgtgatccccatcagcagcagcaaccacagcgccagaagccccttcgagggcgccgtgaccgagagccagagcctgttcagcgacaacttcagacaccccaaccccatccccagcggcctgccccccttccccagcagcccccagaccagcagcgactggcccaccgcccccgagccccagagcctgttcaccagcgagaccatccccgtgagcagcagcaccgactggcaggccgccttcggcttcggcagcagcaagcagcccgaggacgacctgggcttcgaccccttcgacgtgaccagaaaggccctggccgacctgaccgagcccatcgagagaaagagactggccgtgctgaagagaagatag

SEQ ID NO: 75803 - DNA, 1920 bp, Artificial Sequence
  Description of Artificial Sequence: Synthetic coding sequence
atgagcagaagccccgacgccaaggaggaccccgtggagtgccccctgtgcatggagcccctggagatcgacgacatcaacttcttcccctgcacctgcggctaccagatctgcagattctgctggcacagaatcagaaccgacgagaacggcctgtgccccgcctgcagaaagccctaccccgaggaccccgccgtgtacaagcccctgagccaggaggagctgcagagaatcaagaacgagaagaagcagaagcagaacgagagaaagcagaagatcagcgagaacagaaagcacctggccagcgtgagagtggtgcagaagaacctggtgttcgtggtgggcctgagccagagactggccgaccccgaggtgctgaagagacccgagtacttcggcaagttcggcaagatccacaaggtggtgatcaacaacagcaccagctacgccggcagccagggccccagcgccagcgcctacgtgacctacatcagaagcgaggacgccctgagagccatccagtgcgtgaacaacgtggtggtggacggcagaaccctgaaggccagcctgggcaccaccaagtactgcagctacttcctgaagaacatgcagtgccccaagcccgactgcatgtacctgcacgagctgggcgacgaggccgccagcttcaccaaggaggagatgcaggccggcaagcaccaggagtacgagcagaagctgctgcaggagctgtacaagctgaaccccaacttcctgcagctgagcaccggcagcgtggacaagaacaagaacaaggtgacccccctgcagagccccatcgacaagcccagcgacagcctgagcatcggcaacggcgacaacagccagcagatcagcaacagcgacacccccagccccccccccggcctgagcaagagcaaccccgtgatccccatcagcagcagcaaccacagcgccagaagccccttcgagggcgccgtgaccgagagccagagcctgttcagcgacaacttcagacaccccaaccccatccccagcggcctgccccccttccccagcagcccccagaccagcagcgactggcccaccgcccccgagccccagagcctgttcaccagcgagaccatccccgtgagcagcagcaccgactggcaggccgccttcggcttcggcagcagcaagcagcccgaggacgacctgggcttcgaccccttcgacgtgaccagaaaggccctggccgacctgatcgagaaggagctgagcgtgcaggaccagcccagcctgagccccaccagcctgcagaacagcagcagccacaccaccaccgccaagggccccggcagcggcttcctgcaccccgccgccgccaccaacgccaacagcctgaacagcaccttcagcgtgctgccccagagattcccccagttccagcagcacagagccgtgtacaacagcttcagcttccccggccaggccgccagatacccctggatggccttccccagaaacagcatcatgcacctgaaccacaccgccaaccccaccagcaacagcaacttcctggacctgaacctgcccccccagcacaacaccggcctgggcggcatccccgtggccggcatccccgccagcagcggcaacagcctggacagcctgcaggacgacaaccccccccactggctgaagagcctgcaggccctgaccgagatggacggccccagcgccgcccccagccagacccaccacagcgcccccttcagcacccagatccccctgcacagagccagctggaacccctaccccccccccagcaaccccagcagcttccacagccccccccccggcttccagaccgccttcagaccccccagcaagacccccaccgacctgctgcagagcagcaccctggacagacactag

SEQ ID NO: 75804 - DNA, 1302 bp, Artificial Sequence; identical to SEQ ID NO: 75802
  Description of Artificial Sequence: Synthetic coding sequence

SEQ ID NO: 75805 - DNA, 1929 bp, Artificial Sequence
  Description of Artificial Sequence: Synthetic coding sequence
atgagcagaagccccgacgccaaggaggaccccgtggagtgccccctgtgcatggagcccctggagatcgacgacatcaacttcttcccctgcacctgcggctaccagatctgcagattctgctggcacagaatcagaaccgacgagaacggcctgtgccccgcctgcagaaagccctaccccgaggaccccgccgtgtacaagcccctgagccaggaggagctgcagagaatcaagaacgagaagaagcagaagcagaacgagagaaagcagaagatcagcgagaacagaaagcacctggccagcgtgagagtggtgcagaagaacctggtgttcgtggtgggcctgagccagagactggccgaccccgaggtgctgaagagacccgagtacttcggcaagttcggcaagatccacaaggtggtgatcaacaacagcaccagctacgccggcagccagggccccagcgccagcgcctacgtgacctacatcagaagcgaggacgccctgagagccatccagtgcgtgaacaacgtggtggtggacggcagaaccctgaaggccagcctgggcaccaccaagtactgcagctacttcctgaagaacatgcagtgccccaagcccgactgcatgtacctgcacgagctgggcgacgaggccgccagcttcaccaaggaggagatgcaggccggcaagcaccaggagtacgagcagaagctgctgcaggagctgtacaagctgaaccccaacttcctgcagctgagcaccggcagcgtggacaagaacaagaacaaggtgacccccctgcagagatacgacacccccatcgacaagcccagcgacagcctgagcatcggcaacggcgacaacagccagcagatcagcaacagcgacacccccagccccccccccggcctgagcaagagcaaccccgtgatccccatcagcagcagcaaccacagcgccagaagccccttcgagggcgccgtgaccgagagccagagcctgttcagcgacaacttcagacaccccaaccccatccccagcggcctgccccccttccccagcagcccccagaccagcagcgactggcccaccgcccccgagccccagagcctgttcaccagcgagaccatccccgtgagcagcagcaccgactggcaggccgccttcggcttcggcagcagcaagcagcccgaggacgacctgggcttcgaccccttcgacgtgaccagaaaggccctggccgacctgatcgagaaggagctgagcgtgcaggaccagcccagcctgagccccaccagcctgcagaacagcagcagccacaccaccaccgccaagggccccggcagcggcttcctgcaccccgccgccgccaccaacgccaacagcctgaacagcaccttcagcgtgctgccccagagattcccccagttccagcagcacagagccgtgtacaacagcttcagcttccccggccaggccgccagatacccctggatggccttccccagaaacagcatcatgcacctgaaccacaccgccaaccccaccagcaacagcaacttcctggacctgaacctgcccccccagcacaacaccggcctgggcggcatccccgtggccggcatccccgccagcagcggcaacagcctggacagcctgcaggacgacaaccccccccactggctgaagagcctgcaggccctgaccgagatggacggccccagcgccgcccccagccagacccaccacagcgcccccttcagcacccagatccccctgcacagagccagctggaacccctaccccccccccagcaaccccagcagcttccacagccccccccccggcttccagaccgccttcagaccccccagcaagacccccaccgacctgctgcagagcagcaccctggacagacactag

SEQ ID NO: 75806 - DNA, 1719 bp, Artificial Sequence
  Description of Artificial Sequence: Synthetic coding sequence
atgagcagaagccccgacgccaaggaggaccccgtggagtgccccctgtgcatggagcccctggagatcgacgacatcaacttcttcccctgcacctgcggctaccagatctgcagattctgctggcacagaatcagaaccgacgagaacggcctgtgccccgcctgcagaaagccctaccccgaggaccccgccgtgtacaagcccctgagccaggaggagctgcagagaatcaagaacgagaagaagcagaagcagaacgagagaaagcagaagatcagcgagaacagaaagcacctggccagcgtgagagtggtgcagaagaacctggtgttcgtggtgggcctgagccagagactggccgaccccgaggtgctgaagagacccgagtacttcggcaagttcggcaagatccacaaggtggtgatcaacaacagcaccagctacgccggcagccagggccccagcgccagcgcctacgtgacctacatcagaagcgaggacgccctgagagccatccagtgcgtgaacaacgtggtggtggacggcagaaccctgaaggccagcctgggcaccaccaagtactgcagctacttcctgaagaacatgcagtgccccaagcccgactgcatgtacctgcacgagctgggcgacgaggccgccagcttcaccaaggaggagatgcaggccggcaagcaccaggagtacgagcagaagctgctgcaggagctgtacaagctgaaccccaacttcctgcagctgagcaccggcagcgtggacaagaacaagaacaaggtgacccccctgcagagccccatcgacaagcccagcgacagcctgagcatcggcaacggcgacaacagccagcagatcagcaacagcgacacccccagccccccccccggcctgagcaagagcaaccccgtgatccccatcagcagcagcaaccacagcgccagaagccccttcgagggcgccgtgaccgagagccagagcctgttcagcgacaacttcagacaccccaaccccatccccagcggcctgccccccttccccagcagcccccagaccagcagcgactggcccaccgcccccgagccccagagcctgttcaccagcgagaccatccccgtgagcagcagcaccgactggcaggccgccttcggcttcggcagcagcaagcagcccgaggacgacctgggcttcgaccccttcgacgtgaccagaaaggccctggccgacctgatcgagaaggagctgagcgtgcaggaccagcccagcctgagccccaccagcctgcagaacagcagcagccacaccaccaccgccaagggccccggcagcggcttcctgcaccccgccgccgccaccaacgccaacagcctgaacagcaccttcagcgtgctgccccagagattcccccagttccagcagcacagagccgtgtacaacagcttcagcttccccggccaggccgccagatacccctggatggccttccccagaaacagcatcatgcacctgaaccacaccgccaaccccaccagcaacagcaacttcctggacctgaacctgcccccccagcacaacaccggcctgggcggcatccccgtggccggcgaggaggaggtgaaggtgagcaccatgcccctgagcaccagcagccacagcctgcagcagggccagcagcccaccagcctgcacaccaccgtggcctag

SEQ ID NO: 75807 - DNA, 2142 bp, Artificial Sequence
  Description of Artificial Sequence: Synthetic coding sequence
atgagcagaagccccgacgccaaggaggaccccgtggagtgccccctgtgcatggagcccctggagatcgacgacatcaacttcttcccctgcacctgcggctaccagatctgcagattctgctggcacagaatcagaaccgacgagaacggcctgtgccccgcctgcagaaagccctaccccgaggaccccgccgtgtacaagcccctgagccaggaggagctgcagagaatcaagaacgagaagaagcagaagcagaacgagagaaagcagaagatcagcgagaacagaaagcacctggccagcgtgagagtggtgcagaagaacctggtgttcgtggtgggcctgagccagagactggccgaccccgaggtgctgaagagacccgagtacttcggcaagttcggcaagatccacaaggtggtgatcaacaacagcaccagctacgccggcagccagggccccagcgccagcgcctacgtgacctacatcagaagcgaggacgccctgagagccatccagtgcgtgaacaacgtggtggtggacggcagaaccctgaaggccagcctgggcaccaccaagtactgcagctacttcctgaagaacatgcagtgccccaagcccgactgcatgtacctgcacgagctgggcgacgaggccgccagcttcaccaaggaggagatgcaggccggcaagcaccaggagtacgagcagaagctgctgcaggagctgtacaagctgaaccccaacttcctgcagctgagcaccggcagcgtggacaagaacaagaacaaggtgacccccctgcagagatacgacacccccatcgacaagcccagcgacagcctgagcatcggcaacggcgacaacagccagcagatcagcaacagcgacacccccagccccccccccggcctgagcaagagcaaccccgtgatccccatcagcagcagcaaccacagcgccagaagccccttcgagggcgccgtgaccgagagccagagcctgttcagcgacaacttcagacaccccaaccccatccccagcggcctgccccccttccccagcagcccccagaccagcagcgactggcccaccgcccccgagccccagagcctgttcaccagcgagaccatccccgtgagcagcagcaccgactggcaggccgccttcggcttcggcagcagcaagcagcccgaggacgacctgggcttcgaccccttcgacgtgaccagaaaggccctggccgacctgatcgagaaggagctgagcgtgcaggaccagcccagcctgagccccaccagcctgcagaacagcagcagccacaccaccaccgccaagggccccggcagcggcttcctgcaccccgccgccgccaccaacgccaacagcctgaacagcaccttcagcgtgctgccccagagattcccccagttccagcagcacagagccgtgtacaacagcttcagcttccccggccaggccgccagatacccctggatggccttccccagaaacagcatcatgcacctgaaccacaccgccaaccccaccagcaacagcaacttcctggacctgaacctgcccccccagcacaacaccggcctgggcggcatccccgtggccgacaacagcagcagcgtggagagcctgaacatgaaggagtggcaggacggcctgagagccctgctgcccaacatcaacatcaacttcggcggcctgcccaacagcagcagccccagcaacgccaaccacagcgcccccaccagcaacaccgccaccaccgacagcctgagctgggacagccccggcagctggaccgaccccgccatcatcaccggcatccccgccagcagcggcaacagcctggacagcctgcaggacgacaaccccccccactggctgaagagcctgcaggccctgaccgagatggacggccccagcgccgcccccagccagacccaccacagcgcccccttcagcacccagatccccctgcacagagccagctggaacccctaccccccccccagcaaccccagcagcttccacagccccccccccggcttccagaccgccttcagaccccccagcaagacccccaccgacctgctgcagagcagcaccctggacagacactag

SEQ ID NO: 75808 - DNA, 1674 bp, Artificial Sequence
  Description of Artificial Sequence: Synthetic coding sequence
atgcccaaggagaagtacgagccccccgaccccagaagaatgtacaccatcatgagcagcgaggaggccgccaacggcaagaagagccactgggccgagctggagatcagcggcaaggtgagaagcctgagcgccagcctgtggagcctgacccacctgaccgccctgcacctgagcgacaacagcctgagcagaatccccagcgacatcgccaagctgcacaacctggtgtacctggacctgagcagcaacaagatcagaagcctgcccgccgagctgggcaacatggtgagcctgagagagctgcacctgaacaacaacctgctgagagtgctgcccttcgagctgggcaagctgttccagctgcagaccctgggcctgaagggcaaccccctgacccaggacatcctgaacctgtaccaggagcccgacggcaccagaagactgctgaactacctgctggacaacctgagcggcaccgccaagagaatcaccaccgagcagcccccccccagaagctggatcatgctgcaggagcccgacagaaccagacccaccgccctgttcagcgtgatgtgctacaacgtgctgtgcgacaagtacgccaccagacagctgtacggctactgccccagctgggccctgaactgggactacagaaagaaggccatcatccaggagatcctgagctgcaacgccgacatcgtgagcctgcaggaggtggagaccgagcagtactacagcttcttcctggtggagctgaaggagagaggctacaacggcttcttcagccccaagagcagagccagaaccatgagcgagcaggagagaaagcacgtggacggctgcgccatcttcttcaagaccgagaagttcaccctggtgcagaagcacaccgtggagttcaaccagctggccatggccaacagcgagggcagcgaggccatgctgaacagagtgatgaccaaggacaacatcggcgtggccgtgctgctggagctgagaaaggagagcatcgagatgcccagcggcaagccccacctgggcaccgagaagcagctgatcctggtggccaacgcccacatgcactgggaccccgagtacagcgacgtgaagctggtgcagaccatgatgttcctgagcgaggtgaagaacatcatcgacaaggccagcagaaacctgaagagcagcgtgctgggcgagttcggcaccatccccctggtgctgtgcgccgacctgaacagcctgcccgacagcggcgtggtggagtacctgagcaccggcggcgtggagaccaaccacaaggacttcaaggagctgagatacaacgagagcctgaccaacttcagctgccacggcaagaacggcaccaccaacggcagaatcacccacggcttcaagctgcagagcgcctacgagagcggcctgatgccctacaccaactacaccttcgacttcaagggcatcatcgactacatcttctacagcaagccccagctgaacaccctgggcatcctgggccccctggaccaccactggctggtggagaacaacatcagcggctgcccccaccccctgatccccagcgaccacttcagcctgttcgcccagctggagctgctgctgcccttcctgccccaggtgaacggcatccacctgcccggcagaagatag

SEQ ID NO: 75809 - DNA, 1674 bp, Artificial Sequence; identical to SEQ ID NO: 75808
  Description of Artificial Sequence: Synthetic coding sequence

SEQ ID NO: 75810 - DNA, 858 bp, Artificial Sequence
  Description of Artificial Sequence: Synthetic coding sequence
atgcccgccgccaccgtggaccacagccagagaatctgcgaggtgtgggcctgcaacctggacgaggagatgaagaagatcagacaggtgatcagaaagtacaactacgtggccatggacaccgagttccccggcgtggtggccagacccatcggcgagttcagaagcaacgccgactaccagtaccagctgctgagatgcaacgtggacctgctgaagatcatccagctgggcctgaccttcatgaacgagcagggcgagtacccccccggcaccagcacctggcagttcaacttcaagttcaacctgaccgaggacatgtacgcccaggacagcatcgagctgctgaccaccagcggcatccagttcaagaagcacgaggaggagggcatcgagacccagtacttcgccgagctgctgatgaccagcggcgtggtgctgtgcgagggcgtgaagtggctgagcttccacagcggctacgacttcggctacctgatcaagatcctgaccaacagcaacctgcccgaggaggagctggacttcttcgagatcctgagactgttcttccccgtgatctacgacgtgaagtacctgatgaagagctgcaagaacctgaagggcggcctgcaggaggtggccgagcagctggagctggagagaatcggcccccagcaccaggccggcagcgacagcctgctgaccggcatggccttcttcaagatgagagagatgttcttcgaggaccacatcgacgacgccaagtactgcggccacctgtacggcctgggcagcggcagcagctacgtgcagaacggcaccggcaacgcctacgaggaggaggccaacaagcagagctag

SEQ ID NO: 75811 - DNA, 126 bp, Artificial Sequence
  Description of Artificial Sequence: Synthetic coding sequence
atgcccgccgccaccgtggaccacagccagagaatctgcgaggtgtgggcctgcaacctggacgaggagatgaagaagatcagacaggtgatcagaaagtacaactacgtggccatggacacctag

SEQ ID NO: 75812 - DNA, 735 bp, Artificial Sequence
  Description of Artificial Sequence: Synthetic coding sequence
atgcccgccgccaccgtggaccacagccagagaatctgcgaggtgtgggcctgcaacctggacgaggagatgaagaagatcagacaggtgatcagaaagtacaactacgtggccatggacaccgagttccccggcgtggtggccagacccatcggcgagttcagaagcaacgccgactaccagtaccagctgctgagatgcaacgtggacctgctgaagatcatccagctgggcctgaccttcatgaacgagcagggcgagtacccccccggcaccagcacctggcagttcaacttcaagttcaacctgaccgaggacatgtacgcccaggacagcatcgagctgctgaccaccagcggcatccagttcaagaagcacgaggaggagggcatcgagacccagtacttcgccgagctgctgatgaccagcggcgtggtgctgtgcgagggcgtgaagtggctgagcttccacagcggctacgacttcggctacctgatcaagatcctgaccaacagcaacctgcccgaggaggagctggacttcttcgagatcctgagactgttcttccccgtgatctacgacgtgaagtacctgatgaagagctgcaagaacctgaagggcggcctgcaggaggtggccgagcagctggagctggagagaatcggcccccagcaccaggccggcagcgacagcctgctgaccggcatggccttcttcaagatgagagaggtgtag

SEQ ID NO: 75813 - DNA, 444 bp, Artificial Sequence
  Description of Artificial Sequence: Synthetic coding sequence
atgcccgccgccaccgtggaccacagccagagaatctgcgaggtgtgggcctgcaacctggacgaggagatgaagaagatcagacaggtgatcagaaagtacaactacgtggccatggacaccgagttccccggcgtggtggccagacccatcggcgagttcagaagcaacgccgactaccagtaccagctgctgagatgcaacgtggacctgctgaagatcatccagctgggcctgaccttcatgaacgagcagggcgagtacccccccggcaccagcacctggcagttcaacttcaagttcaacctgaccgaggacatgtacgcccaggacagcatcgagctgctgaccaccagcggcatccagttcaagaagcacgaggaggagggcatcgagacccagtacttcgccgagctgctgatgaccagcggcgtggtgctgtag

SEQ ID NO: 75814 - DNA, 879 bp, Artificial Sequence
  Description of Artificial Sequence: Synthetic coding sequence
atgcccgccgccctggtggagaacagccaggtgatctgcgaggtgtgggccagcaacctggaggaggagatgagaaagatcagagagatcgtgctgagctacagctacatcgccatggacaccgagttccccggcgtggtggtgagacccatcggcgagttcagaagcagcatcgactaccagtaccagctgctgagatgcaacgtggacctgctgaagatcatccagctgggcctgaccttcaccaacgagaagggcgagtaccccagcggcatcaacacctggcagttcaacttcaagttcaacctgaccgaggacatgtacagccaggacagcatcgacctgctggccaacagcggcctgcagttccagaagcacgaggaggagggcatcgacaccctgcacttcgccgagctgctgatgaccagcggcgtggtgctgtgcgacaacgtgaagtggctgagcttccacagcggctacgacttcggctacatggtgaagctgctgaccgacagcagactgcccgaggaggagcacgagttcttccacatcctgaacctgttcttccccagcatctacgacgtgaagtacctgatgaagagctgcaagaacctgaagggcggcctgcaggaggtggccgaccagctggacctgcagagaatcggcagacagcaccaggccggcagcgacagcctgctgaccggcatggccttcttcagaatgaaggagctgttcttcgaggacagcatcgacgacgccaagtactgcggcagactgtacggcctgggcaccggcgtggcccagaagcagaacgaggacgtggacagcgcccaggagaagatgagcatcctggccatcatcaacaacatgcagcagtag

SEQ ID NO: 75815 - DNA, 879 bp, Artificial Sequence; identical to SEQ ID NO: 75814
  Description of Artificial Sequence: Synthetic coding sequence

SEQ ID NO: 75816 - DNA, 357 bp, Artificial Sequence
  Description of Artificial Sequence: Synthetic coding sequence
atgcccgccgccctggtggagaacagccaggtgatctgcgaggtgtgggccagcaacctggaggaggagatgagaaagatcagagagatcgtgctgagctacagctacatcgccatggacaccgagttccccggcgtggtggtgagacccatcggcgagttcagaagcagcatcgactaccagtaccagctgctgagatgcaacgtggacctgctgaagatcatccagctgggcctgaccttcaccaacgagaagggcgagtaccccagcggcatcaacacctggcagttcaacttcaagttcaacctgaccgaggacatgtacagccaggacagcatcgacctgctggccaactag

SEQ ID NO: 75817 - DNA, 879 bp, Artificial Sequence; identical to SEQ ID NO: 75814
  Description of Artificial Sequence: Synthetic coding sequence

SEQ ID NO: 75818 - DNA, 168 bp, Artificial Sequence
  Description of Artificial Sequence: Synthetic coding sequence
atgcccgccgccctggtggagaacagccaggtgatctgcgaggtgtgggccagcaacctggaggaggagatgagaaagatcagagagatcgtgctgagctacagctacatcgccatggacaccgagttccccggcgtggtggtgagacccatcggcgagttcagatag

SEQ ID NO: 75819 - DNA, 678 bp, Artificial Sequence
  Description of Artificial Sequence: Synthetic coding sequence
atgcccgccgccctggtggagaacagccaggtgatctgcgaggtgtgggccagcaacctggaggaggagatgagaaagatcagagagatcgtgctgagctacagctacatcgccatggacaccgagttccccggcgtggtggtgagacccatcggcgagttcagaagcagcatcgactaccagtaccagctgctgagatgcaacgtggacctgctgaagatcatccagctgggcctgaccttcaccaacgagaagggcgagtaccccagcggcatcaacacctggcagttcaacttcaagttcaacctgaccggctacgacttcggctacatggtgaagctgctgaccgacagcagactgcccgaggaggagcacgagttcttccacatcctgaacctgttcttccccagcatctacgacgtgaagtacctgatgaagagctgcaagaacctgaagggcggcctgcaggaggtggccgaccagctggacctgcagagaatcggcagacagcaccaggccggcagcgacagcctgctgaccggcatggccttcttcagaatgaaggagctgttcttcgaggacagcatcgacgacgccaagtactgcggcagactgtacggcctgggcaccggcgtggcccagaagcagaacgaggacgtggacagcgcccaggagtag

SEQ ID NO: 75820 - DNA, 360 bp, Artificial Sequence
  Description of Artificial Sequence: Synthetic coding sequence
atgcccgccgccctggtggagaacagccaggtgatctgcgaggtgtgggccagcaacctggaggaggagatgagaaagatcagagagatcgtgctgagctacagctacatcgccatggacaccgagttccccggcgtggtggtgagacccatcggcgagttcagaagcagcatcgactaccagtaccagctgctgagatgcaacgtggacctgctgaagatcatccagctgggcctgaccttcaccaacgagaagggcgagtaccccagcggcatcaacacctggcagttcaacttcaagttcaacctgaccgaggacatgtacagccaggacagcatcgacctgctggccaacagctag

SEQ ID NO: 75821 - DNA, 717 bp, Artificial Sequence
  Description of Artificial Sequence: Synthetic coding sequence
atgcccgccgccctggtggagaacagccaggtgatctgcgaggtgtgggccagcaacctggaggaggagatgagaaagatcagagagatcgtgctgagctacagctacatcgccatggacaccgagttccccggcgtggtggtgagacccatcggcgagttcagaagcagcatcgactaccagtaccagctgctgagatgcaacgtggacctgctgaagatcatccagctgggcctgaccttcaccaacgagaagggcgagtaccccagcggcatcaacacctggcagttcaacttcaagttcaacctgaccggctacgacttcggctacatggtgaagctgctgaccgacagcagactgcccgaggaggagcacgagttcttccacatcctgaacctgttcttccccagcatctacgacgtgaagtacctgatgaagagctgcaagaacctgaagggcggcctgcaggaggtggccgaccagctggacctgcagagaatcggcagacagcaccaggccggcagcgacagcctgctgaccggcatggccttcttcagaatgaaggagctgttcttcgaggacagcatcgacgacgccaagtactgcggcagactgtacggcctgggcaccggcgtggcccagaagcagaacgaggacgtggacagcgcccaggagaagatgagcatcctggccatcatcaacaacatgcagcagtag

SEQ ID NO: 75822 - DNA, 168 bp, Artificial Sequence; identical to SEQ ID NO: 75818
  Description of Artificial Sequence: Synthetic coding sequence

SEQ ID NO: 75823 - DNA, 258 bp, Artificial Sequence
  Description of Artificial Sequence: Synthetic coding sequence
atgtacagccaggacagcatcgacctgctggccaacagcggcctgcagttccagaagcacgaggaggagggcatcgacaccctgcacttcgccgagctgctgatgaccagcggcgtggtgctgtgcgacaacgtgaagtggctgagcttccacagcggctacgacttcggctacatggtgaagctgctgaccgacagcagactgcccgaggaggagcacgagttcttccacatcctgaacctgttcttccccagctag

SEQ ID NO: 75824 - DNA, 402 bp, Artificial Sequence
  Description of Artificial Sequence: Synthetic coding sequence
atgcccgccgccctggtggagaacagccaggtgatctgcgaggtgtgggccagcaacctggaggaggagatgagaaagatcagagagatcgtgctgagctacagctacatcgccatggacaccgagttccccggcgtggtggtgagacccatcggcgagttcagaagcagcatcgactaccagtaccagctgctgagatgcaacgtggacctgctgaagatcatccagctgggcctgaccttcaccaacgagaagggcgagtaccccagcggcatcaacacctggcagttcaacttcaagttcaacctgaccgaggacatgtacagccaggacagcatcgacctgctggccaacagcggcctgcagttccagaagcacgaggaggagggcatcgacacctag

SEQ ID NO: 75825 - DNA, 561 bp, Artificial Sequence
  Description of Artificial Sequence: Synthetic coding sequence
atgtacagccaggacagcatcgacctgctggccaacagcggcctgcagttccagaagcacgaggaggagggcatcgacaccctgcacttcgccgagctgctgatgaccagcggcgtggtgctgtgcgacaacgtgaagtggctgagcttccacagcggctacgacttcggctacatggtgaagctgctgaccgacagcagactgcccgaggaggagcacgagttcttccacatcctgaacctgttcttccccagcatctacgacgtgaagtacctgatgaagagctgcaagaacctgaagggcggcctgcaggaggtggccgaccagctggacctgcagagaatcggcagacagcaccaggccggcagcgacagcctgctgaccggcatggccttcttcagaatgaaggagctgttcttcgaggacagcatcgacgacgccaagtactgcggcagactgtacggcctgggcaccggcgtggcccagaagcagaacgaggacgtggacagcgcccaggagaagatgagcatcctggccatcatcaacaacatgcagcagtag

SEQ ID NO: 75826 - DNA, 561 bp, Artificial Sequence; identical to SEQ ID NO: 75825
  Description of Artificial Sequence: Synthetic coding sequence

SEQ ID NO: 75827 - DNA, 561 bp, Artificial Sequence; identical to SEQ ID NO: 75825
  Description of Artificial Sequence: Synthetic coding sequence

SEQ ID NO: 75828 - DNA, 366 bp, Artificial Sequence
  Description of Artificial Sequence: Synthetic coding sequence
atgcccgccgccctggtggagaacagccaggtgatctgcgaggtgtgggccagcaacctggaggaggagatgagaaagatcagagagatcgtgctgagctacagctacatcgccatggacaccgagttccccggcgtggtggtgagacccatcggcgagttcagaagcagcatcgactaccagtaccagctgctgagatgcaacgtggacctgctgaagatcatccagctgggcctgaccttcaccaacgagaagggcgagtaccccagcggcatcaacacctggcagttcaacttcaagttcaacctgaccggctacgacttcggctacatggtgaagctgctgaccgacagcagactgccctag

SEQ ID NO: 75829 - DNA, 561 bp, Artificial Sequence; identical to SEQ ID NO: 75825
  Description of Artificial Sequence: Synthetic coding sequence

SEQ ID NO: 75830 - DNA, 387 bp, Artificial Sequence
  Description of Artificial Sequence: Synthetic coding sequence
atggtgaagctgctgaccgacagcagactgcccgaggaggagcacgagttcttccacatcctgaacctgttcttccccagcatctacgacgtgaagtacctgatgaagagctgcaagaacctgaagggcggcctgcaggaggtggccgaccagctggacctgcagagaatcggcagacagcaccaggccggcagcgacagcctgctgaccggcatggccttcttcagaatgaaggagctgttcttcgaggacagcatcgacgacgccaagtactgcggcagactgtacggcctgggcaccggcgtggcccagaagcagaacgaggacgtggacagcgcccaggagaagatgagcatcctggccatcatcaacaacatgcagcagtag

SEQ ID NO: 75831 - DNA, 810 bp, Artificial Sequence
  Description of Artificial Sequence: Synthetic coding sequence
atgagaaagatcagagagatcgtgctgagctacagctacatcgccatggacaccgagttccccggcgtggtggtgagacccatcggcgagttcagaagcagcatcgactaccagtaccagctgctgagatgcaacgtggacctgctgaagatcatccagctgggcctgaccttcaccaacgagaagggcgagtaccccagcggcatcaacacctggcagttcaacttcaagttcaacctgaccgaggacatgtacagccaggacagcatcgacctgctggccaacagcggcctgcagttccagaagcacgaggaggagggcatcgacaccctgcacttcgccgagctgctgatgaccagcggcgtggtgctgtgcgacaacgtgaagtggctgagcttccacagcggctacgacttcggctacatggtgaagctgctgaccgacagcagactgcccgaggaggagcacgagttcttccacatcctgaacctgttcttccccagcatctacgacgtgaagtacctgatgaagagctgcaagaacctgaagggcggcctgcaggaggtggccgaccagctggacctgcagagaatcggcagacagcaccaggccggcagcgacagcctgctgaccggcatggccttcttcagaatgaaggagctgttcttcgaggacagcatcgacgacgccaagtactgcggcagactgtacggcctgggcaccggcgtggcccagaagcagaacgaggacgtggacagcgcccaggagaagatgagcatcctggccatcatcaacaacatgcagcagtag

SEQ ID NO: 75832 - DNA, 4338 bp, Artificial Sequence
  Description of Artificial Sequence: Synthetic coding sequence
atgcagggcccccccctgctgaccgccgcccacctgctgtgcgtgtgcaccgccgccctggccgtggcccccggccccagattcctggtgaccgcccccggcatcatcagacccggcggcaacgtgaccatcggcgtggagctgctggagcactgccccagccaggtgaccgtgaaggccgagctgctgaagaccgccagcaacctgaccgtgagcgtgctggaggccgagggcgtgttcgagaagggcagcttcaagaccctgaccctgcccagcctgcccctgaacagcgccgacgagatctacgagctgagagtgaccggcagaacccaggacgagatcctgttcagcaacagcaccagactgagcttcgagaccaagagaatcagcgtgttcatccagaccgacaaggccctgtacaagcccaagcaggaggtgaagttcagaatcgtgaccctgttcagcgacttcaagccctacaagaccagcctgaacatcctgatcaaggaccccaagagcaacctgatccagcagtggctgagccagcagagcgacctgggcgtgatcagcaagaccttccagctgagcagccaccccatcctgggcgactggagcatccaggtgcaggtgaacgaccagacctactaccagagcttccaggtgagcgagtacgtgctgcccaagttcgaggtgaccctgcagacccccctgtactgcagcatgaacagcaagcacctgaacggcaccatcaccgccaagtacacctacggcaagcccgtgaagggcgacgtgaccctgaccttcctgcccctgagcttctggggcaagaagaagaacatcaccaagaccttcaagatcaacggcagcgccaacttcagcttcaacgacgaggagatgaagaacgtgatggacagcagcaacggcctgagcgagtacctggacctgagcagccccggccccgtggagatcctgaccaccgtgaccgagagcgtgaccggcatcagcagaaacgtgagcaccaacgtgttcttcaagcagcacgactacatcatcgagttcttcgactacaccaccgtgctgaagcccagcctgaacttcaccgccaccgtgaaggtgaccagagccgacggcaaccagctgaccctggaggagagaagaaacaacgtggtgatcaccgtgacccagagaaactacaccgagtactggagcggcagcaacagcggcaaccagaagatggaggccgtgcagaagatcaactacaccgtgccccagagcggcaccttcaagatcgagttccccatcctggaggacagcagcgagctgcagctgaaggcctacttcctgggcagcaagagcagcatggccgtgcacagcctgttcaagagccccagcaagacctacatccagctgaagaccagagacgagaacatcaaggtgggcagccccttcgagctggtggtgagcggcaacaagagactgaaggagctgagctacatggtggtgagcagaggccagctggtggccgtgggcaagcagaacagcaccatgttcagcctgacccccgagaacagctggacccccaaggcctgcgtgatcgtgtactacatcgaggacgacggcgagatcatcagcgacgtgctgaagatccccgtgcagctggtgttcaagaacaagatcaagctgtactggagcaaggtgaaggccgagcccagcgagaaggtgagcctgagaatcagcgtgacccagcccgacagcatcgtgggcatcgtggccgtggacaagagcgtgaacctgatgaacgccagcaacgacatcaccatggagaacgtggtgcacgagctggagctgtacaacaccggctactacctgggcatgttcatgaacagcttcgccgtgttccaggagtgcggcctgtgggtgctgaccgacgccaacctgaccaaggactacatcgacggcgtgtacgacaacgccgagtacgccgagagattcatggaggagaacgagggccacatcgtggacatccacgacttcagcctgggcagcagcccccacgtgagaaagcacttccccgagacctggatctggctggacaccaacatgggctacagaatctaccaggagttcgaggtgaccgtgcccgacagcatcaccagctgggtggccaccggcttcgtgatcagcgaggacctgggcctgggcctgaccaccacccccgtggagctgcaggccttccagcccttcttcatcttcctgaacctgccctacagcgtgatcagaggcgaggagttcgccctggagatcaccatcttcaactacctgaaggacgccaccgaggtgaaggtgatcatcgagaagagcgacaagttcgacatcctgatgaccagcaacgagatcaacgccaccggccaccagcagaccctgctggtgcccagcgaggacggcgccaccgtgctgttccccatcagacccacccacctgggcgagatccccatcaccgtgaccgccctgagccccaccgccagcgacgccgtgacccagatgatcctggtgaaggccgagggcatcgagaagagctacagccagagcatcctgctggacctgaccgacaacagactgcagagcaccctgaagaccctgagcttcagcttcccccccaacaccgtgaccggcagcgagagagtgcagatcaccgccatcggcgacgtgctgggccccagcatcaacggcctggccagcctgatcagaatgccctacggctgcggcgagcagaacatgatcaacttcgcccccaacatctacatcctggactacctgaccaagaagaagcagctgaccgacaacctgaaggagaaggccctgagcttcatgagacagggctaccagagagagctgctgtaccagagagaggacggcagcttcagcgccttcggcaactacgaccccagcggcagcacctggctgagcgccttcgtgctgagatgcttcctggaggccgacccctacatcgacatcgaccagaacgtgctgcacagaacctacacctggctgaagggccaccagaagagcaacggcgagttctgggaccccggcagagtgatccacagcgagctgcagggcggcaacaagagccccgtgaccctgaccgcctacatcgtgaccagcctgctgggctacagaaagtaccagcccaacatcgacgtgcaggagagcatccacttcctggagagcgagttcagcagaggcatcagcgacaactacaccctggccctgatcacctacgccctgagcagcgtgggcagccccaaggccaaggaggccctgaacatgctgacctggagagccgagcaggagggcggcatgcagttctgggtgagcagcgagagcaagctgagcgacagctggcagcccagaagcctggacatcgaggtggccgcctacgccctgctgagccacttcctgcagttccagaccagcgagggcatccccatcatgagatggctgagcagacagagaaacagcctgggcggcttcgccagcacccaggacaccaccgtggccctgaaggccctgagcgagttcgccgccctgatgaacaccgagagaaccaacatccaggtgaccgtgaccggccccagcagccccagccccgtgaagttcctgatcgacacccacaacagactgctgctgcagaccgccgagctggccgtggtgcagcccaccgccgtgaacatcagcgccaacggcttcggcttcgccatctgccagctgaacgtggtgtacaacgtgaaggccagcggcagcagcagaagaagaagaagcatccagaaccaggaggccttcgacctggacgtggccgtgaaggagaacaaggacgacctgaaccacgtggacctgaacgtgtgcaccagcttcagcggccccggcagaagcggcatggccctgatggaggtgaacctgctgagcggcttcatggtgcccagcgaggccatcagcctgagcgagaccgtgaagaaggtggagtacgaccacggcaagctgaacctgtacctggacagcgtgaacgagacccagttctgcgtgaacatccccgccgtgagaaacttcaaggtgagcaacacccaggacgccagcgtgagcatcgtggactactacgagcccagaagacaggccgtgagaagctacaacagcgaggtgaagctgagcagctgcgacctgtgcagcgacgtgcagggctgcagaccctgcgaggacggcgccagcggcagccaccaccacagcagcgtgatcttcatcttctgcttcaagctgctgtacttcatggagctgtggctgtag

SEQ ID NO: 75833 - DNA, 4107 bp, Artificial Sequence
  Description of Artificial Sequence: Synthetic coding sequence
atgcagggcccccccctgctgaccgccgcccacctgctgtgcgtgtgcaccgccgccctggccgtggcccccggccccagattcctggtgaccgcccccggcatcatcagacccggcggcaacgtgaccatcggcgtggagctgctggagcactgccccagccaggtgaccgtgaaggccgagctgctgaagaccgccagcaacctgaccgtgagcgtgctggaggccgagggcgtgttcgagaagggcagcttcaagaccctgaccctgcccagcgaccccaagagcaacctgatccagcagtggctgagccagcagagcgacctgggcgtgatcagcaagaccttccagctgagcagccaccccatcctgggcgactggagcatccaggtgcaggtgaacgaccagacctactaccagagcttccaggtgagcgagtacgtgctgcccaagttcgaggtgaccctgcagacccccctgtactgcagcatgaacagcaagcacctgaacggcaccatcaccgccaagtacacctacggcaagcccgtgaagggcgacgtgaccctgaccttcctgcccctgagcttctggggcaagaagaagaacatcaccaagaccttcaagatcaacggcagcgccaacttcagcttcaacgacgaggagatgaagaacgtgatggacagcagcaacggcctgagcgagtacctggacctgagcagccccggccccgtggagatcctgaccaccgtgaccgagagcgtgaccggcatcagcagaaacgtgagcaccaacgtgttcttcaagcagcacgactacatcatcgagttcttcgactacaccaccgtgctgaagcccagcctgaacttcaccgccaccgtgaaggtgaccagagccgacggcaaccagctgaccctggaggagagaagaaacaacgtggtgatcaccgtgacccagagaaactacaccgagtactggagcggcagcaacagcggcaaccagaagatggaggccgtgcagaagatcaactacaccgtgccccagagcggcaccttcaagatcgagttccccatcctggaggacagcagcgagctgcagctgaaggcctacttcctgggcagcaagagcagcatggccgtgcacagcctgttcaagagccccagcaagacctacatccagctgaagaccagagacgagaacatcaaggtgggcagccccttcgagctggtggtgagcggcaacaagagactgaaggagctgagctacatggtggtgagcagaggccagctggtggccgtgggcaagcagaacagcaccatgttcagcctgacccccgagaacagctggacccccaaggcctgcgtgatcgtgtactacatcgaggacgacggcgagatcatcagcgacgtgctgaagatccccgtgcagctggtgttcaagaacaagatcaagctgtactggagcaaggtgaaggccgagcccagcgagaaggtgagcctgagaatcagcgtgacccagcccgacagcatcgtgggcatcgtggccgtggacaagagcgtgaacctgatgaacgccagcaacgacatcaccatggagaacgtggtgcacgagctggagctgtacaacaccggctactacctgggcatgttcatgaacagcttcgccgtgttccaggagtgcggcctgtgggtgctgaccgacgccaacctgaccaaggactacatcgacggcgtgtacgacaacgccgagtacgccgagagattcatggaggagaacgagggccacatcgtggacatccacgacttcagcctgggcagcagcccccacgtgagaaagcacttccccgagacctggatctggctggacaccaacatgggctacagaatctaccaggagttcgaggtgaccgtgcccgacagcatcaccagctgggtggccaccggcttcgtgatcagcgaggacctgggcctgggcctgaccaccacccccgtggagctgcaggccttccagcccttcttcatcttcctgaacctgccctacagcgtgatcagaggcgaggagttcgccctggagatcaccatcttcaactacctgaaggacgccaccgaggtgaaggtgatcatcgagaagagcgacaagttcgacatcctgatgaccagcaacgagatcaacgccaccggccaccagcagaccctgctggtgcccagcgaggacggcgccaccgtgctgttccccatcagacccacccacctgggcgagatccccatcaccgtgaccgccctgagccccaccgccagcgacgccgtgacccagatgatcctggtgaaggccgagggcatcgagaagagctacagccagagcatcctgctggacctgaccgacaacagactgcagagcaccctgaagaccctgagcttcagcttcccccccaacaccgtgaccggcagcgagagagtgcagatcaccgccatcggcgacgtgctgggccccagcatcaacggcctggccagcctgatcagaatgccctacggctgcggcgagcagaacatgatcaacttcgcccccaacatctacatcctggactacctgaccaagaagaagcagctgaccgacaacctgaaggagaaggccctgagcttcatgagacagggctaccagagagagctgctgtaccagagagaggacggcagcttcagcgccttcggcaactacgaccccagcggcagcacctggctgagcgccttcgtgctgagatgcttcctggaggccgacccctacatcgacatcgaccagaacgtgctgcacagaacctacacctggctgaagggccaccagaagagcaacggcgagttctgggaccccggcagagtgatccacagcgagctgcagggcggcaacaagagccccgtgaccctgaccgcctacatcgtgaccagcctgctgggctacagaaagtaccagcccaacatcgacgtgcaggagagcatccacttcctggagagcgagttcagcagaggcatcagcgacaactacaccctggccctgatcacctacgccctgagcagcgtgggcagccccaaggccaaggaggccctgaacatgctgacctggagagccgagcaggagggcggcatgcagttctgggtgagcagcgagagcaagctgagcgacagctggcagcccagaagcctggacatcgaggtggccgcctacgccctgctgagccacttcctgcagttccagaccagcgagggcatccccatcatgagatggctgagcagacagagaaacagcctgggcggcttcgccagcacccaggacaccaccgtggccctgaaggccctgagcgagttcgccgccctgatgaacaccgagagaaccaacatccaggtgaccgtgaccggccccagcagccccagccccgtgaagttcctgatcgacacccacaacagactgctgctgcagaccgccgagctggccgtggtgcagcccaccgccgtgaacatcagcgccaacggcttcggcttcgccatctgccagctgaacgtggtgtacaacgtgaaggccagcggcagcagcagaagaagaagaagcatccagaaccaggaggccttcgacctggacgtggccgtgaaggagaacaaggacgacctgaaccacgtggacctgaacgtgtgcaccagcttcagcggccccggcagaagcggcatggccctgatggaggtgaacctgctgagcggcttcatggtgcccagcgaggccatcagcctgagcgagaccgtgaagaaggtggagtacgaccacggcaagctgaacctgtacctggacagcgtgaacgagacccagttctgcgtgaacatccccgccgtgagaaacttcaaggtgagcaacacccaggacgccagcgtgagcatcgtggactactacgagcccagaagacaggccgtgagaagctacaacagcgaggtgaagctgagcagctgcgacctgtgcagcgacgtgcagggctgcagaccctgcgaggacggcgccagcggcagccaccaccacagcagcgtgatcttcatcttctgcttcaagctgctgtacttcatggagctgtggctgtag

SEQ ID NO: 75834 - DNA, 4287 bp, Artificial Sequence
  Description of Artificial Sequence: Synthetic coding sequence
atgcagggcccccccctgctgaccgccgcccacctgctgtgcgtgtgcaccgccgccctggccgtggcccccggccccagattcctggtgaccgcccccggcatcatcagacccggcggcaacgtgaccatcggcgtggagctgctggagcactgccccagccaggtgaccgtgaaggccgagctgctgaagaccgccagcaacctgaccgtgagcgtgctggaggccgagggcgtgttcgagaagggcagcttcaagaccctgaccctgcccagcctgcccctgaacagcgccgacgagatctacgagctgagagtgaccggcagaacccaggacgagatcctgttcagcaacagcaccagactgagcttcgagaccaagagaatcagcgtgttcatccagaccgacaaggccctgtacaagcccaagcaggaggtgaagttcagaatcgtgaccctgttcagcgacttcaagccctacaagaccagcctgaacatcctgatcaaggaccccaagagcaacctgatccagcagtggctgagccagcagagcgacctgggcgtgatcagcaagaccttccagctgagcagccaccccatcctgggcgactggagcatccaggtgcaggtgaacgaccagacctactaccagagcttccaggtgagcgagtacgtgctgcccaagttcgaggtgaccctgcagacccccctgtactgcagcatgaacagcaagcacctgaacggcaccatcaccgccaagtacacctacggcaagcccgtgaagggcgacgtgaccctgaccttcctgcccctgagcttctggggcaagaagaagaacatcaccaagaccttcaagatcaacggcagcgccaacttcagcttcaacgacgaggagatgaagaacgtgatggacagcagcaacggcctgagcgagtacctggacctgagcagccccggccccgtggagatcctgaccaccgtgaccgagagcgtgaccggcatcagcagaaacgtgagcaccaacgtgttcttcaagcagcacgactacatcatcgagttcttcgactacaccaccgtgctgaagcccagcctgaacttcaccgccaccgtgaaggtgaccagagccgacggcaaccagctgaccctggaggagagaagaaacaacgtggtgatcaccgtgacccagagaaactacaccgagtactggagcggcagcaacagcggcaaccagaagatggaggccgtgcagaagatcaactacaccgtgccccagagcggcaccttcaagatcgagttccccatcctggaggacagcagcgagctgcagctgaaggcctacttcctgggcagcaagagcagcatggccgtgcacagcctgttcaagagccccagcaagacctacatccagctgaagaccagagacgagaacatcaaggtgggcagccccttcgagctggtggtgagcggcaacaagagactgaaggagctgagctacatggtggtgagcagaggccagctggtggccgtgggcaagcagaacagcaccatgttcagcctgacccccgagaacagctggacccccaaggcctgcgtgatcgtgtactacatcgaggacgacggcgagatcatcagcgacgtgctgaagatccccgtgcagctggtgttcaagaacaagatcaagctgtactggagcaaggtgaaggccgagcccagcgagaaggtgagcctgagaatcagcgtgacccagcccgacagcatcgtgggcatcgtggccgtggacaagagcgtgaacctgatgaacgccagcaacgacatcaccatggagaacgtggtgcacgagctggagctgtacaacaccggctactacctgggcatgttcatgaacagcttcgccgtgttccaggagtgcggcctgtgggtgctgaccgacgccaacctgaccaaggactacatcgacggcgtgtacgacaacgccgagtacgccgagagattcatggaggagaacgagggccacatcgtggacatccacgacttcagcctgggcagcagcccccacgtgagaaagcacttccccgagacctggatctggctggacaccaacatgggctacagaatctaccaggagttcgaggtgaccgtgcccgacagcatcaccagctgggtggccaccggcttcgtgatcagcgaggacctgggcctgggcctgaccaccacccccgtggagctgcaggccttccagcccttcttcatcttcctgaacctgccctacagcgtgatcagaggcgaggagttcgccctggagatcaccatcttcaactacctgaaggacgccaccgaggtgaaggtgatcatcgagaagagcgacaagttcgacatcctgatgaccagcaacgagatcaacgccaccggccaccagcagaccctgctggtgcccagcgaggacggcgccaccgtgctgttccccatcagacccacccacctgggcgagatccccatcaccgtgaccgccctgagccccaccgccagcgacgccgtgacccagatgatcctggtgaaggccgagggcatcgagaagagctacagccagagcatcctgctggacctgaccgacaacagactgcagagcaccctgaagaccctgagcttcagcttcccccccaacaccgtgaccggcagcgagagagtgcagatcaccgccatcggcgacgtgctgggccccagcatcaacggcctggccagcctgatcagaatgccctacggctgcggcgagcagaacatgatcaacttcgcccccaacatctacatcctggactacctgaccaagaagaagcagctgaccgacaacctgaaggagaaggccctgagcttcatgagacagggctaccagagagagctgctgtaccagagagaggacggcagcttcagcgccttcggcaactacgaccccagcggcagcacctggctgagcgccttcgtgctgagatgcttcctggaggccgacccctacatcgacatcgaccagaacgtgctgcacagaacctacacctggctgaagggccaccagaagagcaacggcgagttctgggaccccggcagagtgatccacagcgagctgcagggcggcaacaagagccccgtgaccctgaccgcctacatcgtgaccagcctgctgggctacagaaagtaccagcccaacatcgacgtgcaggagagcatccacttcctggagagcgagttcagcagaggcatcagcgacaactacaccctggccctgatcacctacgccctgagcagcgtgggcagccccaaggccaaggaggccctgaacatgctgacctggagagccgagcaggagggcggcatgcagttctgggtgagcagcgagagcaagctgagcgacagctggcagcccagaagcctggacatcgaggtggccgcctacgccctgctgagccacttcctgcagttccagaccagcgagggcatccccatcatgagatggctgagcagacagagaaacagcctgggcggcttcgccagcacccaggacaccaccgtggccctgaaggccctgagcgagttcgccgccctgatgaacaccgagagaaccaacatccaggtgaccgtgaccggccccagcagccccagccccctggccgtggtgcagcccaccgccgtgaacatcagcgccaacggcttcggcttcgccatctgccagctgaacgtggtgtacaacgtgaaggccagcggcagcagcagaagaagaagaagcatccagaaccaggaggccttcgacctggacgtggccgtgaaggagaacaaggacgacctgaaccacgtggacctgaacgtgtgcaccagcttcagcggccccggcagaagcggcatggccctgatggaggtgaacctgctgagcggcttcatggtgcccagcgaggccatcagcctgagcgagaccgtgaagaaggtggagtacgaccacggcaagctgaacctgtacctggacagcgtgaacgagacccagttctgcgtgaacatccccgccgtgagaaacttcaaggtgagcaacacccaggacgccagcgtgagcatcgtggactactacgagcccagaagacaggccgtgagaagctacaacagcgaggtgaagctgagcagctgcgacctgtgcagcgacgtgcagggctgcagaccctgcgaggacggcgccagcggcagccaccaccacagcagcgtgatcttcatcttctgcttcaagctgctgtacttcatggagctgtggctgtag

SEQ ID NO: 75835 - DNA, 762 bp, Artificial Sequence
  Description of Artificial Sequence: Synthetic coding sequence
atgggcgagttcaacgagaagaagaccacctgcggcaccgtgtgcctgaagtacctgctgttcacctacaactgctgcttctggctggccggcctggccgtgatggccgtgggcatctggaccctggccctgaagagcgactacatcagcctgctggccagcggcacctacctggccaccgcctacatcctggtggtggccggcaccgtggtgatggtgaccggcgtgctgggctgctgcgccaccttcaaggagagaagaaacctgctgagactgtacttcatcctgctgctgatcatcttcctgctggagatcatcgccggcatcctggcctacgcctactaccagcagctgaacaccgagctgaaggagaacctgaaggacaccatgaccaagagataccaccagcccggccacgaggccgtgaccagcgccgtggaccagctgcagcaggagttccactgctgcggcagcaacaacagccaggactggagagacagcgagtggatcagaagccaggaggccggcggcagagtggtgcccgacagctgctgcaagaccgtggtggccctgtgcggccagagagaccacgccagcaacatctacaaggtggagggcggctgcatcaccaagctggagaccttcatccaggagcacctgagagtgatcggcgccgtgggcatcggcatcgcctgcgtgcaggtgttcggcatgatcttcacctgctgcctgtacagaagcctgaagctggagcactactag

SEQ ID NO: 75836 - DNA, 762 bp, Artificial Sequence; identical to SEQ ID NO: 75835
  Description of Artificial Sequence: Synthetic coding sequence

SEQ ID NO: 75837 - DNA, 762 bp, Artificial Sequence; identical to SEQ ID NO: 75835
  Description of Artificial Sequence: Synthetic coding sequence

SEQ ID NO: 75838 - DNA, 543 bp, Artificial Sequence
  Description of Artificial Sequence: Synthetic coding sequence
atgggcgagttcaacgagaagaagaccacctgcggcaccgtgtgcctgaagtacctgctgttcacctacaactgctgcttctggctggccggcctggccgtgatggccgtgggcatctggaccctggccctgaagagcgactacatcagcctgctggccagcggcacctacctggccaccgcctacatcctggtggtggccggcaccgtggtgatggtgaccggcgtgctgggctgctgcgccaccttcaaggagagaagaaacctgctgagactgtacttcatcctgctgctgatcatcttcctgctggagatcatcgccggcatcctggcctacgcctactaccagcagctgaacaccgagctgaaggagaacctgaaggacaccatgaccaagagataccaccagcccggccacgaggccgtgaccagcgccgtggaccagctgcagcaggagttccactgctgcggcagcaacaacagccaggactggagagacagcgagtggatcagaagccaggaggccggcggcagagtggtgtag

SEQ ID NO: 75839 - DNA, 240 bp, Artificial Sequence
  Description of Artificial Sequence: Synthetic coding sequence
atgggcgagttcaacgagaagaagaccacctgcggcaccgtgtgcctgaagtacctgctgttcacctacaactgctgcttctggctggccggcctggccgtgatggccgtgggcatctggaccctggccctgaagagcgactacatcagcctgctggccagcggcacctacctggccaccgcctacatcctggtggtggccggcaccgtggtgatggtgaccggcgtgctgggctgctag

SEQ ID NO: 75840 - DNA, 279 bp, Artificial Sequence
  Description of Artificial Sequence: Synthetic coding sequence
atgggcgagttcaacgagaagaagaccacctgcggcaccgtgtgcctgaagtacctgctgttcacctacaactgctgcttctggctggccggcctggccgtgatggccgtgggcatctggaccctggccctgaagagcgactacatcagcctgctggccagcggcacctacctggccaccgcctacatcctggtggtggccggcaccgtggtgatggtgaccggcgtgctgggctgctgcgccaccttcaaggagagaagaaacctgctgagactgtag

SEQ ID NO: 75841 - DNA, 198 bp, Artificial Sequence
  Description of Artificial Sequence: Synthetic coding sequence
atgggcgagttcaacgagaagaagaccacctgcggcaccgtgtgcctgaagtacctgctgttcacctacaactgctgcttctggctggccggcctggccgtgatggccgtgggcatctggaccctggccctgaagagcgactacatcagcctgctggccagcggcacctacctggccaccgcctacatcctggtgtag

SEQ ID NO: 75842 - DNA, 531 bp, Artificial Sequence
  Description of Artificial Sequence: Synthetic coding sequence
atgggcgagttcaacgagaagaagaccacctgcggcaccgtgtgcctgaagtacctgctgttcacctacaactgctgcttctggctggccggcctggccgtgatggccgtgggcatctggaccctggccctgaagagcgactacatcagcctgctggccagcggcacctacctggccaccgcctacatcctggtggtggccggcaccgtggtgatggtgaccggcgtgctgggctgctgcgccaccttcaaggagagaagaaacctgctgagactgtacttcatcctgctgctgatcatcttcctgctggagatcatcgccggcatcctggcctacgcctactaccagcagctgaacaccgagctgaaggagaacctgaaggacaccatgaccaagagataccaccagcccggccacgaggccgtgaccagcgccgtggaccagctgcagcaggagttccactgctgcggcagcaacaacagccaggactggagagacagcgagtggatcagaagccaggaggccggctag

SEQ ID NO: 75843 - DNA, 543 bp, Artificial Sequence; identical to SEQ ID NO: 75838
  Description of Artificial Sequence: Synthetic coding sequence

SEQ ID NO: 75844 - DNA, 273 bp, Artificial Sequence
  Description of Artificial Sequence: Synthetic coding sequence
atgggcgagttcaacgagaagaagaccacctgcggcaccgtgtgcctgaagtacctgctgttcacctacaactgctgcttctggctggccggcctggccgtgatggccgtgggcatctggaccctggccctgaagagcgactacatcagcctgctggccagcggcacctacctggccaccgcctacatcctggtggtggccggcaccgtggtgatggtgaccggcgtgctgggctgctgcgccaccttcaaggagagaagaaacctgctgtag

SEQ ID NO: 75845 - DNA, 513 bp, Artificial Sequence
  Description of Artificial Sequence: Synthetic coding sequence
atgggcgagttcaacgagaagaagaccacctgcggcaccgtgtgcctgaagtacctgctgttcacctacaactgctgcttctggctggccggcctggccgtgatggccgtgggcatctggaccctggccctgaagagcgactacatcagcctgctggccagcggcacctacctggccaccgcctacatcctggtggtggccggcaccgtggtgatggtgaccggcgtgctgggctgctgcgccaccttcaaggagagaagaaacctgctgagactgtacttcatcctgctgctgatcatcttcctgctggagatcatcgccggcatcctggcctacgcctactaccagcagctgaacaccgagctgaaggagaacctgaaggacaccatgaccaagagataccaccagcccggccacgaggccgtgaccagcgccgtggaccagctgcagcaggagttccactgctgcggcagcaacaacagccaggactggagagacagcgagtggatctag

SEQ ID NO: 75846 - DNA, 762 bp, Artificial Sequence; identical to SEQ ID NO: 75835
  Description of Artificial Sequence: Synthetic coding sequence

SEQ ID NO: 75847 - DNA, 3471 bp, Artificial Sequence
  Description of Artificial Sequence: Synthetic coding sequence
atgagcaagctgagaatggtgctgctggaggacagcggcagcgccgacttcagaagacacttcgtgaacctgagccccttcaccatcaccgtggtgctgctgctgagcgcctgcttcgtgaccagcagcctgggcggcaccgacaaggagctgagactggtggacggcgagaacaagtgcagcggcagagtggaggtgaaggtgcaggaggagtggggcaccgtgtgcaacaacggctggagcatggaggccgtgagcgtgatctgcaaccagctgggctgccccaccgccatcaaggcccccggctgggccaacagcagcgccggcagcggcagaatctggatggaccacgtgagctgcagaggcaacgagagcgccctgtgggactgcaagcacgacggctggggcaagcacagcaactgcacccaccagcaggacgccggcgtgacctgcagcgacggcagcaacctggagatgagactgaccagaggcggcaacatgtgcagcggcagaatcgagatcaagttccagggcagatggggcaccgtgtgcgacgacaacttcaacatcgaccacgccagcgtgatctgcagacagctggagtgcggcagcgccgtgagcttcagcggcagcagcaacttcggcgagggcagcggccccatctggttcgacgacctgatctgcaacggcaacgagagcgccctgtggaactgcaagcaccagggctggggcaagcacaactgcgaccacgccgaggacgccggcgtgatctgcagcaagggcgccgacctgagcctgagactggtggacggcgtgaccgagtgcagcggcagactggaggtgagattccagggcgagtggggcaccatctgcgacgacggctgggacagctacgacgccgccgtggcctgcaagcagctgggctgccccaccgccgtgaccgccatcggcagagtgaacgccagcaagggcttcggccacatctggctggacagcgtgagctgccagggccacgagcccgccatctggcagtgcaagcaccacgagtggggcaagcactactgcaaccacaacgaggacgccggcgtgacctgcagcgacggcagcgacctggagctgagactgagaggcggcggcagcagatgcgccggcaccgtggaggtggagatccagagactgctgggcaaggtgtgcgacagaggctggggcctgaaggaggccgacgtggtgtgcagacagctgggctgcggcagcgccctgaagaccagctaccaggtgtacagcaagatccaggccaccaacacctggctgttcctgagcagctgcaacggcaacgagaccagcctgtgggactgcaagaactggcagtggggcggcctgacctgcgaccactacgaggaggccaagatcacctgcagcgcccacagagagcccagactggtgggcggcgacatcccctgcagcggcagagtggaggtgaagcacggcgacacctggggcagcatctgcgacagcgacttcagcctggaggccgccagcgtgctgtgcagagagctgcagtgcggcaccgtggtgagcatcctgggcggcgcccacttcggcgagggcaacggccagatctgggccgaggagttccagtgcgagggccacgagagccacctgagcctgtgccccgtggcccccagacccgagggcacctgcagccacagcagagacgtgggcgtggtgtgcagcagatacaccgagatcagactggtgaacggcaagaccccctgcgagggcagagtggagctgaagaccctgggcgcctggggcagcctgtgcaacagccactgggacatcgaggacgcccacgtgctgtgccagcagctgaagtgcggcgtggccctgagcacccccggcggcgccagattcggcaagggcaacggccagatctggagacacatgttccactgcaccggcaccgagcagcacatgggcgactgccccgtgaccgccctgggcgccagcctgtgccccagcgagcaggtggccagcgtgatctgcagcggcaaccagagccagaccctgagcagctgcaacagcagcagcctgggccccaccagacccaccatccccgaggagagcgccgtggcctgcatcgagagcggccagctgagactggtgaacggcggcggcagatgcgccggcagagtggagatctaccacgagggcagctggggcaccatctgcgacgacagctgggacctgagcgacgcccacgtggtgtgcagacagctgggctgcggcgaggccatcaacgccaccggcagcgcccacttcggcgagggcaccggccccatctggctggacgagatgaagtgcaacggcaaggagagcagaatctggcagtgccacagccacggctggggccagcagaactgcagacacaaggaggacgccggcgtgatctgcagcgagttcatgagcctgagactgaccagcgaggccagcagagaggcctgcgccggcagactggaggtgttctacaacggcgcctggggcaccgtgggcaagagcagcatgagcgagaccaccgtgggcgtggtgtgcagacagctgggctgcgccgacaagggcaagatcaaccccgccagcctggacaaggccatgagcatccccatgtgggtggacaacgtgcagtgccccaagggccccgacaccctgtggcagtgccccagcagcccctgggagaagagactggccagccccagcgaggagacctggatcacctgcgacaacaagatcagactgcaggagggccccaccagctgcagcggcagagtggagatctggcacggcggcagctggggcaccgtgtgcgacgacagctgggacctggacgacgcccaggtggtgtgccagcagctgggctgcggccccgccctgaaggccttcaaggaggccgagttcggccagggcaccggccccatctggctgaacgaggtgaagtgcaagggcaacgagagcagcctgtgggactgccccgccagaagatggggccacagcgagtgcggccacaaggaggacgccgccgtgaactgcaccgacatcagcgtgcagaagaccccccagaaggccaccaccggcagaagcagcagacagagcagcttcatcgccgtgggcatcctgggcgtggtgctgctggccatcttcgtggccctgttcttcctgaccaagaagagaagacagagacagagactggccgtgagcagcagaggcgagaacctggtgcaccagatccagtacagagagatgaacagctgcctgaacgccgacgacctggacctgatgaacagcagcgagaacagccacgagagcgccgacttcagcgccgccgagctgatcagcgtgagcaagttcctgcccatcagcggcatggagaaggaggccatcctgagccacaccgagaaggagaacggcaacctgtag

SEQ ID NO: 75848 - DNA, 3465 bp, Artificial Sequence
  Description of Artificial Sequence: Synthetic coding sequence
atgagcaagctgagaatggtgctgctggaggacagcggcagcgccgacttcagaagacacttcgtgaacctgagccccttcaccatcaccgtggtgctgctgctgagcgcctgcttcgtgaccagcagcctgggcggcaccgacaaggagctgagactggtggacggcgagaacaagtgcagcggcagagtggaggtgaaggtgcaggaggagtggggcaccgtgtgcaacaacggctggagcatggaggccgtgagcgtgatctgcaaccagctgggctgccccaccgccatcaaggcccccggctgggccaacagcagcgccggcagcggcagaatctggatggaccacgtgagctgcagaggcaacgagagcgccctgtgggactgcaagcacgacggctggggcaagcacagcaactgcacccaccagcaggacgccggcgtgacctgcagcgacggcagcaacctggagatgagactgaccagaggcggcaacatgtgcagcggcagaatcgagatcaagttccagggcagatggggcaccgtgtgcgacgacaacttcaacatcgaccacgccagcgtgatctgcagacagctggagtgcggcagcgccgtgagcttcagcggcagcagcaacttcggcgagggcagcggccccatctggttcgacgacctgatctgcaacggcaacgagagcgccctgtggaactgcaagcaccagggctggggcaagcacaactgcgaccacgccgaggacgccggcgtgatctgcagcaagggcgccgacctgagcctgagactggtggacggcgtgaccgagtgcagcggcagactggaggtgagattccagggcgagtggggcaccatctgcgacgacggctgggacagctacgacgccgccgtggcctgcaagcagctgggctgccccaccgccgtgaccgccatcggcagagtgaacgccagcaagggcttcggccacatctggctggacagcgtgagctgccagggccacgagcccgccatctggcagtgcaagcaccacgagtggggcaagcactactgcaaccacaacgaggacgccggcgtgacctgcagcgacggcagcgacctggagctgagactgagaggcggcggcagcagatgcgccggcaccgtggaggtggagatccagagactgctgggcaaggtgtgcgacagaggctggggcctgaaggaggccgacgtggtgtgcagacagctgggctgcggcagcgccctgaagaccagctaccaggtgtacagcaagatccaggccaccaacacctggctgttcctgagcagctgcaacggcaacgagaccagcctgtgggactgcaagaactggcagtggggcggcctgacctgcgaccactacgaggaggccaagatcacctgcagcgcccacagagagcccagactggtgggcggcgacatcccctgcagcggcagagtggaggtgaagcacggcgacacctggggcagcatctgcgacagcgacttcagcctggaggccgccagcgtgctgtgcagagagctgcagtgcggcaccgtggtgagcatcctgggcggcgcccacttcggcgagggcaacggccagatctgggccgaggagttccagtgcgagggccacgagagccacctgagcctgtgccccgtggcccccagacccgagggcacctgcagccacagcagagacgtgggcgtggtgtgcagcagcaagacccagaagaccagcctgatcggcagccacaccgtgaagggcaccggcctgggcagccacagctgcctgttcctgaagccctgcctgctgcccggctacaccgagatcagactggtgaacggcaagaccccctgcgagggcagagtggagctgaagaccctgggcgcctggggcagcctgtgcaacagccactgggacatcgaggacgcccacgtgctgtgccagcagctgaagtgcggcgtggccctgagcacccccggcggcgccagattcggcaagggcaacggccagatctggagacacatgttccactgcaccggcaccgagcagcacatgggcgactgccccgtgaccgccctgggcgccagcctgtgccccagcgagcaggtggccagcgtgatctgcagcggcaaccagagccagaccctgagcagctgcaacagcagcagcctgggccccaccagacccaccatccccgaggagagcgccgtggcctgcatcgagagcggccagctgagactggtgaacggcggcggcagatgcgccggcagagtggagatctaccacgagggcagctggggcaccatctgcgacgacagctgggacctgagcgacgcccacgtggtgtgcagacagctgggctgcggcgaggccatcaacgccaccggcagcgcccacttcggcgagggcaccggccccatctggctggacgagatgaagtgcaacggcaaggagagcagaatctggcagtgccacagccacggctggggccagcagaactgcagacacaaggaggacgccggcgtgatctgcagcgagttcatgagcctgagactgaccagcgaggccagcagagaggcctgcgccggcagactggaggtgttctacaacggcgcctggggcaccgtgggcaagagcagcatgagcgagaccaccgtgggcgtggtgtgcagacagctgggctgcgccgacaagggcaagatcaaccccgccagcctggacaaggccatgagcatccccatgtgggtggacaacgtgcagtgccccaagggccccgacaccctgtggcagtgccccagcagcccctgggagaagagactggccagccccagcgaggagacctggatcacctgcgacaacaagatcagactgcaggagggccccaccagctgcagcggcagagtggagatctggcacggcggcagctggggcaccgtgtgcgacgacagctgggacctggacgacgcccaggtggtgtgccagcagctgggctgcggccccgccctgaaggccttcaaggaggccgagttcggccagggcaccggccccatctggctgaacgaggtgaagtgcaagggcaacgagagcagcctgtgggactgccccgccagaagatggggccacagcgagtgcggccacaaggaggacgccgccgtgaactgcaccgacatcagcgtgcagaagaccccccagaaggccaccaccggcagaagcagcagacagagcagcttcatcgccgtgggcatcctgggcgtggtgctgctggccatcttcgtggccctgttcttcctgaccaagaagagaagacagagacagagactggccgtgagcagcagaggcgagaacctggtgcaccagatccagtacagagagatgaacagctgcctgaacgccgacgacctggacctgatgaacagcagcggcggccacagcgagccccactag

SEQ ID NO: 75849 - DNA, 3366 bp, Artificial Sequence
  Description of Artificial Sequence: Synthetic coding sequence
atgagcaagctgagaatggtgctgctggaggacagcggcagcgccgacttcagaagacacttcgtgaacctgagccccttcaccatcaccgtggtgctgctgctgagcgcctgcttcgtgaccagcagcctgggcggcaccgacaaggagctgagactggtggacggcgagaacaagtgcagcggcagagtggaggtgaaggtgcaggaggagtggggcaccgtgtgcaacaacggctggagcatggaggccgtgagcgtgatctgcaaccagctgggctgccccaccgccatcaaggcccccggctgggccaacagcagcgccggcagcggcagaatctggatggaccacgtgagctgcagaggcaacgagagcgccctgtgggactgcaagcacgacggctggggcaagcacagcaactgcacccaccagcaggacgccggcgtgacctgcagcgacggcagcaacctggagatgagactgaccagaggcggcaacatgtgcagcggcagaatcgagatcaagttccagggcagatggggcaccgtgtgcgacgacaacttcaacatcgaccacgccagcgtgatctgcagacagctggagtgcggcagcgccgtgagcttcagcggcagcagcaacttcggcgagggcagcggccccatctggttcgacgacctgatctgcaacggcaacgagagcgccctgtggaactgcaagcaccagggctggggcaagcacaactgcgaccacgccgaggacgccggcgtgatctgcagcaagggcgccgacctgagcctgagactggtggacggcgtgaccgagtgcagcggcagactggaggtgagattccagggcgagtggggcaccatctgcgacgacggctgggacagctacgacgccgccgtggcctgcaagcagctgggctgccccaccgccgtgaccgccatcggcagagtgaacgccagcaagggcttcggccacatctggctggacagcgtgagctgccagggccacgagcccgccatctggcagtgcaagcaccacgagtggggcaagcactactgcaaccacaacgaggacgccggcgtgacctgcagcgacggcagcgacctggagctgagactgagaggcggcggcagcagatgcgccggcaccgtggaggtggagatccagagactgctgggcaaggtgtgcgacagaggctggggcctgaaggaggccgacgtggtgtgcagacagctgggctgcggcagcgccctgaagaccagctaccaggtgtacagcaagatccaggccaccaacacctggctgttcctgagcagctgcaacggcaacgagaccagcctgtgggactgcaagaactggcagtggggcggcctgacctgcgaccactacgaggaggccaagatcacctgcagcgcccacagagagcccagactggtgggcggcgacatcccctgcagcggcagagtggaggtgaagcacggcgacacctggggcagcatctgcgacagcgacttcagcctggaggccgccagcgtgctgtgcagagagctgcagtgcggcaccgtggtgagcatcctgggcggcgcccacttcggcgagggcaacggccagatctgggccgaggagttccagtgcgagggccacgagagccacctgagcctgtgccccgtggcccccagacccgagggcacctgcagccacagcagagacgtgggcgtggtgtgcagcagatacaccgagatcagactggtgaacggcaagaccccctgcgagggcagagtggagctgaagaccctgggcgcctggggcagcctgtgcaacagccactgggacatcgaggacgcccacgtgctgtgccagcagctgaagtgcggcgtggccctgagcacccccggcggcgccagattcggcaagggcaacggccagatctggagacacatgttccactgcaccggcaccgagcagcacatgggcgactgccccgtgaccgccctgggcgccagcctgtgccccagcgagcaggtggccagcgtgatctgcagcggcaaccagagccagaccctgagcagctgcaacagcagcagcctgggccccaccagacccaccatccccgaggagagcgccgtggcctgcatcgagagcggccagctgagactggtgaacggcggcggcagatgcgccggcagagtggagatctaccacgagggcagctggggcaccatctgcgacgacagctgggacctgagcgacgcccacgtggtgtgcagacagctgggctgcggcgaggccatcaacgccaccggcagcgcccacttcggcgagggcaccggccccatctggctggacgagatgaagtgcaacggcaaggagagcagaatctggcagtgccacagccacggctggggccagcagaactgcagacacaaggaggacgccggcgtgatctgcagcgagttcatgagcctgagactgaccagcgaggccagcagagaggcctgcgccggcagactggaggtgttctacaacggcgcctggggcaccgtgggcaagagcagcatgagcgagaccaccgtgggcgtggtgtgcagacagctgggctgcgccgacaagggcaagatcaaccccgccagcctggacaaggccatgagcatccccatgtgggtggacaacgtgcagtgccccaagggccccgacaccctgtggcagtgccccagcagcccctgggagaagagactggccagccccagcgaggagacctggatcacctgcgacaacaagatcagactgcaggagggccccaccagctgcagcggcagagtggagatctggcacggcggcagctggggcaccgtgtgcgacgacagctgggacctggacgacgcccaggtggtgtgccagcagctgggctgcggccccgccctgaaggccttcaaggaggccgagttcggccagggcaccggccccatctggctgaacgaggtgaagtgcaagggcaacgagagcagcctgtgggactgccccgccagaagatggggccacagcgagtgcggccacaaggaggacgccgccgtgaactgcaccgacatcagcgtgcagaagaccccccagaaggccaccaccggcagaagcagcagacagagcagcttcatcgccgtgggcatcctgggcgtggtgctgctggccatcttcgtggccctgttcttcctgaccaagaagagaagacagagacagagactggccgtgagcagcagaggcgagaacctggtgcaccagatccagtacagagagatgaacagctgcctgaacgccgacgacctggacctgatgaacagcagcggcggccacagcgagccccactag

SEQ ID NO: 75850 - DNA, 555 bp, Artificial Sequence
  Description of Artificial Sequence: Synthetic coding sequence
atgagcagactgagcagaagcctgctgtgggccgccacctgcctgggcgtgctgtgcgtgctgagcgccgacaagaacaccacccagcaccccaacgtgaccaccctggcccccatcagcaacgtgaccagcgcccccgtgaccagcctgcccctggtgaccacccccgcccccgagacctgcgagggcagaaacagctgcgtgagctgcttcaacgtgagcgtggtgaacaccacctgcttctggatcgagtgcaaggacgagagctactgcagccacaacagcaccgtgagcgactgccaggtgggcaacaccaccgacttctgcagcgccaagcccaccgtgcagcccagccccagcaccaccagcaagaccgtgaccaccagcggcaccaccaacaacaccgtgacccccaccagccagcccgtgagaaagagcaccttcgacgccgccagcttcatcggcggcatcgtgctggtgctgggcgtgcaggccgtgatcttcttcctgtacaagttctgcaagagcaaggagagaaactaccacaccctgtag

SEQ ID NO: 75851 - DNA, 594 bp, Artificial Sequence
  Description of Artificial Sequence: Synthetic coding sequence
atgagcagactgagcagaagcctgctgtgggccgccacctgcctgggcgtgctgtgcgtgctgagcgccgacaagaacaccacccagcaccccaacgtgaccaccctggcccccatcagcaacgtgaccagcgcccccgtgaccagcctgcccctggtgaccacccccgcccccgagacctgcgagggcagaaacagctgcgtgagctgcttcaacgtgagcgtggtgaacaccacctgcttctggatcgagtgcaaggacgagagctactgcagccacaacagcaccgtgagcgactgccaggtgggcaacaccaccgacttctgcagcgtgagcaccgccacccccgtgcccaccgccaacagcaccgccaagcccaccgtgcagcccagccccagcaccaccagcaagaccgtgaccaccagcggcaccaccaacaacaccgtgacccccaccagccagcccgtgagaaagagcaccttcgacgccgccagcttcatcggcggcatcgtgctggtgctgggcgtgcaggccgtgatcttcttcctgtacaagttctgcaagagcaaggagagaaactaccacaccctgtag

SEQ ID NO: 75852 - DNA, 537 bp, Artificial Sequence
  Description of Artificial Sequence: Synthetic coding sequence
atgagcagactgagcagaagcctgctgtgggccgccacctgcctgggcgtgctgtgcgtgctgagcgccgacaagaacaccacccagcaccccaacgtgaccaccctggcccccatcagcaacgtgaccagcgcccccgtgaccagcctgcccctggtgaccacccccgcccccgagacctgcgagggcagaaacagctgcgtgagctgcttcaacgtgagcgtggtgaacaccacctgcttctggatcgagtgcaaggacgagagctactgcagccacaacagcaccgtgagcgactgccaggtgggcaacaccaccgacttctgcagcgtgagcaccgccacccccgtgcccaccgccaacagcaccggcaccaccaacaacaccgtgacccccaccagccagcccgtgagaaagagcaccttcgacgccgccagcttcatcggcggcatcgtgctggtgctgggcgtgcaggccgtgatcttcttcctgtacaagttctgcaagagcaaggagagaaactaccacaccctgtag

SEQ ID NO: 75853 - DNA, 498 bp, Artificial Sequence
  Description of Artificial Sequence: Synthetic coding sequence
atgagcagactgagcagaagcctgctgtgggccgccacctgcctgggcgtgctgtgcgtgctgagcgccgacaagaacaccacccagcaccccaacgtgaccaccctggcccccatcagcaacgtgaccagcgcccccgtgaccagcctgcccctggtgaccacccccgcccccgagacctgcgagggcagaaacagctgcgtgagctgcttcaacgtgagcgtggtgaacaccacctgcttctggatcgagtgcaaggacgagagctactgcagccacaacagcaccgtgagcgactgccaggtgggcaacaccaccgacttctgcagcggcaccaccaacaacaccgtgacccccaccagccagcccgtgagaaagagcaccttcgacgccgccagcttcatcggcggcatcgtgctggtgctgggcgtgcaggccgtgatcttcttcctgtacaagttctgcaagagcaaggagagaaactaccacaccctgtag

SEQ ID NO: 75854 - DNA, 570 bp, Artificial Sequence
  Description of Artificial Sequence: Synthetic coding sequence
atgagcagactgagcagaagcctgctgtgggccgccacctgcctgggcgtgctgtgcgtgctgagcgccgacaagaacaccacccagcaccccaacgtgaccaccctggcccccatcagcaacgtgaccagcgcccccgtgaccagcctgcccctggtgaccacccccgcccccgagacctgcgagggcagaaacagctgcgtgagctgcttcaacgtgagcgtggtgaacaccacctgcttctggatcgagtgcaaggacgagagctactgcagccacaacagcaccgtgagcgactgccaggtgggcaacaccaccgacttctgcagcgtgagcaccgccacccccgtgcccaccgccaacagcaccgccaagcccaccgtgcagcccagccccagcaccaccagcaagaccgtgaccaccagcggcaccaccaacaacaccgtgacccccaccagccagcccgtgagaaagagcaccttcgacgccgccagcttcatcggcggcatcgtgctggtgctggagatcagatgccacaccagaaactacatccccgacctgaagaagtag

SEQ ID NO: 75855 - DNA, 474 bp, Artificial Sequence
  Description of Artificial Sequence: Synthetic coding sequence
atgagcagactgagcagaagcctgctgtgggccgccacctgcctgggcgtgctgtgcgtgctgagcgccgacaagaacaccacccagcaccccaacgtgaccaccctggcccccatcagcaacgtgaccagcgcccccgtgaccagcctgcccctggtgaccacccccgcccccgagacctgcgagggcagaaacagctgcgtgagctgcttcaacgtgagcgtggtgaacaccacctgcttctggatcgagtgcaaggacgagagctactgcagccacaacagcaccgtgagcgactgccaggtgggcaacaccaccgacttctgcagcgtgagcaccgccacccccgtgcccaccgccaacagcaccgccaagcccaccgtgcagcccagccccagcaccaccagcaagaccgtgaccaccagcgagatcagatgccacaccagaaactacatccccgacctgaagaagtag

SEQ ID NO: 75856 - DNA, 747 bp, Artificial Sequence
  Description of Artificial Sequence: Synthetic coding sequence
atgagcgccgtgctgctgctggccctgctgggcttcatcctgcccctgcccggcgtgcaggccctgctgtgccagttcggcaccgtgcagcacgtgtggaaggtgagcgacctgcccagacagtggacccccaagaacaccagctgcgacagcggcctgggctgccaggacaccctgatgctgatcgagagcggcccccaggtgagcctggtgctgagcaagggctgcaccgaggccaaggaccaggagcccagagtgaccgagcacagaatgggccccggcctgagcctgatcagctacaccttcgtgtgcagacaggaggacttctgcaacaacctggtgaacagcctgcccctgtgggccccccagccccccgccgaccccggcagcctgagatgccccgtgtgcctgagcatggagggctgcctggagggcaccaccgaggagatctgccccaagggcaccacccactgctacgacggcctgctgagactgagaggcggcggcatcttcagcaacctgagagtgcagggctgcatgccccagcccgtgtgcaacctgctgaacggcacccaggagatcggccccgtgggcatgaccgagaactgcgacatgaaggacttcctgcagctgaagcccgtgggcctgctggaggagcacaacgtgggcgagaaggagagaggccagggccagcaccagtgcgtgcagctggactggcagaagagagccgccaccggcatcttctag

SEQ ID NO: 75857 - DNA, 438 bp, Artificial Sequence
  Description of Artificial Sequence: Synthetic coding sequence
atgagcgccgtgctgctgctggccctgctgggcttcatcctgcccctgcccggcgtgcaggccctgctgtgccagttcggcaccgtgcagcacgtgtggaaggtgagcgacctgcccagacagtggacccccaagaacaccagctgcgacagcggcctgggctgccaggacaccctgatgctgatcgagagcggcccccaggtgagcctggtgctgagcaagggctgcaccgaggccaaggaccaggagcccagagtgaccgagcacagaatgggccccggcctgagcctgatcagctacaccttcgtgtgcagacaggaggacttctgcaacaacctggtgaacagcctgcccctgtgggccccccagccccccgccgaccccatgatgggcgccgccgagggccccttcggcaaggccgagcaggtggacagctag

SEQ ID NO: 75858 - DNA, 438 bp, Artificial Sequence; identical to SEQ ID NO: 75857
  Description of Artificial Sequence: Synthetic coding sequence

SEQ ID NO: 75859 - DNA, 1671 bp, Artificial Sequence
  Description of Artificial Sequence: Synthetic coding sequence
atgcccccccccagactgctgttcttcctgctgttcctgacccccatggaggtgagacccgaggagcccctggtggtgaaggtggaggagggcgacaacgccgtgctgcagtgcctgaagggcaccagcgacggccccacccagcagctgacctggagcagagagagccccctgaagcccttcctgaagctgagcctgggcctgcccggcctgggcatccacatgagacccctggccatctggctgttcatcttcaacgtgagccagcagatgggcggcttctacctgtgccagcccggcccccccagcgagaaggcctggcagcccggctggaccgtgaacgtggagggcagcggcgagctgttcagatggaacgtgagcgacctgggcggcctgggctgcggcctgaagaacagaagcagcgagggccccagcagccccagcggcaagctgatgagccccaagctgtacgtgtgggccaaggacagacccgagatctgggagggcgagcccccctgcctgccccccagagacagcctgaaccagagcctgagccaggacctgaccatggcccccggcagcaccctgtggctgagctgcggcgtgccccccgacagcgtgagcagaggccccctgagctggacccacgtgcaccccaagggccccaagagcctgctgagcctggagctgaaggacgacagacccgccagagacatgtgggtgatggagaccggcctgctgctgcccagagccaccgcccaggacgccggcaagtactactgccacagaggcaacctgaccatgagcttccacctggagatcaccgccagacccgtgctgtggcactggctgctgagaaccggcggctggaaggtgagcgccgtgaccctggcctacctgatcttctgcctgtgcagcctggtgggcatcctgcacctgcagagagccctggtgctgagaagaaagagaaagagaatgaccgaccccaccagaagattcttcaaggtgacccccccccccggcagcggcccccagaaccagtacggcaacgtgctgagcctgcccacccccaccagcggcctgggcagagcccagagatgggccgccggcctgggcggcaccgcccccagctacggcaaccccagcagcgacgtgcaggccgacggcgccctgggcagcagaagcccccccggcgtgggccccgaggaggaggagggcgagggctacgaggagcccgacagcgaggaggacagcgagttctacgagaacgacagcaacctgggccaggaccagctgagccaggacggcagcggctacgagaaccccgaggacgagcccctgggccccgaggacgaggacagcttcagcaacgccgagagctacgagaacgaggacgaggagctgacccagcccgtggccagaaccatggacttcctgagcccccacggcagcgcctgggaccccagcagagaggccaccagcctgggcagccagagctacgaggacatgagaggcatcctgtacgccgccccccagctgagaagcatcagaggccagcccggccccaaccacgaggaggacgccgacagctacgagaacatggacaaccccgacggccccgaccccgcctggggcggcggcggcagaatgggcacctggagcaccagatag

SEQ ID NO: 75860 - DNA, 1092 bp, Artificial Sequence
  Description of Artificial Sequence: Synthetic coding sequence
atggaggtgagacccgaggagcccctggtggtgaaggtggaggagggcgacaacgccgtgctgcagtgcctgaagggcaccagcgacggccccacccagcagctgacctggagcagagagagccccctgaagcccttcctgaagctgagcctgggcctgcccggcctgggcatccacatgagacccctgggcaagtactactgccacagaggcaacctgaccatgagcttccacctggagatcaccgccagacccgtgctgtggcactggctgctgagaaccggcggctggaaggtgagcgccgtgaccctggcctacctgatcttctgcctgtgcagcctggtgggcatcctgcacctgcagagagccctggtgctgagaagaaagagaaagagaatgaccgaccccaccagaagattcttcaaggtgacccccccccccggcagcggcccccagaaccagtacggcaacgtgctgagcctgcccacccccaccagcggcctgggcagagcccagagatgggccgccggcctgggcggcaccgcccccagctacggcaaccccagcagcgacgtgcaggccgacggcgccctgggcagcagaagcccccccggcgtgggccccgaggaggaggagggcgagggctacgaggagcccgacagcgaggaggacagcgagttctacgagaacgacagcaacctgggccaggaccagctgagccaggacggcagcggctacgagaaccccgaggacgagcccctgggccccgaggacgaggacagcttcagcaacgccgagagctacgagaacgaggacgaggagctgacccagcccgtggccagaaccatggacttcctgagcccccacggcagcgcctgggaccccagcagagaggccaccagcctgggcagccagagctacgaggacatgagaggcatcctgtacgccgccccccagctgagaagcatcagaggccagcccggccccaaccacgaggaggacgccgacagctacgagaacatggacaaccccgacggccccgaccccgcctggggcggcggcggcagaatgggcacctggagcaccagatag

SEQ ID NO: 75861 - DNA, 1218 bp, Artificial Sequence
  Description of Artificial Sequence: Synthetic coding sequence
atgagccccaagctgtacgtgtgggccaaggacagacccgagatctgggagggcgagcccccctgcctgccccccagagacagcctgaaccagagcctgagccaggacctgaccatggcccccggcagcaccctgtggctgagctgcggcgtgccccccgacagcgtgagcagaggccccctgagctggacccacgtgcaccccaagggccccaagagcctgctgagcctggagctgaaggacgacagacccgccagagacatgtgggtgatggagaccggcctgctgctgcccagagccaccgcccaggacgccggcaagtactactgccacagaggcaacctgaccatgagcttccacctggagatcaccgccagacccgtgctgtggcactggctgctgagaaccggcggctggaaggtgagcgccgtgaccctggcctacctgatcttctgcctgtgcagcctggtgggcatcctgcacctgcagagagccctggtgctgagaagaaagagaaagagaatgaccgaccccaccagaagattcttcaaggtgacccccccccccggcagcggcccccagaaccagtacggcaacgtgctgagcctgcccacccccaccagcggcctgggcagagcccagagatgggccgccggcctgggcggcaccgcccccagctacggcaaccccagcagcgacgtgcaggccgacggcgccctgggcagcagaagcccccccggcgtgggccccgaggaggaggagggcgagggctacgaggagcccgacagcgaggaggacagcgagttctacgagaacgacagcaacctgggccaggaccagctgagccaggacggcagcggctacgagaaccccgaggacgagcccctgggccccgaggacgaggacagcttcagcaacgccgagagctacgagaacgaggacgaggagctgacccagcccgtggccagaaccatggacttcctgagcccccacggcagcgcctgggaccccagcagagaggccaccagcctgggcagccagagctacgaggacatgagaggcatcctgtacgccgccccccagctgagaagcatcagaggccagcccggccccaaccacgaggaggacgccgacagctacgagaacatggacaaccccgacggccccgaccccgcctggggcggcggcggcagaatgggcacctggagcaccagatag

SEQ ID NO: 75862 - DNA, 1674 bp, Artificial Sequence
  Description of Artificial Sequence: Synthetic coding sequence
atgcccccccccagactgctgttcttcctgctgttcctgacccccatggaggtgagacccgaggagcccctggtggtgaaggtggaggagggcgacaacgccgtgctgcagtgcctgaagggcaccagcgacggccccacccagcagctgacctggagcagagagagccccctgaagcccttcctgaagctgagcctgggcctgcccggcctgggcatccacatgagacccctggccatctggctgttcatcttcaacgtgagccagcagatgggcggcttctacctgtgccagcccggcccccccagcgagaaggcctggcagcccggctggaccgtgaacgtggagggcagcggcgagctgttcagatggaacgtgagcgacctgggcggcctgggctgcggcctgaagaacagaagcagcgagggccccagcagccccagcggcaagctgatgagccccaagctgtacgtgtgggccaaggacagacccgagatctgggagggcgagcccccctgcctgccccccagagacagcctgaaccagagcctgagccaggacctgaccatggcccccggcagcaccctgtggctgagctgcggcgtgccccccgacagcgtgagcagaggccccctgagctggacccacgtgcaccccaagggccccaagagcctgctgagcctggagctgaaggacgacagacccgccagagacatgtgggtgatggagaccggcctgctgctgcccagagccaccgcccaggacgccggcaagtactactgccacagaggcaacctgaccatgagcttccacctggagatcaccgccagacccgtgctgtggcactggctgctgagaaccggcggctggaaggtgagcgccgtgaccctggcctacctgatcttctgcctgtgcagcctggtgggcatcctgcacctgcagagagccctggtgctgagaagaaagagaaagagaatgaccgaccccaccagaagattcttcaaggtgacccccccccccggcagcggcccccagaaccagtacggcaacgtgctgagcctgcccacccccaccagcggcctgggcagagcccagagatgggccgccggcctgggcggcaccgcccccagctacggcaaccccagcagcgacgtgcaggccgacggcgccctgggcagcagaagcccccccggcgtgggccccgaggaggaggagggcgagggctacgaggagcccgacagcgaggaggacagcgagttctacgagaacgacagcaacctgggccaggaccagctgagccaggacggcagcggctacgagaaccccgaggacgagcccctgggccccgaggacgaggacagcttcagcaacgccgagagctacgagaacgaggacgaggagctgacccagcccgtggccagaaccatggacttcctgagcccccacggcagcgcctgggaccccagcagagaggccaccagcctggccggcagccagagctacgaggacatgagaggcatcctgtacgccgccccccagctgagaagcatcagaggccagcccggccccaaccacgaggaggacgccgacagctacgagaacatggacaaccccgacggccccgaccccgcctggggcggcggcggcagaatgggcacctggagcaccagatag

SEQ ID NO: 75863 - DNA, 984 bp, Artificial Sequence
  Description of Artificial Sequence: Synthetic coding sequence
atgctgttcctgctgctgcccctgctggccgtgctgcccggcgacggcaacgccgacggcctgaaggagcccctgagcttccacgtgacctggatcgccagcttctacaaccacagctggaagcagaacctggtgagcggctggctgagcgacctgcagacccacacctgggacagcaacagcagcaccatcgtgttcctgtgcccctggagcagaggcaacttcagcaacgaggagtggaaggagctggagaccctgttcagaatcagaaccatcagaagcttcgagggcatcagaagatacgcccacgagctgcagttcgagtaccccttcgagatccaggtgaccggcggctgcgagctgcacagcggcaaggtgagcggcagcttcctgcagctggcctaccagggcagcgacttcgtgagcttccagaacaacagctggctgccctaccccgtggccggcaacatggccaagcacttctgcaaggtgctgaaccagaaccagcacgagaacgacatcacccacaacctgctgagcgacacctgccccagattcatcctgggcctgctggacgccggcaaggcccacctgcagagacaggtgaagcccgaggcctggctgagccacggccccagccccggccccggccacctgcagctggtgtgccacgtgagcggcttctaccccaagcccgtgtgggtgatgtggatgagaggcgagcaggagcagcagggcacccagagaggcgacatcctgcccagcgccgacggcacctggtacctgagagccaccctggaggtggccgccggcgaggccgccgacctgagctgcagagtgaagcacagcagcctggagggccaggacatcgtgctgtactgggagcaccacagcagcgtgggcttcatcatcctggccgtgatcgtgcccctgctgctgctgatcggcctggccctgtggttcagaaagagatgcttctgctag

SEQ ID NO: 75864 - DNA, 1002 bp, Artificial Sequence
  Description of Artificial Sequence: Synthetic coding sequence
atgctgctgctgcccttccagctgctggccgtgctgttccccggcggcaacagcgagcacgccttccagggccccaccagcttccacgtgatccagaccagcagcttcaccaacagcacctgggcccagacccagggcagcggctggctggacgacctgcagatccacggctgggacagcgacagcggcaccgccatcttcctgaagccctggagcaagggcaacttcagcgacaaggaggtggccgagctggaggagatcttcagagtgtacatcttcggcttcgccagagaggtgcaggacttcgccggcgacttccagatgaagtaccccttcgagatccagggcatcgccggctgcgagctgcacagcggcggcgccatcgtgagcttcctgagaggcgccctgggcggcctggacttcctgagcgtgaagaacgccagctgcgtgcccagccccgagggcggcagcagagcccagaagttctgcgccctgatcatccagtaccagggcatcatggagaccgtgagaatcctgctgtacgagacctgccccagatacctgctgggcgtgctgaacgccggcaaggccgacctgcagagacaggtgaagcccgaggcctggctgagcagcggccccagccccggccccggcagactgcagctggtgtgccacgtgagcggcttctaccccaagcccgtgtgggtgatgtggatgagaggcgagcaggagcagcagggcacccagctgggcgacatcctgcccaacgccaactggacctggtacctgagagccaccctggacgtggccgacggcgaggccgccggcctgagctgcagagtgaagcacagcagcctggagggccaggacatcatcctgtactggagaaaccccaccagcatcggcagcatcgtgctggccatcatcgtgcccagcctgctgctgctgctgtgcctggccctgtggtacatgagaagaagaagctaccagaacatcccctag

SEQ ID NO: 75865 - DNA, 741 bp, Artificial Sequence
  Description of Artificial Sequence: Synthetic coding sequence
tgaagcagcttcaccaacagcacctgggcccagacccagggcagcggctggctggacgacctgcagatccacggctgggacagcgacagcggcaccgccatcttcctgaagccctggagcaagggcaacttcagcgacaaggaggtggccgagctggaggagatcttcagagtgtacatcttcggcttcgccagagaggtgcaggacttcgccggcgacttccagatgaagtaccccttcgagatccagggcatcgccggctgcgagctgcacagcggcggcgccatcgtgagcttcctgagaggcgccctgggcggcctggacttcctgagcgtgaagaacgccagctgcgtgcccagccccgagggcggcagcagagcccagaagttctgcgccctgatcatccagtaccagggcatcatggagaccgtgagaatcctgctgtacgagacctgccccagatacctgctgggcgtgctgaacgccggcaaggccgacctgcagagacaggtgaagcccgaggcctggctgagcagcggccccagccccggccccggcagactgcagctggtgtgccacgtgagcggcttctaccccaagcccgtgtgggtgatgtggatgagaggcaaccccaccagcatcggcagcatcgtgctggccatcatcgtgcccagcctgctgctgctgctgtgcctggccctgtggtacatgagaagaagaagctaccagaacatcccctag

SEQ ID NO: 75866 - DNA, 1041 bp, Artificial Sequence
  Description of Artificial Sequence: Synthetic coding sequence
atgctgttcctgcagttcctgctgctggccctgctgctgcccggcggcgacaacgccgacgccagccaggagcacgtgagcttccacgtgatccagatcttcagcttcgtgaaccagagctgggccagaggccagggcagcggctggctggacgagctgcagacccacggctgggacagcgagagcggcaccatcatcttcctgcacaactggagcaagggcaacttcagcaacgaggagctgagcgacctggagctgctgttcagattctacctgttcggcctgaccagagagatccaggaccacgccagccaggactacagcaagtaccccttcgaggtgcaggtgaaggccggctgcgagctgcacagcggcaagagccccgagggcttcttccaggtggccttcaacggcctggacctgctgagcttccagaacaccacctgggtgcccagccccggctgcggcagcctggcccagagcgtgtgccacctgctgaaccaccagtacgagggcgtgaccgagaccgtgtacaacctgatcagaagcacctgccccagattcctgctgggcctgctggacgccggcaagatgtacgtgcacagacaggtgagacccgaggcctggctgagcagcagacccagcctgggcagcggccagctgctgctggtgtgccacgccagcggcttctaccccaagcccgtgtgggtgacctggatgagaaacgagcaggagcagctgggcaccaagcacggcgacatcctgcccaacgccgacggcacctggtacctgcaggtgatcctggaggtggccagcgaggagcccgccggcctgagctgcagagtgagacacagcagcctgggcggccaggacatcatcctgtactgggcccacatcagaaccagctgcgagaccctgccccccgacagccccatcgtgctgagaacccagcagcccagaagcctggtgcagtacagcgacgccatccccagcaccctgcacctgaactgcttcagcttctgcatcatcaacatctgctag

SEQ ID NO: 75867 - DNA, 1002 bp, Artificial Sequence
  Description of Artificial Sequence: Synthetic coding sequence
atgctgttcctgcagttcctgctgctggccctgctgctgcccggcggcgacaacgccgacgccagccaggagcacgtgagcttccacgtgatccagatcttcagcttcgtgaaccagagctgggccagaggccagggcagcggctggctggacgagctgcagacccacggctgggacagcgagagcggcaccatcatcttcctgcacaactggagcaagggcaacttcagcaacgaggagctgagcgacctggagctgctgttcagattctacctgttcggcctgaccagagagatccaggaccacgccagccaggactacagcaagtaccccttcgaggtgcaggtgaaggccggctgcgagctgcacagcggcaagagccccgagggcttcttccaggtggccttcaacggcctggacctgctgagcttccagaacaccacctgggtgcccagccccggctgcggcagcctggcccagagcgtgtgccacctgctgaaccaccagtacgagggcgtgaccgagaccgtgtacaacctgatcagaagcacctgccccagattcctgctgggcctgctggacgccggcaagatgtacgtgcacagacaggtgagacccgaggcctggctgagcagcagacccagcctgggcagcggccagctgctgctggtgtgccacgccagcggcttctaccccaagcccgtgtgggtgacctggatgagaaacgagcaggagcagctgggcaccaagcacggcgacatcctgcccaacgccgacggcacctggtacctgcaggtgatcctggaggtggccagcgaggagcccgccggcctgagctgcagagtgagacacagcagcctgggcggccaggacatcatcctgtactggggccaccacttcagcatgaactggatcgccctggtggtgatcgtgcccctggtgatcctgatcgtgctggtgctgtggttcaagaagcactgcagctaccaggacatcctgtag

SEQ ID NO: 75868 - DNA, 846 bp, Artificial Sequence
  Description of Artificial Sequence: Synthetic coding sequence
tgattcctgcacaactggagcaagggcaacttcagcaacgaggagctgagcgacctggagctgctgttcagattctacctgttcggcctgaccagagagatccaggaccacgccagccaggactacagcaagtaccccttcgaggtgcaggtgaaggccggctgcgagctgcacagcggcaagagccccgagggcttcttccaggtggccttcaacggcctggacctgctgagcttccagaacaccacctgggtgcccagccccggctgcggcagcctggcccagagcgtgtgccacctgctgaaccaccagtacgagggcgtgaccgagaccgtgtacaacctgatcagaagcacctgccccagattcctgctgggcctgctggacgccggcaagatgtacgtgcacagacaggtgagacccgaggcctggctgagcagcagacccagcctgggcagcggccagctgctgctggtgtgccacgccagcggcttctaccccaagcccgtgtgggtgacctggatgagaaacgagcaggagcagctgggcaccaagcacggcgacatcctgcccaacgccgacggcacctggtacctgcaggtgatcctggaggtggccagcgaggagcccgccggcctgagctgcagagtgagacacagcagcctgggcggccaggacatcatcctgtactgggcccacatcagaaccagctgcgagaccctgccccccgacagccccatcgtgctgagaacccagcagcccagaagcctggtgcagtacagcgacgccatccccagcaccctgcacctgaactgcttcagcttctgcatcatcaacatctgctag

SEQ ID NO: 75869 - DNA, 411 bp, Artificial Sequence
  Description of Artificial Sequence: Synthetic coding sequence
atgtacgtgcacagacaggtgagacccgaggcctggctgagcagcagacccagcctgggcagcggccagctgctgctggtgtgccacgccagcggcttctaccccaagcccgtgtgggtgacctggatgagaaacgagcaggagcagctgggcaccaagcacggcgacatcctgcccaacgccgacggcacctggtacctgcaggtgatcctggaggtggccagcgaggagcccgccggcctgagctgcagagtgagacacagcagcctgggcggccaggacatcatcctgtactggggccaccacttcagcatgaactggatcgccctggtggtgatcgtgcccctggtgatcctgatcgtgctggtgctgtggttcaagaagcactgcagctaccaggacatcctgtag

SEQ ID NO: 75870 - DNA, 1008 bp, Artificial Sequence
  Description of Artificial Sequence: Synthetic coding sequence
atgggctgcctgctgttcctgctgctgtgggccctgctgcaggcctggggcagcgccgaggtgccccagagactgttccccctgagatgcctgcagatcagcagcttcgccaacagcagctggaccagaaccgacggcctggcctggctgggcgagctgcagacccacagctggagcaacgacagcgacaccgtgagaagcctgaagccctggagccagggcaccttcagcgaccagcagtgggagaccctgcagcacatcttcagagtgtacagaagcagcttcaccagagacgtgaaggagttcgccaagatgctgagactgagctaccccctggagctgcaggtgagcgccggctgcgaggtgcaccccggcaacgccagcaacaacttcttccacgtggccttccagggcaaggacatcctgagcttccagggcaccagctgggagcccacccaggaggcccccctgtgggtgaacctggccatccaggtgctgaaccaggacaagtggaccagagagaccgtgcagtggctgctgaacggcacctgcccccagttcgtgagcggcctgctggagagcggcaagagcgagctgaagaagcaggtgaagcccaaggcctggctgagcagaggccccagccccggccccggcagactgctgctggtgtgccacgtgagcggcttctaccccaagcccgtgtgggtgaagtggatgagaggcgagcaggagcagcagggcacccagcccggcgacatcctgcccaacgccgacgagacctggtacctgagagccaccctggacgtggtggccggcgaggccgccggcctgagctgcagagtgaagcacagcagcctggagggccaggacatcgtgctgtactggggcggcagctacaccagcatgggcctgatcgccctggccgtgctggcctgcctgctgttcctgctgatcgtgggcttcaccagcagattcaagagacagaccagctaccagggcgtgctgtag

SEQ ID NO: 75871 - DNA, 435 bp, Artificial Sequence
  Description of Artificial Sequence: Synthetic coding sequence
atgctgctgctgttcctgctgttcgagggcctgtgctgccccggcgagaacaccgccgtgaagcccgaggcctggctgagctgcggccccagccccggccccggcagactgcagctggtgtgccacgtgagcggcttctaccccaagcccgtgtgggtgatgtggatgagaggcggctacagcatcttcctgatcctgatctgcctgaccgtgatcgtgaccctggtgatcctggtggtggtggacagcagactgaagaagcagagcagcaacaagaacatcctgagcccccacacccccagccccgtgttcctgatgggcgccaacacccaggacaccaagaacagcagacaccagttctgcctggcccaggtgagctggatcaagaacagagtgctgaagaagtggaagaccagactgaaccagctgtggtag

SEQ ID NO: 75872 - DNA, 696 bp, Artificial Sequence
  Description of Artificial Sequence: Synthetic coding sequence
atgctgctgctgttcctgctgttcgagggcctgtgctgccccggcgagaacaccgccgccccccaggccctgcagagctaccacctggccgccgaggagcagctgagcttcagaatgctgcagaccagcagcttcgccaaccacagctgggcccacagcgagggcagcggctggctgggcgacctgcagacccacggctgggacaccgtgctgggcaccatcagattcctgaagccctggagccacggcaacttcagcaagcaggagctgaagaacctgcagagcctgttccagctgtacttccacagcttcatccagatcgtgcaggccagcgccggccagttccagctggagctgaagcccgaggcctggctgagctgcggccccagccccggccccggcagactgcagctggtgtgccacgtgagcggcttctaccccaagcccgtgtgggtgatgtggatgagaggcggctacagcatcttcctgatcctgatctgcctgaccgtgatcgtgaccctggtgatcctggtggtggtggacagcagactgaagaagcagagccccgtgttcctgatgggcgccaacacccaggacaccaagaacagcagacaccagttctgcctggcccaggtgagctggatcaagaacagagtgctgaagaagtggaagaccagactgaaccagctgtggtag

SEQ ID NO: 75873 - DNA, 861 bp, Artificial Sequence
  Description of Artificial Sequence: Synthetic coding sequence
atgctgctgctgttcctgctgttcgagggcctgtgctgccccggcgagaacaccgccgccccccaggccctgcagagctaccacctggccgccgaggagcagctgagcttcagaatgctgcagaccagcagcttcgccaaccacagctgggcccacagcgagggcagcggctggctgggcgacctgcagacccacggctgggacaccgtgctgggcaccatcagattcctgaagccctggagccacggcaacttcagcaagcaggagctgaagaacctgcagagcctgttccagctgtacttccacagcttcatccagatcgtgcaggccagcgccggccagttccagctggagctgaagcccgaggcctggctgagctgcggccccagccccggccccggcagactgcagctggtgtgccacgtgagcggcttctaccccaagcccgtgtgggtgatgtggatgagaggcgagcaggagcagagaggcacccagagaggcgacgtgctgcccaacgccgacgagacctggtacctgagagccaccctggacgtggccgccggcgaggccgccggcctgagctgcagagtgaagcacagcagcctgggcggccacgacctgatcatccactggggcggctacagcatcttcctgatcctgatctgcctgaccgtgatcgtgaccctggtgatcctggtggtggtggacagcagactgaagaagcagagccccgtgttcctgatgggcgccaacacccaggacaccaagaacagcagacaccagttctgcctggcccaggtgagctggatcaagaacagagtgctgaagaagtggaagaccagactgaaccagctgtggtag

SEQ ID NO: 75874 - DNA, 399 bp, Artificial Sequence
  Description of Artificial Sequence: Synthetic coding sequence
atgctgctgctgttcctgctgttcgagggcctgtgctgccccggcgagaacaccgccgtgaagcccgaggcctggctgagctgcggccccagccccggccccggcagactgcagctggtgtgccacgtgagcggcttctaccccaagcccgtgtgggtgatgtggatgagaggcggctacagcatcttcctgatcctgatctgcctgaccgtgatcgtgaccctggtgatcctggtggtggtggacagcagactgaagaagcagagccccgtgttcctgatgggcgccaacacccaggacaccaagaacagcagacaccagttctgcctggcccaggtgagctggatcaagaacagagtgctgaagaagtggaagaccagactgaaccagctgtggtag

SEQ ID NO: 75875 - DNA, 1131 bp, Artificial Sequence
  Description of Artificial Sequence: Synthetic coding sequence
atgctgctgctgttcctgctgttcgagggcctgtgctgccccggcgagaacaccgccgccccccaggccctgcagagctaccacctggccgccgaggagcagctgagcttcagaatgctgcagaccagcagcttcgccaaccacagctgggcccacagcgagggcagcggctggctgggcgacctgcagacccacggctgggacaccgtgctgggcaccatcagattcctgaagccctggagccacggcaacttcagcaagcaggagctgaagaacctgcagagcctgttccagctgtacttccacagcttcatccagatcgtgcaggccagcgccggccagttccagctggagtaccccttcgagatccagatcctggccggctgcagaatgaacgccccccagatcttcctgaacatggcctaccagggcagcgacttcctgagcttccagggcatcagctgggagcccagccccggcgccggcatcagagcccagaacatctgcaaggtgctgaacagatacctggacatcaaggagatcctgcagagcctgctgggccacacctgccccagattcctggccggcctgatggaggccggcgagagcgagctgaagagaaaggtgaagcccgaggcctggctgagctgcggccccagccccggccccggcagactgcagctggtgtgccacgtgagcggcttctaccccaagcccgtgtgggtgatgtggatgagaggcgagcaggagcagagaggcacccagagaggcgacgtgctgcccaacgccgacgagacctggtacctgagagccaccctggacgtggccgccggcgaggccgccggcctgagctgcagagtgaagcacagcagcctgggcggccacgacctgatcatccactggggcggctacagcatcttcctgatcctgatctgcctgaccgtgatcgtgaccctggtgatcctggtggtggtggacagcagactgaagaagcagagccccgtgttcctgatgggcgccaacacccaggacaccaagaacagcagacaccagttctgcctggcccaggtgagctggatcaagaacagagtgctgaagaagtggaagaccagactgaaccagctgtggtag

SEQ ID NO: 75876 - DNA, 873 bp, Artificial Sequence
  Description of Artificial Sequence: Synthetic coding sequence
atgctgctgctgttcctgctgttcgagggcctgtgctgccccggcgagaacaccgccgccccccaggccctgcagagctaccacctggccgccgaggagcagctgagcttcagaatgctgcagaccagcagcttcgccaaccacagctgggcccacagcgagggcagcggctggctgggcgacctgcagacccacggctgggacaccgtgctgggcaccatcagattcctgaagccctggagccacggcaacttcagcaagcaggagctgaagaacctgcagagcctgttccagctgtacttccacagcttcatccagatcgtgcaggccagcgccggccagttccagctggagtaccccttcgagatccagatcctggccggctgcagaatgaacgccccccagatcttcctgaacatggcctaccagggcagcgacttcctgagcttccagggcatcagctgggagcccagccccggcgccggcatcagagcccagaacatctgcaaggtgctgaacagatacctggacatcaaggagatcctgcagagcctgctgggccacacctgccccagattcctggccggcctgatggaggccggcgagagcgagctgaagagaaaggtgaagcccgaggcctggctgagctgcggccccagccccggccccggcagactgcagctggtgtgccacgtgagcggcttctaccccaagcccgtgtgggtgatgtggatgagaggcgagcaggagcagagaggcacccagagaggcgacgtgctgcccaacgccgacgagacctggtggatcttccacctgagccaccccgacctgttcgactgcgacagctaccccggccacatcggctgcagctag

SEQ ID NO: 75877 - DNA, 183 bp, Artificial Sequence
  Description of Artificial Sequence: Synthetic coding sequence
tgagtgagcggcttctaccccaagcccgtgtgggtgatgtggatgagaggcgagcaggagcagagaggcacccagagaggcgacgtgctgcccaacgccgacgagacctggtggatcttccacctgagccaccccgacctgttcgactgcgacagctaccccggccacatcggctgcagctag

SEQ ID NO: 75878 - DNA, 966 bp, Artificial Sequence
  Description of Artificial Sequence: Synthetic coding sequence
atgctgctgctgttcctgctgttcgagggcctgtgctgccccggcgagaacaccgccgccccccaggccctgcagagctaccacctggccgccgaggagcagctgagcttcagaatgctgcagaccagcagcttcgccaaccacagctgggcccacagcgagggcagcggctggctgggcgacctgcagacccacggctgggacaccgtgctgggcaccatcagattcctgaagccctggagccacggcaacttcagcaagcaggagctgaagaacctgcagagcctgttccagctgtacttccacagcttcatccagatcgtgcaggccagcgccggccagttccagctggagtaccccttcgagatccagatcctggccggctgcagaatgaacgccccccagatcttcctgaacatggcctaccagggcagcgacttcctgagcttccagggcatcagctgggagcccagccccggcgccggcatcagagcccagaacatctgcaaggtgctgaacagatacctggacatcaaggagatcctgcagagcctgctgggccacacctgccccagattcctggccggcctgatggaggccggcgagagcgagctgaagagaaaggtgaagcccgaggcctggctgagctgcggccccagccccggccccggcagactgcagctggtgtgccacgtgagcggcttctaccccaagcccgtgtgggtgatgtggatgagaggcggctacagcatcttcctgatcctgatctgcctgaccgtgatcgtgaccctggtgatcctggtggtggtggacagcagactgaagaagcagagccccgtgttcctgatgggcgccaacacccaggacaccaagaacagcagacaccagttctgcctggcccaggtgagctggatcaagaacagagtgctgaagaagtggaagaccagactgaaccagctgtggtag

SEQ ID NO: 75879 - DNA, 306 bp, Artificial Sequence
  Description of Artificial Sequence: Synthetic coding sequence
atgctgctgctgttcctgctgttcgagggcctgtgctgccccggcgagaacaccgccgtgaagcccgaggcctggctgagctgcggccccagccccggccccggcagactgcagctggtgtgccacgtgagcggcttctaccccaagcccgtgtgggtgatgtggatgagaggcgagcaggagcagagaggcacccagagaggcgacgtgctgcccaacgccgacgagacctggtggatcttccacctgagccaccccgacctgttcgactgcgacagctaccccggccacatcggctgcagctag

SEQ ID NO: 75880 - DNA, 897 bp, Artificial Sequence
  Description of Artificial Sequence: Synthetic coding sequence
atgctgctgctgttcctgctgttcgagggcctgtgctgccccggcgagaacaccgccgccccccaggccctgcagagctaccacctggccgccgaggagcagctgagcttcagaatgctgcagaccagcagcttcgccaaccacagctgggcccacagcgagggcagcggctggctgggcgacctgcagacccacggctgggacaccgtgctgggcaccatcagattcctgaagccctggagccacggcaacttcagcaagcaggagctgaagaacctgcagagcctgttccagctgtacttccacagcttcatccagatcgtgcaggccagcgccggccagttccagctggagctgaagcccgaggcctggctgagctgcggccccagccccggccccggcagactgcagctggtgtgccacgtgagcggcttctaccccaagcccgtgtgggtgatgtggatgagaggcgagcaggagcagagaggcacccagagaggcgacgtgctgcccaacgccgacgagacctggtacctgagagccaccctggacgtggccgccggcgaggccgccggcctgagctgcagagtgaagcacagcagcctgggcggccacgacctgatcatccactggggcggctacagcatcttcctgatcctgatctgcctgaccgtgatcgtgaccctggtgatcctggtggtggtggacagcagactgaagaagcagagcagcaacaagaacatcctgagcccccacacccccagccccgtgttcctgatgggcgccaacacccaggacaccaagaacagcagacaccagttctgcctggcccaggtgagctggatcaagaacagagtgctgaagaagtggaagaccagactgaaccagctgtggtag

SEQ ID NO: 75881 - DNA, 564 bp, Artificial Sequence
  Description of Artificial Sequence: Synthetic coding sequence
atgctgctgctgttcctgctgttcgagggcctgtgctgccccggcgagaacaccgccgtgaagcccgaggcctggctgagctgcggccccagccccggccccggcagactgcagctggtgtgccacgtgagcggcttctaccccaagcccgtgtgggtgatgtggatgagaggcgagcaggagcagagaggcacccagagaggcgacgtgctgcccaacgccgacgagacctggtacctgagagccaccctggacgtggccgccggcgaggccgccggcctgagctgcagagtgaagcacagcagcctgggcggccacgacctgatcatccactggggcggctacagcatcttcctgatcctgatctgcctgaccgtgatcgtgaccctggtgatcctggtggtggtggacagcagactgaagaagcagagccccgtgttcctgatgggcgccaacacccaggacaccaagaacagcagacaccagttctgcctggcccaggtgagctggatcaagaacagagtgctgaagaagtggaagaccagactgaaccagctgtggtag

SEQ ID NO: 75882 - DNA, 1167 bp, Artificial Sequence
  Description of Artificial Sequence: Synthetic coding sequence
atgctgctgctgttcctgctgttcgagggcctgtgctgccccggcgagaacaccgccgccccccaggccctgcagagctaccacctggccgccgaggagcagctgagcttcagaatgctgcagaccagcagcttcgccaaccacagctgggcccacagcgagggcagcggctggctgggcgacctgcagacccacggctgggacaccgtgctgggcaccatcagattcctgaagccctggagccacggcaacttcagcaagcaggagctgaagaacctgcagagcctgttccagctgtacttccacagcttcatccagatcgtgcaggccagcgccggccagttccagctggagtaccccttcgagatccagatcctggccggctgcagaatgaacgccccccagatcttcctgaacatggcctaccagggcagcgacttcctgagcttccagggcatcagctgggagcccagccccggcgccggcatcagagcccagaacatctgcaaggtgctgaacagatacctggacatcaaggagatcctgcagagcctgctgggccacacctgccccagattcctggccggcctgatggaggccggcgagagcgagctgaagagaaaggtgaagcccgaggcctggctgagctgcggccccagccccggccccggcagactgcagctggtgtgccacgtgagcggcttctaccccaagcccgtgtgggtgatgtggatgagaggcgagcaggagcagagaggcacccagagaggcgacgtgctgcccaacgccgacgagacctggtacctgagagccaccctggacgtggccgccggcgaggccgccggcctgagctgcagagtgaagcacagcagcctgggcggccacgacctgatcatccactggggcggctacagcatcttcctgatcctgatctgcctgaccgtgatcgtgaccctggtgatcctggtggtggtggacagcagactgaagaagcagagcagcaacaagaacatcctgagcccccacacccccagccccgtgttcctgatgggcgccaacacccaggacaccaagaacagcagacaccagttctgcctggcccaggtgagctggatcaagaacagagtgctgaagaagtggaagaccagactgaaccagctgtggtag

SEQ ID NO: 75883 - DNA, 1023 bp, Artificial Sequence
  Description of Artificial Sequence: Synthetic coding sequence
atgatcaagagcagagtgaagagatacagaagaagaagaggcagccagagagccccccaggccctgcagagctaccacctggccgccgaggagcagctgagcttcagaatgctgcagaccagcagcttcgccaaccacagctgggcccacagcgagggcagcggctggctgggcgacctgcagacccacggctgggacaccgtgctgggcaccatcagattcctgaagccctggagccacggcaacttcagcaagcaggagctgaagaacctgcagagcctgttccagctgtacttccacagcttcatccagatcgtgcaggccagcgccggccagttccagctggagtaccccttcgagatccagatcctggccggctgcagaatgaacgccccccagatcttcctgaacatggcctaccagggcagcgacttcctgagcttccagggcatcagctgggagcccagccccggcgccggcatcagagcccagaacatctgcaaggtgctgaacagatacctggacatcaaggagatcctgcagagcctgctgggccacacctgccccagattcctggccggcctgatggaggccggcgagagcgagctgaagagaaaggtgaagcccgaggcctggctgagctgcggccccagccccggccccggcagactgcagctggtgtgccacgtgagcggcttctaccccaagcccgtgtgggtgatgtggatgagaggcgagcaggagcagagaggcacccagagaggcgacgtgctgcccaacgccgacgagacctggtacctgagagccaccctggacgtggccgccggcgaggccgccggcctgagctgcagagtgaagcacagcagcctgggcggccacgacctgatcatccactggggcgagaagcagctgagactgtgctgggagatcatgaagatcgccctgggcctgctgagcgtgggcctgagaaagtgggtgggcatgctgggcaccagaagagtgaagctgggccagagcaagtag

SEQ ID NO: 75884 - DNA, 870 bp, Artificial Sequence
  Description of Artificial Sequence: Synthetic coding sequence
atgctgctgctgttcctgctgttcgagggcctgtgctgccccggcgagaacaccgccgaccccttcgagatccagatcctggccggctgcagaatgaacgccccccagatcttcctgaacatggcctaccagggcagcgacttcctgagcttccagggcatcagctgggagcccagccccggcgccggcatcagagcccagaacatctgcaaggtgctgaacagatacctggacatcaaggagatcctgcagagcctgctgggccacacctgccccagattcctggccggcctgatggaggccggcgagagcgagctgaagagaaaggtgaagcccgaggcctggctgagctgcggccccagccccggccccggcagactgcagctggtgtgccacgtgagcggcttctaccccaagcccgtgtgggtgatgtggatgagaggcgagcaggagcagagaggcacccagagaggcgacgtgctgcccaacgccgacgagacctggtacctgagagccaccctggacgtggccgccggcgaggccgccggcctgagctgcagagtgaagcacagcagcctgggcggccacgacctgatcatccactggggcggctacagcatcttcctgatcctgatctgcctgaccgtgatcgtgaccctggtgatcctggtggtggtggacagcagactgaagaagcagagcagcaacaagaacatcctgagcccccacacccccagccccgtgttcctgatgggcgccaacacccaggacaccaagaacagcagacaccagttctgcctggcccaggtgagctggatcaagaacagagtgctgaagaagtggaagaccagactgaaccagctgtggtag

SEQ ID NO: 75885 - DNA, 600 bp, Artificial Sequence
  Description of Artificial Sequence: Synthetic coding sequence
atgctgctgctgttcctgctgttcgagggcctgtgctgccccggcgagaacaccgccgtgaagcccgaggcctggctgagctgcggccccagccccggccccggcagactgcagctggtgtgccacgtgagcggcttctaccccaagcccgtgtgggtgatgtggatgagaggcgagcaggagcagagaggcacccagagaggcgacgtgctgcccaacgccgacgagacctggtacctgagagccaccctggacgtggccgccggcgaggccgccggcctgagctgcagagtgaagcacagcagcctgggcggccacgacctgatcatccactggggcggctacagcatcttcctgatcctgatctgcctgaccgtgatcgtgaccctggtgatcctggtggtggtggacagcagactgaagaagcagagcagcaacaagaacatcctgagcccccacacccccagccccgtgttcctgatgggcgccaacacccaggacaccaagaacagcagacaccagttctgcctggcccaggtgagctggatcaagaacagagtgctgaagaagtggaagaccagactgaaccagctgtggtag

SEQ ID NO: 75886 - DNA, 1047 bp, Artificial Sequence
  Description of Artificial Sequence: Synthetic coding sequence
atgctgtgcccctggagaaccgccaacctgggcctgctgctgatcctgaccatcttcctggtggccgaggccgagggcgccgcccagcccaacaacagcctgatgctgcagaccagcaaggagaaccacgccctggccagcagcagcctgtgcatggacgagaagcagatcacccagaactacagcaaggtgctggccgaggtgaacaccagctggcccgtgaagatggccaccaacgccgtgctgtgctgcccccccatcgccctgagaaacctgatcatcatcacctgggagatcatcctgagaggccagcccagctgcaccaaggcctacaagaaggagaccaacgagaccaaggagaccaactgcaccgacgagagaatcacctgggtgagcagacccgaccagaacagcgacctgcagatcagaaccgtggccatcacccacgacggctactacagatgcatcatggtgacccccgacggcaacttccacagaggctaccacctgcaggtgctggtgacccccgaggtgaccctgttccagaacagaaacagaaccgccgtgtgcaaggccgtggccggcaagcccgccgcccacatcagctggatccccgagggcgactgcgccaccaagcaggagtactggagcaacggcaccgtgaccgtgaagagcacctgccactgggaggtgcacaacgtgagcaccgtgacctgccacgtgagccacctgaccggcaacaagagcctgtacatcgagctgctgcccgtgcccggcgccaagaagagcgccaagctgtacatcccctacatcatcctgaccatcatcatcctgaccatcgtgggcttcatctggctgctgaaggtgaacggctgcagaaagtacaagctgaacaagaccgagagcacccccgtggtggaggaggacgagatgcagccctacgccagctacaccgagaagaacaaccccctgtacgacaccaccaacaaggtgaaggccagcgaggccctgcagagcgaggtggacaccgacctgcacaccctgtag

SEQ ID NO: 75887 - DNA, 567 bp, Artificial Sequence
  Description of Artificial Sequence: Synthetic coding sequence
atgctgtgcccctggagaaccgccaacctgggcctgctgctgatcctgaccatcttcctggtggccgaggccgagggcgccgcccagcccaacaacagcctgatgctgcagaccagcaaggagaaccacgccctggccagcagcagcctgtgcatggacgagaagcagatcacccagaactacagcaaggtgctggccgaggtgaacaccagctggcccgtgaagatggccaccaacgccgtgctgtgctgcccccccatcgccctgagaaacctgatcatcatcacctgggagatcatcctgagaggccagcccagctgcaccaaggcctacaagaaggagaccaacgagaccaaggagaccaactgcaccgacgagagaatcacctgggtgagcagacccgaccagaacagcgacctgcagatcagaaccgtggccatcacccacgacggctactacagatgcatcatggtgacccccgacggcaacttccacagaggctaccacctgcaggtgctgggcaaggagcaccacatcctgagatacttcaccagccccgacctgtag

SEQ ID NO: 75888 - DNA, 978 bp, Artificial Sequence
  Description of Artificial Sequence: Synthetic coding sequence
atgctgtgcccctggagaaccgccaacctgggcctgctgctgatcctgaccatcttcctggtggccgccagcagcagcctgtgcatggacgagaagcagatcacccagaactacagcaaggtgctggccgaggtgaacaccagctggcccgtgaagatggccaccaacgccgtgctgtgctgcccccccatcgccctgagaaacctgatcatcatcacctgggagatcatcctgagaggccagcccagctgcaccaaggcctacaagaaggagaccaacgagaccaaggagaccaactgcaccgacgagagaatcacctgggtgagcagacccgaccagaacagcgacctgcagatcagaaccgtggccatcacccacgacggctactacagatgcatcatggtgacccccgacggcaacttccacagaggctaccacctgcaggtgctggtgacccccgaggtgaccctgttccagaacagaaacagaaccgccgtgtgcaaggccgtggccggcaagcccgccgcccacatcagctggatccccgagggcgactgcgccaccaagcaggagtactggagcaacggcaccgtgaccgtgaagagcacctgccactgggaggtgcacaacgtgagcaccgtgacctgccacgtgagccacctgaccggcaacaagagcctgtacatcgagctgctgcccgtgcccggcgccaagaagagcgccaagctgtacatcccctacatcatcctgaccatcatcatcctgaccatcgtgggcttcatctggctgctgaaggtgaacggctgcagaaagtacaagctgaacaagaccgagagcacccccgtggtggaggaggacgagatgcagccctacgccagctacaccgagaagaacaaccccctgtacgacaccaccaacaaggtgaaggccagcgaggccctgcagagcgaggtggacaccgacctgcacaccctgtag

SEQ ID NO: 75889 - DNA, 498 bp, Artificial Sequence
  Description of Artificial Sequence: Synthetic coding sequence
atgctgtgcccctggagaaccgccaacctgggcctgctgctgatcctgaccatcttcctggtggccgccagcagcagcctgtgcatggacgagaagcagatcacccagaactacagcaaggtgctggccgaggtgaacaccagctggcccgtgaagatggccaccaacgccgtgctgtgctgcccccccatcgccctgagaaacctgatcatcatcacctgggagatcatcctgagaggccagcccagctgcaccaaggcctacaagaaggagaccaacgagaccaaggagaccaactgcaccgacgagagaatcacctgggtgagcagacccgaccagaacagcgacctgcagatcagaaccgtggccatcacccacgacggctactacagatgcatcatggtgacccccgacggcaacttccacagaggctaccacctgcaggtgctgggcaaggagcaccacatcctgagatacttcaccagccccgacctgtag

SEQ ID NO: 75890 - DNA, 987 bp, Artificial Sequence
  Description of Artificial Sequence: Synthetic coding sequence
atgaccgtggagaaggaggcccccgacgcccacttcaccgtggacaagcagaacatcagcctgtggcccagagagcccccccccaagagcggccccagcctggtgcccggcaagacccccaccgtgagagccgccctgatctgcctgaccctggtgctggtggccagcgtgctgctgcaggccgtgctgtaccccagattcatgggcaccatcagcgacgtgaagaccaacgtgcagctgctgaagggcagagtggacaacatcagcaccctggacagcgagatcaagaagaacagcgacggcatggaggccgccggcgtgcagatccagatggtgaacgagagcctgggctacgtgagaagccagttcctgaagctgaagaccagcgtggagaaggccaacgcccagatccagatcctgaccagaagctgggaggaggtgagcaccctgaacgcccagatccccgagctgaagagcgacctggagaaggccagcgccctgaacaccaagatcagagccctgcagggcagcctggagaacatgagcaagctgctgaagagacagaacgacatcctgcaggtggtgagccagggctggaagtacttcaagggcaacttctactacttcagcctgatccccaagacctggtacagcgccgagcagttctgcgtgagcagaaacagccacctgaccagcgtgaccagcgagagcgagcaggagttcctgtacaagaccgccggcggcctgatctactggatcggcctgaccaaggccggcatggagggcgactggagctgggtggacgacacccccttcaacaaggtgcagagcgtgagattctggatccccggcgagcccaacaacgccggcaacaacgagcactgcggcaacatcaaggcccccagcctgcaggcctggaacgacgccccctgcgacaagaccttcctgttcatctgcaagagaccctacgtgcccagcgagccctag

SEQ ID NO: 75891 - DNA, 4497 bp, Artificial Sequence
  Description of Artificial Sequence: Synthetic coding sequence
atggacggcgccagcgccgagcaggacggcctgcaggaggacagaagccacagcggccccagcagcctgcccgaggcccccctgaagccccccggccccctggtgccccccgaccagcaggacaaggtgcagtgcgccgaggtgaacagagccagcaccgagggcgagagccccgacggccccggccagggcggcctgtgccagaacggccccaccccccccttccccgacccccccagcagcctggaccccaccaccagccccgtgggccccgacgccagccccggcgtggccggcttccacgacaacctgagaaagagccagggcaccagcgccgagggcagcgtgagaaaggaggccctgcagagcctgagactgagcctgcccatgcaggagacccagctgtgcagcaccgacagccccctgcccctggagaaggaggagcaggtgagactgcaggccagaaagtggctggaggagcagctgaagcagtacagagtgaagagacagcaggagagaagcagccagcccgccaccaagaccagactgttcagcaccctggaccccgagctgatgctgaaccccgagaacctgcccagagccagcaccctggccatgaccaaggagtacagcttcctgagaaccagcgtgcccagaggccccaaggtgggcagcctgggcctgcccgcccaccccagagagaagaagaccagcaagagcagcaagatcagaagcctggccgactacagaaccgaggacagcaacgccggcaacagcggcggcaacgtgcccgcccccgacagcaccaagggcagcctgaagcagaacagaagcagcgccgccagcgtggtgagcgagatcagcctgagccccgacaccgacgacagactggagaacaccagcctggccggcgacagcgtgagcgaggtggacggcaacgacagcgacagcagcagctacagcagcgccagcaccagaggcacctacggcatcctgagcaagaccgtgggcacccaggacaccccctacatggtgaacggccaggagatccccgccgacaccctgggccagttccccagcatcaaggacgtgctgcaggccgccgccgccgagcaccaggaccagggccaggaggtgaacggcgaggtgagaagcagaagagacagcatctgcagcagcgtgagcctggagagcagcgccgccgagacccaggaggagatgctgcaggtgctgaaggagaagatgagactggagggccagctggaggccctgagcctggaggccagccaggccctgaaggagaaggccgagctgcaggcccagctggccgccctgagcaccaagctgcaggcccaggtggagtgcagccacagcagccagcagagacaggacagcctgagcagcgaggtggacaccctgaagcagagctgctgggacctggagagagccatgaccgacctgcagaacatgctggaggccaagaacgccagcctggccagcagcaacaacgacctgcaggtggccgaggagcagtaccagagactgatggccaaggtggaggacatgcagagaagcatgctgagcaaggacaacaccgtgcacgacctgagacagcagatgaccgccctgcagagccagctgcagcaggtgcagctggagagaaccaccctgaccagcaagctgaaggccagccaggccgagatcagcagcctgcagagcgtgagacagtggtaccagcagcagctggccctggcccaggaggccagagtgagactgcagggcgagatggcccacatccaggtgggccagatgacccaggccggcctgctggagcacctgaagctggagaacgtgagcctgagccagcagctgaccgagacccagcacagaagcatgaaggagaagggcagaatcgccgcccagctgcagggcatcgaggccgacatgctggaccaggaggccgccttcatgcagatccaggaggccaagaccatggtggaggaggacctgcagagaagactggaggagttcgagggcgagagagagagactgcagagaatggccgacagcgccgccagcctggagcagcagctggagcaggtgaagctgaccctgctgcagagagaccagcagctggaggccctgcagcaggagcacctggacctgatgaagcagctgaccctgacccaggaggccctgcagagcagagagcagagcctggacgccctgcagacccactacgacgagctgcaggccagactgggcgagctgcagggcgaggccgccagcagagaggacaccatctgcctgctgcagaacgagaagatcatcctggaggccgccctgcaggccgccaagagcggcaaggaggagctggacagaggcgccagaagactggaggagggcaccgaggagaccagcgagaccctggagaagctgagagaggagctggccatcaagagcggccaggtggagcacctgcagcaggagaccgccgccctgaagaagcagatgcagaagatcaaggagcagttcctgcagcagaaggtgatggtggaggcctacagaagagacgccaccagcaaggaccagctgatcagcgagctgaaggccaccagaaagagactggacagcgagctgaaggagctgagacaggagctgatgcaggtgcacggcgagaagagaaccgccgaggccgagctgagcagactgcacagagaggtggcccaggtgagacagcacatggccgacctggagggccacctgcagagcgcccagaaggagagagacgagatggagacccacctgcagagcctgcagttcgacaaggagcagatggtggccgtgaccgaggccaacgaggccctgaagaagcagatcgaggagctgcagcaggaggccagaaaggccatcaccgagcagaagcagaagatgagaagactgggcagcgacctgaccagcgcccagaaggagatgaagaccaagcacaaggcctacgagaacgccgtgggcatcctgagcagaagactgcaggaggccctggccgccaaggaggccgccgacgccgagctgggccagctgagagcccagggcggcagcagcgacagcagcctggccctgcacgagagaatccaggccctggaggccgagctgcaggccgtgagccacagcaagaccctgctggagaaggagctgcaggaggtgatcgccctgaccagccaggagctggaggagagcagagagaaggtgctggagctggaggacgagctgcaggagagcagaggcttcagaaagaagatcaagagactggaggagagcaacaagaagctggccctggagctggagcacgagaagggcaagctgaccggcctgggccagagcaacgccgccctgagagagcacaacagcatcctggagaccgccctggccaagagagaggccgacctggtgcagctgaacctgcaggtgcaggccgtgctgcagagaaaggaggaggaggacagacagatgaagcacctggtgcaggccctgcaggccagcctggagaaggagaaggagaaggtgaacagcctgaaggagcaggtggccgccgccaaggtggaggccggccacaacagaagacacttcaaggccgccagcctggagctgagcgaggtgaagaaggagctgcaggccaaggagcacctggtgcagaagctgcaggccgaggccgacgacctgcagatcagagagggcaagcacagccaggagatcgcccagttccaggccgagctggccgaggccagagcccagctgcagctgctgcagaagcagctggacgagcagctgagcaagcagcccgtgggcaaccaggagatggagaacctgaagtgggaggtggaccagaaggagagagagatccagagcctgaagcagcagctggacctgaccgagcagcagggcagaaaggagctggagggcctgcagcagctgctgcagaacgtgaagagcgagctggagatggcccaggaggacctgagcatgacccagaaggacaagttcatgctgcaggccaaggtgagcgagctgaagaacaacatgaagaccctgctgcagcagaaccagcagctgaagctggacctgagaagaggcgccgccaagaccagaaaggagcccaagggcgaggccagcagcagcaaccccgccacccccatcaagatccccgactgccccgtgcccgccagcctgctggaggagctgctgagacccccccccgccgtgagcaaggagcccctgaagaacctgaacagctgcctgcagcagctgaagcaggagatggacagcctgcagagacagatggaggagcacgccctgaccgtgcacgagagcctgagcagctggacccccctggagcccgccaccgccagccccgtgccccccggcggccacgccggccccagaggcgacccccagagacacagccagagcagagccagcaaggagggccccggcgagtag

SEQ ID NO: 75892 - DNA, 807 bp, Artificial Sequence
  Description of Artificial Sequence: Synthetic coding sequence
atgagcgacagcaaggagcccagactgcagcagctgggcctgctggtgagcaaggtgcccagcagcatcagccaggagcagagcagacaggacgccatctaccagaacctgacccagctgaaggccgccgtgggcgagctgagcgagaagagcaagctgcaggagatctaccaggagctgacccagctgaaggccgccgtgggcgagctgcccgagaagagcaagctgcaggagatctaccaggagctgaccagactgaaggccgccgtgggcgagctgcccgagaagagcaagcagcaggagatctaccaggagctgacccagctgaaggccgccgtggagagactgtgccacccctgcccctgggagtggaccttcttccagggcaactgctacttcatgagcaacagccagagaaactggcacgacagcatcaccgcctgcaaggaggtgggcgcccagctggtggtgatcaagagcgccgaggagcagaacttcctgcagctgcagagcagcagaagcaacagattcacctggatgggcctgagcgacctgaaccaggagggcacctggcagtgggtggacggcagccccctgctgcccagcttcaagcagtactggaacagaggcgagcccaacaacgtgggcgaggaggactgcgccgagttcagcggcaacggctggaacgacgacaagtgcaacctggccaagttctggatctgcaagaagagcgccgccagctgcagcagagacgaggagcagttcctgagccccgcccccgccacccccaaccccccccccgcctag

SEQ ID NO: 75893 - DNA, 1143 bp, Artificial Sequence
  Description of Artificial Sequence: Synthetic coding sequence
atgagcgacagcaaggagcccagactgcagcagctgggcctgctggaggaggagcagctgagaggcctgggcttcagacagaccagaggctacaagagcctggccgtgagcaaggtgcccagcagcatcagccaggagcagagcagacaggacgccatctaccagaacctgacccagctgaaggccgccgtgggcgagctgagcgagaagagcaagctgcaggagatctaccaggagctgacccagctgaaggccgccgtgggcgagctgcccgagaagagcaagctgcaggagatctaccaggagctgaccagactgaaggccgccgtgggcgagctgcccgagaagagcaagctgcaggagatctaccaggagctgacctggctgaaggccgccgtgggcgagctgcccgagaagagcaagatgcaggagatctaccaggagctgaccagactgaaggccgccgtgggcgagctgcccgagaagagcaagcagcaggagatctaccaggagctgaccagactgaaggccgccgtgggcgagctgcccgagaagagcaagcagcaggagatctaccaggagctgaccagactgaaggccgccgtgggcgagctgcccgagaagagcaagcagcaggagatctaccaggagctgacccagctgaaggccgccgtggagagactgtgccacccctgcccctgggagtggaccttcttccagggcaactgctacttcatgagcaacagccagagaaactggcacgacagcatcaccgcctgcaaggaggtgggcgcccagctggtggtgatcaagagcgccgaggagcagaacttcctgcagctgcagagcagcagaagcaacagattcacctggatgggcctgagcgacctgaaccaggagggcacctggcagtgggtggacggcagccccctgctgcccagcttcaagcagtactggaacagaggcgagcccaacaacgtgggcgaggaggactgcgccgagttcagcggcaacggctggaacgacgacaagtgcaacctggccaagttctggatctgcaagaagagcgccgccagctgcagcagagacgaggagcagttcctgagccccgcccccgccacccccaaccccccccccgcctag

SEQ ID NO: 75894 - DNA, 1215 bp, Artificial Sequence
  Description of Artificial Sequence: Synthetic coding sequence
atgagcgacagcaaggagcccagactgcagcagctgggcctgctggaggaggagcagctgagaggcctgggcttcagacagaccagaggctacaagagcctggccggctgcctgggccacggccccctggtgctgcagctgctgagcttcaccctgctggccggcctgctggtgcaggtgagcaaggtgcccagcagcatcagccaggagcagagcagacaggacgccatctaccagaacctgacccagctgaaggccgccgtgggcgagctgagcgagaagagcaagctgcaggagatctaccaggagctgacccagctgaaggccgccgtgggcgagctgcccgagaagagcaagctgcaggagatctaccaggagctgaccagactgaaggccgccgtgggcgagctgcccgagaagagcaagctgcaggagatctaccaggagctgacctggctgaaggccgccgtgggcgagctgcccgagaagagcaagatgcaggagatctaccaggagctgaccagactgaaggccgccgtgggcgagctgcccgagaagagcaagcagcaggagatctaccaggagctgaccagactgaaggccgccgtgggcgagctgcccgagaagagcaagcagcaggagatctaccaggagctgaccagactgaaggccgccgtgggcgagctgcccgagaagagcaagcagcaggagatctaccaggagctgacccagctgaaggccgccgtggagagactgtgccacccctgcccctgggagtggaccttcttccagggcaactgctacttcatgagcaacagccagagaaactggcacgacagcatcaccgcctgcaaggaggtgggcgcccagctggtggtgatcaagagcgccgaggagcagaacttcctgcagctgcagagcagcagaagcaacagattcacctggatgggcctgagcgacctgaaccaggagggcacctggcagtgggtggacggcagccccctgctgcccagcttcaagcagtactggaacagaggcgagcccaacaacgtgggcgaggaggactgcgccgagttcagcggcaacggctggaacgacgacaagtgcaacctggccaagttctggatctgcaagaagagcgccgccagctgcagcagagacgaggagcagttcctgagccccgcccccgccacccccaaccccccccccgcctag

SEQ ID NO: 75895 - DNA, 1197 bp, Artificial Sequence
  Description of Artificial Sequence: Synthetic coding sequence
atgagcgacagcaaggagcccagactgcagcagctgggcctgctggaggaggagcagctgagaggcctgggcttcagacagaccagaggctacaagagcctggccggctgcctgggccacggccccctggtgctgcagctgctgagcttcaccctgctggccggcctgctggtgcaggtgagcaaggtgcccagcagcatcagccaggagcagagcagacaggacgccatctaccagaacctgacccagctgaaggccgccgtgggcgagctgagcgagaagagcaagctgcaggagatctaccaggagctgacccagctgaaggccgccgtgggcgagctgcccgagaagagcaagctgcaggagatctaccaggagctgaccagactgaaggccgccgtgggcgagctgcccgagaagagcaagctgcaggagatctaccaggagctgacctggctgaaggccgccgtgggcgagctgcccgagaagagcaagatgcaggagatctaccaggagctgaccagactgaaggccgccgtgggcgagctgcccgagaagagcaagcagcaggagatctaccaggagctgaccagactgaaggccgccgtgggcgagctgcccgagaagagcaagcagcaggagatctaccaggagctgaccagactgaaggccgccgtgggcgagctgcccgagaagagcaagcagcaggagatctaccaggagctgacccagctgaaggccgccgtggagagactgtgccacccctgcccctgggagtggaccttcttccagggcaactgctacttcatgagcaacagccagagaaactggcacgacagcatcaccgcctgcaaggaggtgggcgcccagctggtggtgatcaagagcgccgaggagcagagcagcagaagcaacagattcacctggatgggcctgagcgacctgaaccaggagggcacctggcagtgggtggacggcagccccctgctgcccagcttcaagcagtactggaacagaggcgagcccaacaacgtgggcgaggaggactgcgccgagttcagcggcaacggctggaacgacgacaagtgcaacctggccaagttctggatctgcaagaagagcgccgccagctgcagcagagacgaggagcagttcctgagccccgcccccgccacccccaaccccccccccgcctag

SEQ ID NO: 75896 - DNA, 507 bp, Artificial Sequence
  Description of Artificial Sequence: Synthetic coding sequence
atgagcgacagcaaggagcccagactgcagcagctgggcctgctggaggaggagcagctgagaggcctgggcttcagacagaccagaggctacaagagcctggccggctgcctgggccacggccccctggtgctgcagctgctgagcttcaccctgctggccggcctgctggtgcaggtgagcaaggtgcccagcagcatcagccaggagcagagcagaagcaacagattcacctggatgggcctgagcgacctgaaccaggagggcacctggcagtgggtggacggcagccccctgctgcccagcttcaagcagtactggaacagaggcgagcccaacaacgtgggcgaggaggactgcgccgagttcagcggcaacggctggaacgacgacaagtgcaacctggccaagttctggatctgcaagaagagcgccgccagctgcagcagagacgaggagcagttcctgagccccgcccccgccacccccaaccccccccccgcctag

SEQ ID NO: 75897 - DNA, 939 bp, Artificial Sequence
  Description of Artificial Sequence: Synthetic coding sequence
atgagcgacagcaaggagcccagactgcagcagctgggcctgctggaggaggagcagctgagaggcctgggcttcagacagaccagaggctacaagagcctggccggctgcctgggccacggccccctggtgctgcagctgctgagcttcaccctgctggccggcctgctggtgcaggtgagcaaggtgcccagcagcatcagccaggagcagagcagacaggacgccatctaccagaacctgacccagctgaaggccgccgtgggcgagctgagcgagaagagcaagctgcaggagatctaccaggagctgacccagctgaaggccgccgtgggcgagctgcccgagaagagcaagctgcaggagatctaccaggagctgaccagactgaaggccgccgtgggcgagctgcccgagaagagcaagctgcaggagatctaccaggagctgacctggctgaaggccgccgtggagagactgtgccacccctgcccctgggagtggaccttcttccagggcaactgctacttcatgagcaacagccagagaaactggcacgacagcatcaccgcctgcaaggaggtgggcgcccagctggtggtgatcaagagcgccgaggagcagaacttcctgcagctgcagagcagcagaagcaacagattcacctggatgggcctgagcgacctgaaccaggagggcacctggcagtgggtggacggcagccccctgctgcccagcttcaagcagtactggaacagaggcgagcccaacaacgtgggcgaggaggactgcgccgagttcagcggcaacggctggaacgacgacaagtgcaacctggccaagttctggatctgcaagaagagcgccgccagctgcagcagagacgaggagcagttcctgagccccgcccccgccacccccaaccccccccccgcctag

SEQ ID NO: 75898 - DNA, 105 bp, Artificial Sequence
  Description of Artificial Sequence: Synthetic coding sequence
atgagcgacagcaaggagcccagactgcagcagctgggcctgctggaggaggagcagctgagaggcctgggcttcagacagaccagaagaaaccagaagtgctag

SEQ ID NO: 75899 - DNA, 855 bp, Artificial Sequence
  Description of Artificial Sequence: Synthetic coding sequence
atgagcgacagcaaggagcccagactgcagcagctgggcctgctgggctgcctgggccacggccccctggtgctgcagctgctgagcttcaccctgctggccggcctgctggtgcaggtgctgggccccgtgagcaaggtgcccagcagcatcagccaggagcagagcagacaggacgccatctaccagaacctgacccagctgaaggccgccgtgggcgagctgagcgagaagagcaagctgcaggagatctaccaggagctgacccagctgaaggccgccgtgggcgagctgcccgagaagagcaagctgcaggagatctaccaggagctgaccagactgaaggccgccgtgggcgagctgcccgagaagagcaagctgcaggagatctaccaggagctgacctggctgaaggccgccgtgggcgagctgcccgagaagagcaagatgcaggagatctaccaggagctgaccagactgaaggccgccgtgggcgagctgcccgagaagagcaagcagcaggagatctaccaggagctgaccagactgaaggccgccgtgggcgagctgcccgagaagagcaagcagcaggagatctaccaggagctgaccagactgaaggccgccgtgggcgagctgcccgagaagagcaagcagcaggagatctaccaggagctgacccagctgaaggccgccgtggagagactgtgccacccctgcccctgggagtggaccttcttccagggcaactgctacttcatgagcaacagccagagaaactggcacgacagcatcaccgcctgcaaggaggtgggcgcccagctggtggtgatcaagagcgccgaggagcagtag

SEQ ID NO: 75900 - DNA, 939 bp, Artificial Sequence; identical to SEQ ID NO: 75897
  Description of Artificial Sequence: Synthetic coding sequence

SEQ ID NO: 75901 - DNA, 1011 bp, Artificial Sequence
  Description of Artificial Sequence: Synthetic coding sequence
atggactaccccaccctgctgctggccctgctgcacgtgtacagagccctgtgcgaggaggtgctgtggcacaccagcgtgcccttcgccgagaacatgagcctggagtgcgtgtaccccagcatgggcatcctgacccaggtggagtggttcaagatcggcacccagcaggacagcatcgccatcttcagccccacccacggcatggtgatcagaaagccctacgccgagagagtgtacttcctgaacagcaccatggccagcaacaacatgaccctgttcttcagaaacgccagcgaggacgacgtgggctactacagctgcagcctgtacacctacccccagggcacctggcagaaggtgatccaggtggtgcagagcgacagcttcgaggccgccgtgcccagcaacagccacatcgtgagcgagcccggcaagaacgtgaccctgacctgccagccccagatgacctggcccgtgcaggccgtgagatgggagaagatccagcccagacagatcgacctgctgacctactgcaacctggtgcacggcagaaacttcaccagcaagttccccagacagatcgtgagcaactgcagccacggcagatggagcgtgatcgtgatccccgacgtgaccgtgagcgacagcggcctgtacagatgctacctgcaggccagcgccggcgagaacgagaccttcgtgatgagactgaccgtggccgagggcaagaccgacaaccagtacaccctgttcgtggccggcggcaccgtgctgctgctgctgttcgtgatcagcatcaccaccatcatcgtgatcttcctgaacagaagaagaagaagagagagaagagacctgttcaccgagagctgggacacccagaaggcccccaacaactacagaagccccatcagcaccagccagcccaccaaccagagcatggacgacaccagagaggacatctacgtgaactaccccaccttcagcagaagacccaagaccagagtgtag

SEQ ID NO: 75902 - DNA, 822 bp, Artificial Sequence
  Description of Artificial Sequence: Synthetic coding sequence
atgctgggccaggtggtgaccctgatcctgctgctgctgctgaaggtgtaccagggcaagggctgccagggcagcgccgaccacgtggtgagcatcagcggcgtgcccctgcagctgcagcccaacagcatccagaccaaggtggacagcatcgcctggaagaagctgctgcccagccagaacggcttccaccacatcctgaagtgggagaacggcagcctgcccagcaacaccagcaacgacagattcagcttcatcgtgaagaacctgagcctgctgatcaaggccgcccagcagcaggacagcggcctgtactgcctggaggtgaccagcatcagcggcaaggtgcagaccgccaccttccaggtgttcgtgttcgagttcagattctggcccttcctggtgatcatcgtgatcctgagcgccctgttcctgggcaccctggcctgcttctgcgtgtggagaagaaagagaaaggagaagcagagcgagaccagccccaaggagttcctgaccatctacgaggacgtgaaggacctgaagaccagaagaaaccacgagcaggagcagaccttccccggcggcggcagcaccatctacagcatgatccagagccagagcagcgcccccaccagccaggagcccgcctacaccctgtacagcctgatccagcccagcagaaagagcggcagcagaaagagaaaccacagccccagcttcaacagcaccatctacgaggtgatcggcaagagccagcccaaggcccagaaccccgccagactgagcagaaaggagctggagaacttcgacgtgtacagctag

SEQ ID NO: 75903 - DNA, 990 bp, Artificial Sequence
  Description of Artificial Sequence: Synthetic coding sequence
atgctgggccaggtggtgaccctgatcctgctgctgctgctgaaggtgtaccagggcaagggctgccagggcagcgccgaccacgtggtgagcatcagcggcgtgcccctgcagctgcagcccaacagcatccagaccaaggtggacagcatcgcctggaagaagctgctgcccagccagaacggcttccaccacatcctgaagtgggagaacggcagcctgcccagcaacaccagcaacgacagattcagcttcatcgtgaagaacctgagcctgctgatcaaggccgcccagcagcaggacagcggcctgtactgcctggaggtgaccagcatcagcggcaaggtgcagaccgccaccttccaggtgttcgtgttcgacaaggtggagaagcccagactgcagggccagggcaagatcctggacagaggcagatgccaggtggccctgagctgcctggtgagcagagacggcaacgtgagctacgcctggtacagaggcagcaagctgatccagaccgccggcaacctgacctacctggacgaggaggtggacatcaacggcacccacacctacacctgcaacgtgagcaaccccgtgagctgggagagccacaccctgaacctgacccaggactgccagaacgcccaccaggagttcagattctggcccttcctggtgatcatcgtgatcctgagcgccctgttcctgggcaccctggcctgcttctgcgtgtggagaagaaagagaaaggagaagcagagcgagaccagccccaaggagttcctgaccatctacgaggacgtgaaggacctgaagaccagaagaaaccacgagcaggagcagaccttccccggcggcggcagcaccatctacagcatgatccagagccagagcagcgcccccaccagccaggagcccgcctacaccctgtacagcctgatccagcccagcagaaagggcgacagattctacagcttcagcggctag

SEQ ID NO: 75904 - DNA, 1113 bp, Artificial Sequence
  Description of Artificial Sequence: Synthetic coding sequence
atgctgggccaggtggtgaccctgatcctgctgctgctgctgaaggtgtaccagggcaagggctgccagggcagcgccgaccacgtggtgagcatcagcggcgtgcccctgcagctgcagcccaacagcatccagaccaaggtggacagcatcgcctggaagaagctgctgcccagccagaacggcttccaccacatcctgaagtgggagaacggcagcctgcccagcaacaccagcaacgacagattcagcttcatcgtgaagaacctgagcctgctgatcaaggccgcccagcagcaggacagcggcctgtactgcctggaggtgaccagcatcagcggcaaggtgcagaccgccaccttccaggtgttcgtgttcgagagcctgctgcccgacaaggtggagaagcccagactgcagggccagggcaagatcctggacagaggcagatgccaggtggccctgagctgcctggtgagcagagacggcaacgtgagctacgcctggtacagaggcagcaagctgatccagaccgccggcaacctgacctacctggacgaggaggtggacatcaacggcacccacacctacacctgcaacgtgagcaaccccgtgagctgggagagccacaccctgaacctgacccaggactgccagaacgcccaccaggagttcagattctggcccttcctggtgatcatcgtgatcctgagcgccctgttcctgggcaccctggcctgcttctgcgtgtggagaagaaagagaaaggagaagcagagcgagaccagccccaaggagttcctgaccatctacgaggacgtgaaggacctgaagaccagaagaaaccacgagcaggagcagaccttccccggcggcggcagcaccatctacagcatgatccagagccagagcagcgcccccaccagccaggagcccgcctacaccctgtacagcctgatccagcccagcagaaagagcggcagcagaaagagaaaccacagccccagcttcaacagcaccatctacgaggtgatcggcaagagccagcccaaggcccagaaccccgccagactgagcagaaaggagctggagaacttcgacgtgtacagctag

SEQ ID NO: 75905 - DNA, 1098 bp, Artificial Sequence
  Description of Artificial Sequence: Synthetic coding sequence
atgctgggccaggtggtgaccctgatcctgctgctgctgctgaaggtgtaccagggcaagggctgccagggcagcgccgaccacgtggtgagcatcagcggcgtgcccctgcagctgcagcccaacagcatccagaccaaggtggacagcatcgcctggaagaagctgctgcccagccagaacggcttccaccacatcctgaagtgggagaacggcagcctgcccagcaacaccagcaacgacagattcagcttcatcgtgaagaacctgagcctgctgatcaaggccgcccagcagcaggacagcggcctgtactgcctggaggtgaccagcatcagcggcaaggtgcagaccgccaccttccaggtgttcgtgttcgacaaggtggagaagcccagactgcagggccagggcaagatcctggacagaggcagatgccaggtggccctgagctgcctggtgagcagagacggcaacgtgagctacgcctggtacagaggcagcaagctgatccagaccgccggcaacctgacctacctggacgaggaggtggacatcaacggcacccacacctacacctgcaacgtgagcaaccccgtgagctgggagagccacaccctgaacctgacccaggactgccagaacgcccaccaggagttcagattctggcccttcctggtgatcatcgtgatcctgagcgccctgttcctgggcaccctggcctgcttctgcgtgtggagaagaaagagaaaggagaagcagagcgagaccagccccaaggagttcctgaccatctacgaggacgtgaaggacctgaagaccagaagaaaccacgagcaggagcagaccttccccggcggcggcagcaccatctacagcatgatccagagccagagcagcgcccccaccagccaggagcccgcctacaccctgtacagcctgatccagcccagcagaaagagcggcagcagaaagagaaaccacagccccagcttcaacagcaccatctacgaggtgatcggcaagagccagcccaaggcccagaaccccgccagactgagcagaaaggagctggagaacttcgacgtgtacagctag

SEQ ID NO: 75906 - DNA, 495 bp, Artificial Sequence
  Description of Artificial Sequence: Synthetic coding sequence
atgaagtggaaggccctgttcaccgccgccatcctgcaggcccagctgcccatcaccgaggcccagagcttcggcctgctggaccccaagctgtgctacctgctggacggcatcctgttcatctacggcgtgatcctgaccgccctgttcctgagagtgaagttcagcagaagcgccgacgcccccgcctaccagcagggccagaaccagctgtacaacgagctgaacctgggcagaagagaggagtacgacgtgctggacaagagaagaggcagagaccccgagatgggcggcaagccccagagaagaaagaacccccaggagggcctgtacaacgagctgcagaaggacaagatggccgaggcctacagcgagatcggcatgaagggcgagagaagaagaggcaagggccacgacggcctgtaccagggcctgagcaccgccaccaaggacacctacgacgccctgcacatgcaggccctgccccccagatag

SEQ ID NO: 75907 - DNA, 492 bp, Artificial Sequence
  Description of Artificial Sequence: Synthetic coding sequence
atgaagtggaaggccctgttcaccgccgccatcctgcaggcccagctgcccatcaccgaggcccagagcttcggcctgctggaccccaagctgtgctacctgctggacggcatcctgttcatctacggcgtgatcctgaccgccctgttcctgagagtgaagttcagcagaagcgccgacgcccccgcctaccagcagggccagaaccagctgtacaacgagctgaacctgggcagaagagaggagtacgacgtgctggacaagagaagaggcagagaccccgagatgggcggcaagcccagaagaaagaacccccaggagggcctgtacaacgagctgcagaaggacaagatggccgaggcctacagcgagatcggcatgaagggcgagagaagaagaggcaagggccacgacggcctgtaccagggcctgagcaccgccaccaaggacacctacgacgccctgcacatgcaggccctgccccccagatag

SEQ ID NO: 75908 - DNA, 2274 bp, Artificial Sequence
  Description of Artificial Sequence: Synthetic coding sequence
atgctgctgagactgctgctggcctgggccgccgccggccccaccctgggccaggacccctgggccgccgagcccagagccgcctgcggccccagcagctgctacgccctgttccccagaagaagaaccttcctggaggcctggagagcctgcagagagctgggcggcgacctggccacccccagaacccccgaggaggcccagagagtggacagcctggtgggcgccggccccgccagcagactgctgtggatcggcctgcagagacaggccagacagtgccagctgcagagacccctgagaggcttcacctggaccaccggcgaccaggacaccgccttcaccaactgggcccagcccgccagcggcggcccctgccccgcccagagatgcgtggccctggaggccagcggcgagcacagatggctggagggcagctgcaccctggccgtggacggctacctgtgccagttcggcttcgagggcgcctgccccgccctgcaggacgaggccggccaggccggccccgccgtgtacaccacccccttccacctggtgagcaccgagttcgagtggctgcccttcggcagcgtggccgccgtgcagtgccaggccggcagaggcgccagcctgctgtgcgtgaagcagcccgagggcggcgtgggctggagcagagccggccccctgtgcctgggcaccggctgcagccccgacaacggcggctgcgagcacgagtgcgtggaggaggtggacggccacgtgagctgcagatgcaccgagggcttcagactggccgccgacggcagaagctgcgaggacccctgcgcccaggccccctgcgagcagcagtgcgagcccggcggcccccagggctacagctgccactgcagactgggcttcagacccgccgaggacgacccccacagatgcgtggacaccgacgagtgccagatcgccggcgtgtgccagcagatgtgcgtgaactacgtgggcggcttcgagtgctactgcagcgagggccacgagctggaggccgacggcatcagctgcagccccgccggcgccatgggcgcccaggccagccaggacctgggcgacgagctgctggacgacggcgaggacgaggaggacgaggacgaggcctggaaggccttcaacggcggctggaccgagatgcccggcatcctgtggatggagcccacccagccccccgacttcgccctggcctacagacccagcttccccgaggacagagagccccagatcccctaccccgagcccacctggcccccccccctgagcgcccccagagtgccctaccacagcagcgtgctgagcgtgaccagacccgtggtggtgagcgccacccaccccaccctgcccagcgcccaccagccccccgtgatccccgccacccaccccgccctgagcagagaccaccagatccccgtgatcgccgccaactaccccgacctgcccagcgcctaccagcccggcatcctgagcgtgagccacagcgcccagccccccgcccaccagccccccatgatcagcaccaagtaccccgagctgttccccgcccaccagagccccatgttccccgacaccagagtggccggcacccagaccaccacccacctgcccggcatcccccccaaccacgcccccctggtgaccaccctgggcgcccagctgcccccccaggcccccgacgccctggtgctgagaacccaggccacccagctgcccatcatccccaccgcccagcccagcctgaccaccaccagcagaagccccgtgagccccgcccaccagatcagcgtgcccgccgccacccagcccgccgccctgcccaccctgctgcccagccagagccccaccaaccagaccagccccatcagccccacccacccccacagcaaggccccccagatccccagagaggacggccccagccccaagctggccctgtggctgcccagccccgcccccaccgccgcccccaccgccctgggcgaggccggcctggccgagcacagccagagagacgacagatggctgctggtggccctgctggtgcccacctgcgtgttcctggtggtgctgctggccctgggcatcgtgtactgcaccagatgcggcccccacgcccccaacaagagaatcaccgactgctacagatgggtgatccacgccggcagcaagagccccaccgagcccatgccccccagaggcagcctgaccggcgtgcagacctgcagaaccagcgtgtag

SEQ ID NO: 75909 - DNA, 951 bp, Artificial Sequence
  Description of Artificial Sequence: Synthetic coding sequence
atgctgagaagaagaggcagccccggcatgggcgtgcacgtgggcgccgccctgggcgccctgtggttctgcctgaccggcgccctggaggtgcaggtgcccgaggaccccgtggtggccctggtgggcaccgacgccaccctgtgctgcagcttcagccccgagcccggcttcagcctggcccagctgaacctgatctggcagctgaccgacaccaagcagctggtgcacagcttcgccgagggccaggaccagggcagcgcctacgccaacagaaccgccctgttccccgacctgctggcccagggcaacgccagcctgagactgcagagagtgagagtggccgacgagggcagcttcacctgcttcgtgagcatcagagacttcggcagcgccgccgtgagcctgcaggtggccgccccctacagcaagcccagcatgaccctggagcccaacaaggacctgagacccggcgacaccgtgaccatcacctgcagcagctacagaggctaccccgaggccgaggtgttctggcaggacggccagggcgtgcccctgaccggcaacgtgaccaccagccagatggccaacgagcagggcctgttcgacgtgcacagcgtgctgagagtggtgctgggcgccaacggcacctacagctgcctggtgagaaaccccgtgctgcagcaggacgcccacggcagcgtgaccatcaccggccagcccatgaccttcccccccgaggccctgtgggtgaccgtgggcctgagcgtgtgcctgatcgccctgctggtggccctggccttcgtgtgctggagaaagatcaagcagagctgcgaggaggagaacgccggcgccgaggaccaggacggcgagggcgagggcagcaagaccgccctgcagcccctgaagcacagcgacagcaaggaggacgacggccaggagatcgcctag

SEQ ID NO: 75910 - DNA, 1605 bp, Artificial Sequence
  Description of Artificial Sequence: Synthetic coding sequence
atgctgagaagaagaggcagccccggcatgggcgtgcacgtgggcgccgccctgggcgccctgtggttctgcctgaccggcgccctggaggtgcaggtgcccgaggaccccgtggtggccctggtgggcaccgacgccaccctgtgctgcagcttcagccccgagcccggcttcagcctggcccagctgaacctgatctggcagctgaccgacaccaagcagctggtgcacagcttcgccgagggccaggaccagggcagcgcctacgccaacagaaccgccctgttccccgacctgctggcccagggcaacgccagcctgagactgcagagagtgagagtggccgacgagggcagcttcacctgcttcgtgagcatcagagacttcggcagcgccgccgtgagcctgcaggtggccgccccctacagcaagcccagcatgaccctggagcccaacaaggacctgagacccggcgacaccgtgaccatcacctgcagcagctaccagggctaccccgaggccgaggtgttctggcaggacggccagggcgtgcccctgaccggcaacgtgaccaccagccagatggccaacgagcagggcctgttcgacgtgcacagcatcctgagagtggtgctgggcgccaacggcacctacagctgcctggtgagaaaccccgtgctgcagcaggacgcccacagcagcgtgaccatcaccccccagagaagccccaccggcgccgtggaggtgcaggtgcccgaggaccccgtggtggccctggtgggcaccgacgccaccctgagatgcagcttcagccccgagcccggcttcagcctggcccagctgaacctgatctggcagctgaccgacaccaagcagctggtgcacagcttcaccgagggcagagaccagggcagcgcctacgccaacagaaccgccctgttccccgacctgctggcccagggcaacgccagcctgagactgcagagagtgagagtggccgacgagggcagcttcacctgcttcgtgagcatcagagacttcggcagcgccgccgtgagcctgcaggtggccgccccctacagcaagcccagcatgaccctggagcccaacaaggacctgagacccggcgacaccgtgaccatcacctgcagcagctacagaggctaccccgaggccgaggtgttctggcaggacggccagggcgtgcccctgaccggcaacgtgaccaccagccagatggccaacgagcagggcctgttcgacgtgcacagcgtgctgagagtggtgctgggcgccaacggcacctacagctgcctggtgagaaaccccgtgctgcagcaggacgcccacggcagcgtgaccatcaccggccagcccatgaccttcccccccgaggccctgtgggtgaccgtgggcctgagcgtgtgcctgatcgccctgctggtggccctggccttcgtgtgctggagaaagatcaagcagagctgcgaggaggagaacgccggcgccgaggaccaggacggcgagggcgagggcagcaagaccgccctgcagcccctgaagcacagcgacagcaaggaggacgacggccaggagatcgcctag

SEQ ID NO: 75911 - DNA, 1482 bp, Artificial Sequence
  Description of Artificial Sequence: Synthetic coding sequence
atgctgagaagaagaggcagccccggcatgggcgtgcacgtgggcgccgccctgggcgccctgtggttctgcctgaccggcgccctggaggtgcaggtgcccgaggaccccgtggtggccctggtgggcaccgacgccaccctgtgctgcagcttcagccccgagcccggcttcagcctggcccagctgaacctgatctggcagctgaccgacaccaagcagctggtgcacagcttcgccgagggccaggaccagggcagcgcctacgccaacagaaccgccctgttccccgacctgctggcccagggcaacgccagcctgagactgcagagagtgagagtggccgacgagggcagcttcacctgcttcgtgagcatcagagacttcggcagcgccgccgtgagcctgcaggtggccgccccctacagcaagcccagcatgaccctggagcccaacaaggacctgagacccggcgacaccgtgaccatcacctgcagcagctaccagggctaccccgaggccgaggtgttctggcaggacggccagggcgtgcccctgaccggcaacgtgaccaccagccagatggccaacgagcagggcctgttcgacgtgcacagcatcctgagagtggtgctgggcgccaacggcacctacagctgcctggtgagaaaccccgtgctgcagcaggacgcccacagcagcgtgaccatcaccccccagagaagccccaccggcgccgtggaggtgcaggtgcccgaggaccccgtggtggccctggtgggcaccgacgccaccctgagatgcagcttcagccccgagcccggcttcagcctggcccagctgaacctgatctggcagctgaccgacaccaagcagctggtgcacagcttcaccgagggcagagaccagggcagcgcctacgccaacagaaccgccctgttccccgacctgctggcccagggcaacgccagcctgagactgcagagagtgagagtggccgacgagggcagcttcacctgcttcgtgagcatcagagacttcggcagcgccgccgtgagcctgcaggtggccgccccctacagcaagcccagcatgaccctggagcccaacaaggacctgagacccggcgacaccgtgaccatcacctgcagcagctacagaggctaccccgaggccgaggtgttctggcaggacggccagggcgtgcccctgaccggcaacgtgaccaccagccagatggccaacgagcagggcctgttcgacgtgcacagcgtgctgagagtggtgctgggcgccaacggcacctacagctgcctggtgagaaaccccgtgctgcagcaggacgcccacggcagcgtgaccatcaccggccagcccatgaccttcccccccggccccgccagcagcgccgtgcccctgagccccgcccaccccccccacggcagcatgtgctggagccactggttcagcagaggcctgtag

SEQ ID NO: 75912 - DNA, 423 bp, Artificial Sequence
  Description of Artificial Sequence: Synthetic coding sequence
atgctgagaagaagaggcagccccggcatgggcgtgcacgtgggcgccgccctgggcgccctgtggttctgcctgaccggcgccctggaggtgcaggtgcccgaggaccccgtggtggccctggtgggcaccgacgccaccctgtgctgcagcttcagccccgagcccggcttcagcctggcccagctgaacctgatctggcagctgaccgacaccaagcagctggtgcacagcttcgccgagggccaggaccagggcagcgcctacgccaacagaaccgccctgttccccgacctgcacagagccgcctacgacatcccccccagaggccccgtgggcgacagaggcgccgtgtgcctgagccactgcaccgccggcggccccggcttcagagtgctggagaaggaccagaccgagctgtag

SEQ ID NO: 75913 - DNA, 411 bp, Artificial Sequence
  Description of Artificial Sequence: Synthetic coding sequence
atgctgagaagaagaggcagccccggcatgggcgtgcacgtgggcgccgccctgggcgccctgtggttctgcctgaccggcgccctggaggtgcaggtgcccgaggaccccgtggtggccctggtgggcaccgacgccaccctgtgctgcagcttcagccccgagcccggcttcagcctggcccagctgaacctgatctggcagctgaccgacaccaagcagctggtgcacagcttcgccgagggccaggaccagggcagcgcctacgccaacagaaccgccctgttccccgacctgctggcccagggcaacgccagcctgagactgcagagagtgagagtggccgacgagggcagcttcacctgcttcgtgagcatcagagacttcggcagcgccgccgtgagcctgtag

SEQ ID NO: 75914 - DNA, 402 bp, Artificial Sequence
  Description of Artificial Sequence: Synthetic coding sequence
atgctgagaagaagaggcagccccggcatgggcgtgcacgtgggcgccgccctgggcgccctgtggttctgcctgaccggcgccctggaggtgcaggtgcccgaggaccccgtggtggccctggtgggcaccgacgccaccctgtgctgcagcttcagccccgagcccggcttcagcctggcccagctgaacctgatctggcagctgaccgacaccaagcagctggtgcacagcttcgccgagggccaggaccagggcagcgcctacgccaacagaaccgccctgttccccgacctgctggcccagggcaacgccagcctgagactgcagagagtgagagtggccgacgagggcagcttcacctgcttcgtgagcatcagagacttcggcagcgccgcctag

SEQ ID NO: 75915 - DNA, 1602 bp, Artificial Sequence
  Description of Artificial Sequence: Synthetic coding sequence
atgctgagaagaagaggcagccccggcatgggcgtgcacgtgggcgccgccctgggcgccctgtggttctgcctgaccggcgccctggaggtgcaggtgcccgaggaccccgtggtggccctggtgggcaccgacgccaccctgtgctgcagcttcagccccgagcccggcttcagcctggcccagctgaacctgatctggcagctgaccgacaccaagcagctggtgcacagcttcgccgagggccaggaccagggcagcgcctacgccaacagaaccgccctgttccccgacctgctggcccagggcaacgccagcctgagactgcagagagtgagagtggccgacgagggcagcttcacctgcttcgtgagcatcagagacttcggcagcgccgccgtgagcctgcaggtggccgccccctacagcaagcccagcatgaccctggagcccaacaaggacctgagacccggcgacaccgtgaccatcacctgcagcagctaccagggctaccccgaggccgaggtgttctggcaggacggccagggcgtgcccctgaccggcaacgtgaccaccagccagatggccaacgagcagggcctgttcgacgtgcacagcatcctgagagtggtgctgggcgccaacggcacctacagctgcctggtgagaaaccccgtgctgcagcaggacgcccacagcagcgtgaccatcaccccccagagaagccccaccggcgccgtggaggtgcaggtgcccgaggaccccgtggtggccctggtgggcaccgacgccaccctgagatgcagcttcagccccgagcccggcttcagcctggcccagctgaacctgatctggcagctgaccgacaccaagcagctggtgcacagcttcaccgagggcagagaccagggcagcgcctacgccaacagaaccgccctgttccccgacctgctggcccagggcaacgccagcctgagactgcagagagtgagagtggccgacgagggcagcttcacctgcttcgtgagcatcagagacttcggcagcgccgccgtgagcctgcaggtggccgccccctacagcaagcccagcatgaccctggagcccaacaaggacctgagacccggcgacaccgtgaccatcacctgcagcagctacagaggctaccccgaggccgaggtgttctggcaggacggccagggcgtgcccctgaccggcaacgtgaccaccagccagatggccaacgagcagggcctgttcgacgtgcacagcgtgctgagagtggtgctgggcgccaacggcacctacagctgcctggtgagaaaccccgtgctgcagcaggacgcccacggcagcgtgaccatcaccggccagcccatgaccttcccccccgaggccctgtgggtgaccgtgggcctgagcgtgtgcctgatcgccctgctggtggccctggccttcgtgtgctggagaaagatcaagcagagctgcgaggaggagaacgccggcgccgaggaccaggacggcgagggcgagggcagcaagaccgccctgcagcccctgaagcacagcgacagcaaggagggcaaggacacctgggcctag

SEQ ID NO: 75916 - DNA, 498 bp, Artificial Sequence
  Description of Artificial Sequence: Synthetic coding sequence
atgctgagaagaagaggcagccccggcatgggcgtgcacgtgggcgccgccctgggcgccctgtggttctgcctgaccggcgccctggaggtgcaggtgcccgaggaccccgtggtggccctggtgggcaccgacgccaccctgtgctgcagcttcagccccgagcccggcttcagcctggcccagctgaacctgatctggcagctgaccgacaccaagcagctggtgcacagcttcgccgagggccaggaccagggcagcgcctacgccaacagaaccgccctgttccccgacctgctggcccagggcaacgccagcctgagactgcagagagtgagagtggccgacgagggcagcttcacctgcttcgtgagcatcagagacttcggcagcgccgccgtgagcctgcaggtggccgccccctacagcaagcccagcatgaccctggagcccaacaaggacctgagacccggcgacaccgtgaccatcacctgctag

SEQ ID NO: 75917 - DNA, 156 bp, Artificial Sequence
  Description of Artificial Sequence: Synthetic coding sequence
atgctgagaagaagaggcagccccggcatgggcgtgcacgtgggcgccgccctgggcgccctgtggttctgcctgaccggcgccctggaggtgcaggtgcccgaggaccccgtggtggccctggtgggcaccgacgccaccctgtgctgcagctag

SEQ ID NO: 75918 - DNA, 663 bp, Artificial Sequence
  Description of Artificial Sequence: Synthetic coding sequence
atgctgagactgctgctggccctgaacctgttccccagcatccaggtgaccggcaacaagatcctggtgaagcagagccccatgctggtggcctacgacaacgccgtgaacctgagctgcaagtacagctacaacctgttcagcagagagttcagagccagcctgcacaagggcctggacagcgccgtggaggtgtgcgtggtgtacggcaactacagccagcagctgcaggtgtacagcaagaccggcttcaactgcgacggcaagctgggcaacgagagcgtgaccttctacctgcagaacctgtacgtgaaccagaccgacatctacttctgcaagatcgaggtgatgtacccccccccctacctggacaacgagaagagcaacggcaccatcatccacgtgaagggcaagcacctgtgccccagccccctgttccccggccccagcaagcccttctgggtgctggtggtggtgggcggcgtgctggcctgctacagcctgctggtgaccgtggccttcatcatcttctgggtgagaagcaagagaagcagactgctgcacagcgactacatgaacatgacccccagaagacccggccccaccagaaagcactaccagccctacgccccccccagagacttcgccgcctacagaagctag

SEQ ID NO: 75919 - DNA, 306 bp, Artificial Sequence
  Description of Artificial Sequence: Synthetic coding sequence
atgctgagactgctgctggccctgaacctgttccccagcatccaggtgaccggcaagcacctgtgccccagccccctgttccccggccccagcaagcccttctgggtgctggtggtggtgggcggcgtgctggcctgctacagcctgctggtgaccgtggccttcatcatcttctgggtgagaagcaagagaagcagactgctgcacagcgactacatgaacatgacccccagaagacccggccccaccagaaagcactaccagccctacgccccccccagagacttcgccgcctacagaagctag

SEQ ID NO: 75920 - DNA, 411 bp, Artificial Sequence
  Description of Artificial Sequence: Synthetic coding sequence
atgctgagactgctgctggccctgaacctgttccccagcatccaggtgaccggcaacaagatcctggtgaagcagagccccatgctggtggcctacgacaacgccgtgaacctgagctacaacgagaagagcaacggcaccatcatccacgtgaagggcaagcacctgtgccccagccccctgttccccggccccagcaagcccttctgggtgctggtggtggtgggcggcgtgctggcctgctacagcctgctggtgaccgtggccttcatcatcttctgggtgagaagcaagagaagcagactgctgcacagcgactacatgaacatgacccccagaagacccggccccaccagaaagcactaccagccctacgccccccccagagacttcgccgcctacagaagctag

SEQ ID NO: 75921 - DNA, 705 bp, Artificial Sequence
  Description of Artificial Sequence: Synthetic coding sequence
atgccctgcggcctgagcgccctgatcatgtgccccaagggcatggtggccgtggtggtggccgtggacgacggcgacagccaggccctggccggcaacaagatcctggtgaagcagagccccatgctggtggcctacgacaacgccgtgaacctgagctgcaagtacagctacaacctgttcagcagagagttcagagccagcctgcacaagggcctggacagcgccgtggaggtgtgcgtggtgtacggcaactacagccagcagctgcaggtgtacagcaagaccggcttcaactgcgacggcaagctgggcaacgagagcgtgaccttctacctgcagaacctgtacgtgaaccagaccgacatctacttctgcaagatcgaggtgatgtacccccccccctacctggacaacgagaagagcaacggcaccatcatccacgtgaagggcaagcacctgtgccccagccccctgttccccggccccagcaagcccttctgggtgctggtggtggtgggcggcgtgctggcctgctacagcctgctggtgaccgtggccttcatcatcttctgggtgagaagcaagagaagcagactgctgcacagcgactacatgaacatgacccccagaagacccggccccaccagaaagcactaccagccctacgccccccccagagacttcgccgcctacagaagctag

SEQ ID NO: 75922 - DNA, 1920 bp, Artificial Sequence
  Description of Artificial Sequence: Synthetic coding sequence
atggtggactacatcgtggagtacgactacgacgccgtgcacgacgacgagctgaccatcagagtgggcgagatcatcagaaacgtgaagaagctgcaggaggagggctggctggagggcgagctgaacggcagaagaggcatgttccccgacaacttcgtgaaggagatcaagagagagaccgagttcaaggacgacagcctgcccatcaagagagagagacacggcaacgtggccagcctggtgcagagaatcagcacctacggcctgcccgccggcggcatccagccccacccccagaccaagaacatcaagaagaagaccaagaagagacagtgcaaggtgctgttcgagtacatcccccagaacgaggacgagctggagctgaaggtgggcgacatcatcgacatcaacgaggaggtggaggagggctggtggagcggcaccctgaacaacaagctgggcctgttccccagcaacttcgtgaaggagctggaggtgaccgacgacggcgagacccacgaggcccaggacgacagcgagaccgtgctggccggccccaccagccccatccccagcctgggcaacgtgagcgagaccgccagcggcagcgtgacccagcccaagaagatcagaggcatcggcttcggcgacatcttcaaggagggcagcgtgaagctgagaaccagaaccagcagcagcgagaccgaggagaagaagcccgagaagcccctgatcctgcagagcctgggccccaagacccagagcgtggagatcaccaagaccgacaccgagggcaagatcaaggccaaggagtactgcagaaccctgttcgcctacgagggcaccaacgaggacgagctgaccttcaaggagggcgagatcatccacctgatcagcaaggagaccggcgaggccggctggtggagaggcgagctgaacggcaaggagggcgtgttccccgacaacttcgccgtgcagatcaacgagctggacaaggacttccccaagcccaagaagccccccccccccgccaaggcccccgcccccaagcccgagctgatcgccgccgagaagaagtacttcagcctgaagcccgaggagaaggacgagaagagcaccctggagcagaagcccagcaagcccgccgccccccaggtgccccccaagaagcccaccccccccaccaaggccagcaacctgctgagaagcagcggcaccgtgtaccccaagagacccgagaagcccgtgcccccccccccccccatcgccaagatcaacggcgaggtgagcagcatcagcagcaagttcgagaccgagcccgtgagcaagctgaagctggacagcgagcagctgcccctgagacccaagagcgtggacttcgacagcctgaccgtgagaaccagcaaggagaccgacgtggtgaacttcgacgacatcgccagcagcgagaacctgctgcacctgaccgccaacagacccaagatgcccggcagaagactgcccggcagattcaacggcggccacagccccacccacagccccgagaagatcctgaagctgcccaaggaggaggacagcgccaacctgaagcccagcgagctgaagaaggacacctgctacagccccaagcccagcgtgtacctgagcacccccagcagcgccagcaaggccaacaccaccgccttcctgacccccctggagatcaaggccaaggtggagaccgacgacgtgaagaagaacagcctggacgagctgagagcccagatcatcgagctgctgtgcatcgtggaggccctgaagaaggaccacggcaaggagctggagaagctgagaaaggacctggaggaggagaagaccatgagaagcaacctggagatggagatcgagaagctgaagaaggccgtgctgagcagctag

SEQ ID NO: 75923 - DNA, 717 bp, Artificial Sequence
  Description of Artificial Sequence: Synthetic coding sequence
atgtgcagaagatgcaagcccgagctgagacagaacttccagagcgccagcggcatctgcatctgccactggctgcagatcagaagaaccagaagcagagagggcagagccatgtggctgccccccgccctgctgctgctgagcctgagcggctgcttcagcatccagggccccgagagcgtgagagcccccgagcagggcagcctgaccgtgcagtgccactacaagcagggctgggagacctacatcaagtggtggtgcagaggcgtgagatgggacacctgcaagatcctgatcgagaccagaggcagcgagcagggcgagaagagcgacagagtgagcatcaaggacaaccagaaggacagaaccttcaccgtgaccatggagggcctgagaagagacgacgccgacgtgtactggtgcggcatcgagagaagaggccccgacctgggcacccaggtgaaggtgatcgtggaccccgagggcgccgccagcaccaccgccagcagccccaccaacagcaacatggccgtgttcatcggcagccacaagagaaaccactacatgctgctggtgttcgtgaaggtgcccatcctgctgatcctggtgaccgccatcctgtggctgaagggcagccagagagtgcccgaggagcccggcgagcagcccatctacatgaacttcagcgagcccctgaccaaggacatggccacctag

SEQ ID NO: 75924 - DNA, 606 bp, Artificial Sequence
  Description of Artificial Sequence: Synthetic coding sequence
atgtggctgccccccgccctgctgctgctgagcctgagcggctgcttcagcatccagggccccgagagcgtgagagcccccgagcagggcagcctgaccgtgcagtgccactacaagcagggctgggagacctacatcaagtggtggtgcagaggcgtgagatgggacacctgcaagatcctgatcgagaccagaggcagcgagcagggcgagaagagcgacagagtgagcatcaaggacaaccagaaggacagaaccttcaccgtgaccatggagggcctgagaagagacgacgccgacgtgtactggtgcggcatcgagagaagaggccccgacctgggcacccaggtgaaggtgatcgtggaccccgagggcgccgccagcaccaccgccagcagccccaccaacagcaacatggccgtgttcatcggcagccacaagagaaaccactacatgctgctggtgttcgtgaaggtgcccatcctgctgatcctggtgaccgccatcctgtggctgaagggcagccagagagtgcccgaggagcccggcgagcagcccatctacatgaacttcagcgagcccctgaccaaggacatggccacctag

SEQ ID NO: 75925 - DNA, 735 bp, Artificial Sequence
  Description of Artificial Sequence: Synthetic coding sequence
atgcccctgctgaccctgtacctgctgctgttctggctgagcggctacagcatcgtgacccagatcaccggccccaccaccgtgaacggcctggagagaggcagcctgaccgtgcagtgcgtgtacagaagcggctgggagacctacctgaagtggtggtgcagaggcgccatctggagagactgcaagatcctggtgaagaccagcggcagcgagcaggaggtgaagagagacagagtgagcatcaaggacaaccagaagaacagaaccttcaccgtgaccatggaggacctgatgaagaccgacgccgacacctactggtgcggcatcgagaagaccggcaacgacctgggcgtgaccgtgcaggtgaccatcgaccccgcccccgtgacccaggaggagaccagcagcagccccaccctgaccggccaccacctggacaacagaagcgagggcagccaggccgccaactacagacccgccgcccaccaggcccaggcccccgaggcccagtgcccccccgccccccacctgcaccacatcgccgccgccttcggcggcagactgaccctgggcctggaggacgacgaggtgcccgccgagagcagcagagacgtgcccagagccggcaccgccgcccccggcggcagacccctgctgtgcagacccgaccccgccgccggcagaaacctgcccgccaagggctaccacgaggccttcctgtgccccggctag

SEQ ID NO: 75926 - DNA, 873 bp, Artificial Sequence
  Description of Artificial Sequence: Synthetic coding sequence
atgcccctgctgaccctgtacctgctgctgttctggctgagcggctacagcatcgtgacccagatcaccggccccaccaccgtgaacggcctggagagaggcagcctgaccgtgcagtgcgtgtacagaagcggctgggagacctacctgaagtggtggtgcagaggcgccatctggagagactgcaagatcctggtgaagaccagcggcagcgagcaggaggtgaagagagacagagtgagcatcaaggacaaccagaagaacagaaccttcaccgtgaccatggaggacctgatgaagaccgacgccgacacctactggtgcggcatcgagaagaccggcaacgacctgggcgtgaccgtgcaggtgaccatcgaccccgcccccgtgacccaggaggagaccagcagcagccccaccctgaccggccaccacctggacaacagacacaagctgctgaagctgagcgtgctgctgcccctgatcttcaccatcctgctgctgctgctggtggccgccagcctgctggcctggagaatgatgaagtaccagcagaaggccgccggcatgagccccgagcaggtgctgcagcccctggagggcgacctgtgctacgccgacctgaccctgcagctggccggcaccagcccccagaaggccaccaccaagctgagcagcgcccaggtggaccaggtggaggtggagtacgtgaccatggccagcctgcccaaggaggacatcagctacgccagcctgaccctgggcgccgaggaccaggagcccacctactgcaacatgggccacctgagcagccacctgcccggcagaggccccgaggagcccaccgagtacagcaccatcagcagaccctag

SEQ ID NO: 75927 - DNA, 585 bp, Artificial Sequence
  Description of Artificial Sequence: Synthetic coding sequence
atgtggctgccccagctggacctgatgagagtgatcagcgccaagagccagggctacagcatcgtgacccagatcaccggccccaccaccgtgaacggcctggagagaggcagcctgaccgtgcagtgcgtgtacagaagcggctgggagacctacctgaagtggtggtgcagaggcgccatctggagagactgcaagatcctggtgaagaccagcggcagcgagcaggaggtgaagagagacagagtgagcatcaaggacaaccagaagaacagaaccttcaccgtgaccatggaggacctgatgaagaccgacgccgacacctactggtgcggcatcgagaagaccggcaacgacctgggcgtgaccgtgcaggtgaccatcgaccccgcccccgtgacccaggaggagaccagcagcagccccaccctgaccggccaccacctggacaacagcagcagagacgtgcccagagccggcaccgccgcccccggcggcagacccctgctgtgcagacccgaccccgccgccggcagaaacctgcccgccaagggctaccacgaggccttcctgtgccccggctag

SEQ ID NO: 75928 - DNA, 720 bp, Artificial Sequence
  Description of Artificial Sequence: Synthetic coding sequence
atgtggctgccccagctggacctgatgagagtgatcagcgccaagagccagggctacagcatcgtgacccagatcaccggccccaccaccgtgaacggcctggagagaggcagcctgaccgtgcagtgcgtgtacagaagcggctgggagacctacctgaagtggtggtgcagaggcgccatctggagagactgcaagatcctggtgaagaccagcggcagcgagcaggaggtgaagagagacagagtgagcatcaaggacaaccagaagaacagaaccttcaccgtgaccatggaggacctgatgaagaccgacgccgacacctactggtgcggcatcgagaagaccggcaacgacctgggcgtgaccgtgcaggtgaccatcgaccccgccagcacccccgcccccaccacccccaccagcaccaccttcaccgcccccgtgacccaggaggagaccagcagcagccccaccctgaccggccaccacctggacaacagacacaagctgctgaagctgagcgtgctgctgcccctgatcttcaccatcctgctgctgctgctggtggccgccagcctgctggcctggagaatgatgaagtaccagcagaagggcaccgccgcccccggcggcagacccctgctgtgcagacccgaccccgccgccggcagaaacctgcccgccaagggctaccacgaggccttcctgtgccccggctag

SEQ ID NO: 75929 - DNA, 699 bp, Artificial Sequence
  Description of Artificial Sequence: Synthetic coding sequence
atgctgagagccgccctgcccgccctgctgctgcccctgctgggcctggccgccgccgccgtggccgactgccccagcagcacctggatccagttccaggacagctgctacatcttcctgcaggaggccatcaaggtggagagcatcgaggacgtgagaaaccagtgcaccgaccacggcgccgacatgatcagcatccacaacgaggaggagaacgccttcatcctggacaccctgaagaagcagtggaagggccccgacgacatcctgctgggcatgttctacgacaccgacgacgccagcttcaagtggttcgacaacagcaacatgaccttcgacaagtggaccgaccaggacgacgacgaggacctggtggacacctgcgccttcctgcacatcaagaccggcgagtggaagaagggcaactgcgaggtgagcagcgtggagggcaccctgtgcaagaccgccatcccctacaagagaaagtacctgagcgacaaccacatcctgatcagcgccctggtgatcgccagcaccgtgatcctgaccgtgctgggcgccatcatctggttcctgtacaagaagcacagcgacagcagattcaccaccgtgttcagcaccgccccccagagcccctacaacgaggactgcgtgctggtggtgggcgaggagaacgagtaccccgtgcagttcgactag

SEQ ID NO: 75930 - DNA, 525 bp, Artificial Sequence
  Description of Artificial Sequence: Synthetic coding sequence
atgctgagagccgccctgcccgccctgctgctgcccctgctgggcctggccgccgccgccgtggccgactgccccagcagcacctggatccagttccaggacagctgctacatcttcctgcaggaggccatcaaggtggagagcatcgaggacgtgagaaaccagtgcaccgaccacggcgccgacatgatcagcatccacaacgaggaggagaacgccttcatcctggacaccctgaagaagcagtggaagggccccgacgacatcctgctgggcatgttctacgacaccgacgtgccctacaagagaaagtacctgagcgacaaccacatcctgatcagcgccctggtgatcgccagcaccgtgatcctgaccgtgctgggcgccatcatctggttcctgtacaagaagcacagcgacagcagattcaccaccgtgttcagcaccgccccccagagcccctacaacgaggactgcgtgctggtggtgggcgaggagaacgagtaccccgtgcagttcgactag

SEQ ID NO: 75931 - DNA, 849 bp, Artificial Sequence
  Description of Artificial Sequence: Synthetic coding sequence
atgagcggcggctggatggcccaggtgggcgcctggagaaccggcgccctgggcctggccctgctgctgctgctgggcctgggcctgggcctggaggccgccgccagccccctgagcacccccaccagcgcccaggccgccggccccagcagcggcagctgcccccccaccaagttccagtgcagaaccagcggcctgtgcgtgcccctgacctggagatgcgacagagacctggactgcagcgacggcagcgacgaggaggagtgcagaatcgagccctgcacccagaagggccagtgcccccccccccccggcctgccctgcccctgcaccggcgtgagcgactgcagcggcggcaccgacaagaagctgagaaactgcagcagactggcctgcctggccggcgagctgagatgcaccctgagcgacgactgcatccccctgacctggagatgcgacggccaccccgactgccccgacagcagcgacgagctgggctgcggcaccaacgagatcctgcccgagggcgacgccaccaccatgggcccccccgtgaccctggagagcgtgaccagcctgagaaacgccaccaccatgggcccccccgtgaccctggagagcgtgcccagcgtgggcaacgccaccagcagcagcgccggcgaccagagcggcagccccaccgcctacggcgtgatcgccgccgccgccgtgctgagcgccagcctggtgaccgccaccctgctgctgctgagctggctgagagcccaggagagactgagacccctgggcctgctggtggccatgaaggagagcctgctgctgagcgagcagaagaccagcctgccctag

SEQ ID NO: 75932 - DNA, 606 bp, Artificial Sequence
  Description of Artificial Sequence: Synthetic coding sequence
aacgagatcctgcccgagggcgacgccaccaccatgggcccccccgtgaccctggagagcgtgaccagcctgagaaacgccaccaccatgggcccccccgtgaccctggagagcgtgcccagcgtgggcaacgccatcctgctgtgcagaagacccgtgtggaagcccaactgcctgtggggctactgcagctgctgcggcgcccagtgcaagcccggccacagacaccccccccccttcgtgctggcccccagccccggcgcccccccccccaccggcgtgaccggcggccacgagggcgtgcccgccgccgtgagaaccgaggacctggccgccctgagaaccagcacctgccaccacagacacagcgccctgggcgtggccggccaggaggagagcagcgacgccgacggctaccccggcacccccgccctgagagacctgagcagcagcggccacgtggagcccagaaccagagcccccgccgaggtggccctggagatcgagggcccctggaccctgcccatggagatcagaggcgccagaatgggcaacctgccccagcccgagctgagaggctggccccaggccgcccccagaggctag

SEQ ID NO: 75933 - DNA, 723 bp, Artificial Sequence
  Description of Artificial Sequence: Synthetic coding sequence
atgagcggcggctggatggcccaggtgggcgcctggagaaccggcgccctgggcctggccctgctgctgctgctgggcctgggcctgggcctggaggccgccgccagccccctgagcacccccaccagcgcccaggccgccggcatcgagccctgcacccagaagggccagtgcccccccccccccggcctgccctgcccctgcaccggcgtgagcgactgcagcggcggcaccgacaagaagctgagaaactgcagcagactggcctgcctggccggcgagctgagatgcaccctgagcgacgactgcatccccctgacctggagatgcgacggccaccccgactgccccgacagcagcgacgagctgggctgcggcaccaacgagatcctgcccgagggcgacgccaccaccatgggcccccccgtgaccctggagagcgtgaccagcctgagaaacgccaccaccatgggcccccccgtgaccctggagagcgtgcccagcgtgggcaacgccaccagcagcagcgccggcgaccagagcggcagccccaccgcctacggcgtgatcgccgccgccgccgtgctgagcgccagcctggtgaccgccaccctgctgctgctgagctggctgagagcccaggagagactgagacccctgggcctgctggtggccatgaaggagagcctgctgctgagcgagcagaagaccagcctgccctag

SEQ ID NO: 75934 - DNA, 1095 bp, Artificial Sequence
  Description of Artificial Sequence: Synthetic coding sequence
atgcccctgctgctgctgctgcccctgctgtgggccggcgccctggccatggaccccaacttctggctgcaggtgcaggagagcgtgaccgtgcaggagggcctgtgcgtgctggtgccctgcaccttcttccaccccatcccctactacgacaagaacagccccgtgcacggctactggttcagagagggcgccatcatcagcagagacagccccgtggccaccaacaagctggaccaggaggtgcaggaggagacccagggcagattcagactgctgggcgaccccagcagaaacaactgcagcctgagcatcgtggacgccagaagaagagacaacggcagctacttcttcagaatggagagaggcagcaccaagtacagctacaagagcccccagctgagcgtgcacgtgaccgacctgacccacagacccaagatcctgatccccggcaccctggagcccggccacagcaagaacctgacctgcagcgtgagctgggcctgcgagcagggcaccccccccatcttcagctggctgagcgccgcccccaccagcctgggccccagaaccacccacagcagcgtgctgatcatcacccccagaccccaggaccacggcaccaacctgacctgccaggtgaagttcgccggcgccggcgtgaccaccgagagaaccatccagctgaacgtgacctacgtgccccagaaccccaccaccggcatcttccccggcgacggcagcggcaagcaggagaccagagccggcgtggtgcacggcgccatcggcggcgccggcgtgaccgccctgctggccctgtgcctgtgcctgatcttcttcatcgtgaagacccacagaagaaaggccgccagaaccgccgtgggcagaaacgacacccaccccaccaccggcagcgccagccccaagcaccagaagaagagcaagctgcacggccccaccgagaccagcagctgcagcggcgccgcccccaccgtggagatggacgaggagctgcactacgccagcctgaacttccacggcatgaaccccagcaaggacaccagcaccgagtacagcgaggtgagaacccagtag

SEQ ID NO: 75935 - DNA, 933 bp, Artificial Sequence
  Description of Artificial Sequence: Synthetic coding sequence
atgcccctgctgctgctgctgcccctgctgtgggccggcgccctggccatggaccccaacttctggctgcaggtgcaggagagcgtgaccgtgcaggagggcctgtgcgtgctggtgccctgcaccttcttccaccccatcccctactacgacaagaacagccccgtgcacggctactggttcagagagggcgccatcatcagcagagacagccccgtggccaccaacaagctggaccaggaggtgcaggaggagacccagggcagattcagactgctgggcgaccccagcagaaacaactgcagcctgagcatcgtggacgccagaagaagagacaacggcagctacttcttcagaatggagagaggcagcaccaagtacagctacaagagcccccagctgagcgtgcacgtgaccgacctgacccacagacccaagatcctgatccccggcaccctggagcccggccacagcaagaacctgacctgcagcgtgagctgggcctgcgagcagggcaccccccccatcttcagctggctgagcgccgcccccaccagcctgggccccagaaccacccacagcagcgtgctgatcatcacccccagaccccaggaccacggcaccaacctgacctgccaggtgaagttcgccggcgccggcgtgaccaccgagagaaccatccagctgaacgtgacctacgtgccccagaaccccaccaccggcatcttccccggcgacggcagcggcaagcaggagaccagagccggcgtggtgcacggcgccatcggcggcgccggcgtgaccgccctgctggccctgtgcctgtgcctgatcttcttcatcgtgaagacccacagaagaaaggccgccagaaccgccgtgggcagaaacgacacccaccccaccaccggcagcgccagccccgtgagatag

SEQ ID NO: 75936 - DNA, 714 bp, Artificial Sequence
  Description of Artificial Sequence: Synthetic coding sequence
atgcccctgctgctgctgctgcccctgctgtgggccgacctgacccacagacccaagatcctgatccccggcaccctggagcccggccacagcaagaacctgacctgcagcgtgagctgggcctgcgagcagggcaccccccccatcttcagctggctgagcgccgcccccaccagcctgggccccagaaccacccacagcagcgtgctgatcatcacccccagaccccaggaccacggcaccaacctgacctgccaggtgaagttcgccggcgccggcgtgaccaccgagagaaccatccagctgaacgtgacctacgtgccccagaaccccaccaccggcatcttccccggcgacggcagcggcaagcaggagaccagagccggcgtggtgcacggcgccatcggcggcgccggcgtgaccgccctgctggccctgtgcctgtgcctgatcttcttcatcgtgaagacccacagaagaaaggccgccagaaccgccgtgggcagaaacgacacccaccccaccaccggcagcgccagccccaagcaccagaagaagagcaagctgcacggccccaccgagaccagcagctgcagcggcgccgcccccaccgtggagatggacgaggagctgcactacgccagcctgaacttccacggcatgaaccccagcaaggacaccagcaccgagtacagcgaggtgagaacccagtag

SEQ ID NO: 75937 - DNA, 639 bp, Artificial Sequence
  Description of Artificial Sequence: Synthetic coding sequence
atgcccctgctgctgctgctgcccctgctgtgggccgacctgacccacagacccaagatcctgatccccggcaccctggagcccggccacagcaagaacctgacctgcagcgtgagctgggcctgcgagcagggcaccccccccatcttcagctggctgagcgccgcccccaccagcctgggccccagaaccacccacagcagcgtgctgatcatcacccccagaccccaggaccacggcaccaacctgacctgccaggtgaagttcgccggcgccggcgtgaccaccgagagaaccatccagctgaacgtgacctacgtgccccagaaccccaccaccggcatcttccccggcgacggcagcggcaagcaggagaccagagccggcgtggtgcacggcgccatcggcggcgccggcgtgaccgccctgctggccctgtgcctgtgcctgatcttcttcatcgtgaagacccacagaagaaaggccgccagaaccgccgtgggcagaaacgacacccaccccaccaccggcagcgccagccccgtgagcgacggcgccagctggcaccccgtgtgccccgccgacaccagcagccagtgcggcccccccagctgccccatccagcacttccagaactag

SEQ ID NO: 75938 - DNA, 1419 bp, Artificial Sequence
  Description of Artificial Sequence: Synthetic coding sequence
atgggctgcgacagaaactgcggcctgatcgccggcgccgtgatcggcgccgtgctggccgtgttcggcggcatcctgatgcccgtgggcgacctgctgatccagaagaccatcaagaagcaggtggtgctggaggagggcaccatcgccttcaagaactgggtgaagaccggcaccgaggtgtacagacagttctggatcttcgacgtgcagaacccccaggaggtgatgatgaacagcagcaacatccaggtgaagcagagaggcccctacacctacagagtgagattcctggccaaggagaacgtgacccaggacgccgaggacaacaccgtgagcttcctgcagcccaacggcgccatcttcgagcccagcctgagcgtgggcaccgaggccgacaacttcaccgtgctgaacctggccgtggccgccgccagccacatctaccagaaccagttcgtgcagatgatcctgaacagcctgatcaacaagagcaagagcagcatgttccaggtgagaaccctgagagagctgctgtggggctacagagaccccttcctgagcctggtgccctaccccgtgaccaccaccgtgggcctgttctacccctacaacaacaccgccgacggcgtgtacaaggtgttcaacggcaaggacaacatcagcaaggtggccatcatcgacacctacaagggcaagagaaacctgagctactgggagagccactgcgacatgatcaacggcaccgacgccgccagcttcccccccttcgtggagaagagccaggtgctgcagttcttcagcagcgacatctgcagaagcatctacgccgtgttcgagagcgacgtgaacctgaagggcatccccgtgtacagattcgtgctgcccagcaaggccttcgccagccccgtggagaaccccgacaactactgcttctgcaccgagaagatcatcagcaagaactgcaccagctacggcgtgctggacatcagcaagtgcaaggagggcagacccgtgtacatcagcctgccccacttcctgtacgccagccccgacgtgagcgagcccatcgacggcctgaaccccaacgaggaggagcacagaacctacctggacatcgagcccatcaccggcttcaccctgcagttcgccaagagactgcaggtgaacctgctggtgaagcccagcgagaagatccaggtgctgaagaacctgaagagaaactacatcgtgcccatcctgtggctgaacgagaccggcaccatcggcgacgagaaggccaacatgttcagaagccaggtgaccggcaagatcaacctgctgggcctgatcgagatgatcctgctgagcgtgggcgtggtgatgttcgtggccttcatgatcagctactgcgcctgcagaagcaagaccatcaagtag

SEQ ID NO: 75939 - DNA, 1419 bp, Artificial Sequence; identical to SEQ ID NO: 75938
  Description of Artificial Sequence: Synthetic coding sequence

SEQ ID NO: 75940 - DNA, 612 bp, Artificial Sequence
  Description of Artificial Sequence: Synthetic coding sequence
atgggctgcgacagaaactgcggcctgatcgccggcgccgtgatcggcgccgtgctggccgtgttcggcggcatcctgatgcccgtgggcgacctgctgatccagaagaccatcaagaagcaggtggtgctggaggagggcaccatcgccttcaagaactgggtgaagaccggcaccgaggtgtacagacagttctggatcttcgacgtgcagaacccccaggaggtgatgatgaacagcagcaacatccaggtgaagcagagaggcccctacacctacagagtgagattcctggccaaggagaacgtgacccaggacgccgaggacaacaccgtgagcttcctgcagcccaacggcgccatcttcgagcccagcctgagcgtgggcaccgaggccgacaacttcaccgtgctgaacctggccgtggccgccgccagccacatctaccagaaccagttcgtgcagatgatcctgaacagcctgatcaacaagagcaagagcagcatgttccaggtgagaaccctgagagagctgctgtggggctacagagaccccttcctgagcctggtgccctaccccgtgaccaccaccgtgggcctgttctacccctag

SEQ ID NO: 75941 - DNA, 1392 bp, Artificial Sequence
  Description of Artificial Sequence: Synthetic coding sequence
atgggctgcgacagaaactgcggcctgatcgccggcgccgtgatcggcgccgtgctggccgtgttcggcggcatcctgatgcccgtgggcgacctgctgatccagaagaccatcaagaagcaggtggtgctggaggagggcaccatcgccttcaagaactgggtgaagaccggcaccgaggtgtacagacagttctggatcttcgacgtgcagaacccccaggaggtgatgatgaacagcagcaacatccaggtgaagcagagaggcccctacacctacagagtgagattcctggccaaggagaacgtgacccaggacgccgaggacaacaccgtgagcttcctgcagcccaacggcgccatcttcgagcccagcctgagcgtgggcaccgaggccgacaacttcaccgtgctgaacctggccgtggccgccgccagccacatctaccagaaccagttcgtgcagatgatcctgaacagcctgatcaacaagagcaagagcagcatgttccaggtgagaaccctgagagagctgctgtggggctacagagaccccttcctgagcctggtgccctaccccgtgaccaccaccgtgggcctgttctacccctacaacaacaccgccgacggcgtgtacaaggtgttcaacggcaaggacaacatcagcaaggtggccatcatcgacacctacaagggcaagagaaacctgagctactgggagagccactgcgacatgatcaacggcaccgacgccgccagcttcccccccttcgtggagaagagccaggtgctgcagttcttcagcagcgacatctgcagaagcatctacgccgtgttcgagagcgacgtgaacctgaagggcatccccgtgtacagattcgtgctgcccagcaaggccttcgccagccccgtggagaaccccgacaactactgcttctgcaccgagaagatcatcagcaagaactgcaccagctacggcgtgctggacatcagcaagtgcaaggagggcagacccgtgtacatcagcctgccccacttcctgtacgccagccccgacgtgagcgagcccatcgacggcctgaaccccaacgaggaggagcacagaacctacctggacatcgagcccatcaccggcttcaccctgcagttcgccaagagactgcaggtgaacctgctggtgaagcccagcgagaagatccaggtgctgaagaacctgaagagaaactacatcgtgcccatcctgtggctgaacgagaccggcaccatcggcgacgagaaggccaacatgttcagaagccaggtgaccggcaagatcaacctgctgggcctgatcgagatgatcctgctgagcgtgggcgtggtgatgttcgtggccttcatgatcagctactag

SEQ ID NO: 75942 - DNA, 447 bp, Artificial Sequence
  Description of Artificial Sequence: Synthetic coding sequence
atgggctgcgacagaaactgcggcctgatcgccggcgccgtgatcggcgccgtgctggccgtgttcggcggcatcctgatgcccgtgggcgacctgctgatccagaagaccatcaagaagcaggtggtgctggaggagggcaccatcgccttcaagaactgggtgaagaccggcaccgaggtgtacagacagttctggatcttcgacgtgcagaacccccaggaggtgatgatgaacagcagcaacatccaggtgaagcagagaggcccctacacctacagagtgagattcctggccaaggagaacgtgacccaggacgccgaggacaacaccgtgagcttcctgcagcccaacggcgccatcttcgagcccagcctgagcgtgggcaccgaggccgacaacttcaccgtgctgaacctggccgtggccgccgccagccacatctag

SEQ ID NO: 75943 - DNA, 282 bp, Artificial Sequence
  Description of Artificial Sequence: Synthetic coding sequence
atgggctgcgacagaaactgcggcctgatcgccggcgccgtgatcggcgccgtgctggccgtgttcggcggcatcctgatgcccgtgggcgacctgctgatccagaagaccatcaagaagcaggtggtgctggaggagggcaccatcgccttcaagaactgggtgaagaccggcaccgaggtgtacagacagttctggatcttcgacgtgcagaacccccaggaggtgatgatgaacagcagcaacatccaggtgaagcagagaggcccctacacctactag

SEQ ID NO: 75944 - DNA, 1419 bp, Artificial Sequence; identical to SEQ ID NO: 75938
  Description of Artificial Sequence: Synthetic coding sequence

SEQ ID NO: 75945 - DNA, 1302 bp, Artificial Sequence
  Description of Artificial Sequence: Synthetic coding sequence
atgggctgcgacagaaactgcggcctgatcgccggcgccgtgatcggcgccgtgctggccgtgttcggcggcatcctgatgcccgtgggcgacctgctgatccagaagaccatcaagaagcaggtggtgctggaggagggcaccatcgccttcaagaactgggtgaagaccggcaccgaggtgtacagacagttctggatcttcgacgtgcagaacccccaggaggtgatgatgaacagcagcaacatccaggtgaagcagagaggcccctacacctacagagtgagattcctggccaaggagaacgtgacccaggacgccgaggacaacaccgtgagcttcctgcagcccaacggcgccatcttcgagcccagcctgagcgtgggcaccgaggccgacaacttcaccgtgctgaacctggccgtggccgccgccagccacatctaccagaaccagttcgtgcagatgatcctgaacagcctgatcaacaagagcaagagcagcatgttccaggtgagaaccctgagagagctgctgtggggctacagagaccccttcctgagcctggtgccctaccccgtgaccaccaccgtgggcctgttctacccctacaacaacaccgccgacggcgtgtacaaggtgttcaacggcaaggacaacatcagcaaggtggccatcatcgacacctacaagggcaagagaagcatctacgccgtgttcgagagcgacgtgaacctgaagggcatccccgtgtacagattcgtgctgcccagcaaggccttcgccagccccgtggagaaccccgacaactactgcttctgcaccgagaagatcatcagcaagaactgcaccagctacggcgtgctggacatcagcaagtgcaaggagggcagacccgtgtacatcagcctgccccacttcctgtacgccagccccgacgtgagcgagcccatcgacggcctgaaccccaacgaggaggagcacagaacctacctggacatcgagcccatcaccggcttcaccctgcagttcgccaagagactgcaggtgaacctgctggtgaagcccagcgagaagatccaggtgctgaagaacctgaagagaaactacatcgtgcccatcctgtggctgaacgagaccggcaccatcggcgacgagaaggccaacatgttcagaagccaggtgaccggcaagatcaacctgctgggcctgatcgagatgatcctgctgagcgtgggcgtggtgatgttcgtggccttcatgatcagctactgcgcctgcagaagcaagaccatcaagtag

SEQ ID NO: 75946 - DNA, 1419 bp, Artificial Sequence; identical to SEQ ID NO: 75938
  Description of Artificial Sequence: Synthetic coding sequence

SEQ ID NO: 75947 - DNA, 282 bp, Artificial Sequence; identical to SEQ ID NO: 75943
  Description of Artificial Sequence: Synthetic coding sequence

SEQ ID NO: 75948 - DNA, 432 bp, Artificial Sequence
  Description of Artificial Sequence: Synthetic coding sequence
atgggctgcgacagaaactgcggcctgatcgccggcgccgtgatcggcgccgtgctggccgtgttcggcggcatcctgatgcccgtgggcgacctgctgatccagaagaccatcaagaagcaggtggtgctggaggagggcaccatcgccttcaagaactgggtgaagaccggcaccgaggtgtacagacagttctggatcttcgacgtgcagaacccccaggaggtgatgatgaacagcagcaacatccaggtgaagcagagaggcccctacacctacagagtgagattcctggccaaggagaacgtgacccaggacgccgaggacaacaccgtgagcttcctgcagcccaacggcgccatcttcgagcccagcctgagcgtgggcaccgaggccgacaacttcaccgtgctgaacctggccgtggcctag

SEQ ID NO: 75949 - DNA, 1419 bp, Artificial Sequence; identical to SEQ ID NO: 75938
  Description of Artificial Sequence: Synthetic coding sequence

SEQ ID NO: 75950 - DNA, 198 bp, Artificial Sequence
  Description of Artificial Sequence: Synthetic coding sequence
atgggctgcgacagaaactgcggcctgatcgccggcgccgtgatcggcgccgtgctggccgtgttcggcggcatcctgatgcccgtgggcgacctgctgatccagaagaccatcaagaagcaggtggtgctggaggagggcaccatcgccttcaagaactgggtgaagaccggcaccgaggtgtacagacagttctag

SEQ ID NO: 75951 - DNA, 1191 bp, Artificial Sequence
  Description of Artificial Sequence: Synthetic coding sequence
atgatgaacagcagcaacatccaggtgaagcagagaggcccctacacctacagagtgagattcctggccaaggagaacgtgacccaggacgccgaggacaacaccgtgagcttcctgcagcccaacggcgccatcttcgagcccagcctgagcgtgggcaccgaggccgacaacttcaccgtgctgaacctggccgtggccgccgccagccacatctaccagaaccagttcgtgcagatgatcctgaacagcctgatcaacaagagcaagagcagcatgttccaggtgagaaccctgagagagctgctgtggggctacagagaccccttcctgagcctggtgccctaccccgtgaccaccaccgtgggcctgttctacccctacaacaacaccgccgacggcgtgtacaaggtgttcaacggcaaggacaacatcagcaaggtggccatcatcgacacctacaagggcaagagaaacctgagctactgggagagccactgcgacatgatcaacggcaccgacgccgccagcttcccccccttcgtggagaagagccaggtgctgcagttcttcagcagcgacatctgcagaagcatctacgccgtgttcgagagcgacgtgaacctgaagggcatccccgtgtacagattcgtgctgcccagcaaggccttcgccagccccgtggagaaccccgacaactactgcttctgcaccgagaagatcatcagcaagaactgcaccagctacggcgtgctggacatcagcaagtgcaaggagggcagacccgtgtacatcagcctgccccacttcctgtacgccagccccgacgtgagcgagcccatcgacggcctgaaccccaacgaggaggagcacagaacctacctggacatcgagcccatcaccggcttcaccctgcagttcgccaagagactgcaggtgaacctgctggtgaagcccagcgagaagatccaggtgctgaagaacctgaagagaaactacatcgtgcccatcctgtggctgaacgagaccggcaccatcggcgacgagaaggccaacatgttcagaagccaggtgaccggcaagatcaacctgctgggcctgatcgagatgatcctgctgagcgtgggcgtggtgatgttcgtggccttcatgatcagctactgcgcctgcagaagcaagaccatcaagtag

SEQ ID NO: 75952 - DNA, 1239 bp, Artificial Sequence
  Description of Artificial Sequence: Synthetic coding sequence
atgggctgcgacagaaactgcggcctgatcgccggcgccgtgatcggcgccgtgctggccgtgttcggcggcatcctgatgcccgtgggcgacctgctgatccagaagaccatcaagaagcaggtggtgctggaggagggcaccatcgccttcaagaactgggtgaagaccggcaccgaggtgtacagacagttctggatcttcgacgtgcagaacccccaggaggtgatgatgaacagcagcaacatccaggtgaagcagagaggcccctacacctacagagtgagattcctggccaaggagaacgtgacccaggacgccgaggacaacaccgtgagcttcctgcagcccaacggcgccatcttcgagcccagcctgagcgtgggcaccgaggccgacaacttcaccgtgctgaacctggccgtggcctacaacaacaccgccgacggcgtgtacaaggtgttcaacggcaaggacaacatcagcaaggtggccatcatcgacacctacaagggcaagagaaacctgagctactgggagagccactgcgacatgatcaacggcaccgacgccgccagcttcccccccttcgtggagaagagccaggtgctgcagttcttcagcagcgacatctgcagaagcatctacgccgtgttcgagagcgacgtgaacctgaagggcatccccgtgtacagattcgtgctgcccagcaaggccttcgccagccccgtggagaaccccgacaactactgcttctgcaccgagaagatcatcagcaagaactgcaccagctacggcgtgctggacatcagcaagtgcaaggagggcagacccgtgtacatcagcctgccccacttcctgtacgccagccccgacgtgagcgagcccatcgacggcctgaaccccaacgaggaggagcacagaacctacctggacatcgagcccatcaccggcttcaccctgcagttcgccaagagactgcaggtgaacctgctggtgaagcccagcgagaagatccaggtgctgaagaacctgaagagaaactacatcgtgcccatcctgtggctgaacgagaccggcaccatcggcgacgagaaggccaacatgttcagaagccaggtgaccggcaagatcaacctgctgggcctgatcgagatgatcctgctgagcgtgggcgtggtgatgttcgtggccttcatgatcagctactgcgcctgcagaagcaagaccatcaagtag

SEQ ID NO: 75953 - DNA, 867 bp, Artificial Sequence
  Description of Artificial Sequence: Synthetic coding sequence
atgggctgcgacagaaactgcggcctgatcgccggcgccgtgatcggcgccgtgctggccgtgttcggcggcatcctgatgcccgtgggcgacctgctgatccagaagaccatcaagaagcaggtggtgctggaggagggcaccatcgccttcaagaactgggtgaagaccggcaccgaggtgtacagacagttctggatcttcgacgtgcagaacccccaggaggtgatgatgaacagcagcaacatccaggtgaagcagagaggcccctacacctacagagtgagattcctggccaaggagaacgtgacccaggacgccgaggacaacaccgtgagcttcctgcagcccaacggcgccatcttcgagcccagcctgagcgtgggcaccgaggccgacaacttcaccgtgctgaacctggccgtggccgccgccagccacatctaccagaaccagttcgtgcagatgatcctgaacagcctgatcaacaagagcaagagcagcatgttccaggtgagaaccctgagagagctgctgtggggctacagagaccccttcctgagcctggtgccctaccccgtgaccaccaccgtgggcctgttctacccctacaacaacaccgccgacggcgtgtacaaggtgttcaacggcaaggacaacatcagcaaggtggccatcatcgacacctacaagggcaagagaaacctgagctactgggagagccactgcgacatgatcaacggcaccgacgccgccagcttcccccccttcgtggagaagagccaggtgctgcagttcttcagcagcgacatctgcagagagacctgcgtgcacttcaccagcagcttcagcgtgtgcaagagctag

SEQ ID NO: 75954 - DNA, 846 bp, Artificial Sequence
  Description of Artificial Sequence: Synthetic coding sequence
atgagcgcccaggagagctgcctgagcctgatcaagtacttcctgttcgtgttcaacctgttcttcttcgtgctgggcagcctgatcttctgcttcggcatctggatcctgatcgacaagaccagcttcgtgagcttcgtgggcctggccttcgtgcccctgcagatctggagcaaggtgctggccatcagcggcatcttcaccatgggcatcgccctgctgggctgcgtgggcgccctgaaggagctgagatgcctgctgggcctgtacttcggcatgctgctgctgctgttcgccacccagatcaccctgggcatcctgatcagcacccagagagcccagctggagagaagcctgagagacgtggtggagaagaccatccagaagtacggcaccaaccccgaggagaccgccgccgaggagagctgggactacgtgcagttccagctgagatgctgcggctggcactacccccaggactggttccaggtgctgatcctgagaggcaacggcagcgaggcccacagagtgccctgcagctgctacaacctgagcgccaccaacgacagcaccatcctggacaaggtgatcctgccccagctgagcagactgggccacctggccagaagcagacacagcgccgacatctgcgccgtgcccgccgagagccacatctacagagagggctgcgcccagggcctgcagaagtggctgcacaacaacctgatcagcatcgtgggcatctgcctgggcgtgggcctgctggagctgggcttcatgaccctgagcatcttcctgtgcagaaacctggaccacgtgtacaacagactggccagatacagatag

SEQ ID NO: 75955 - DNA, 471 bp, Artificial Sequence
  Description of Artificial Sequence: Synthetic coding sequence
atgagcgcccaggagagctgcctgagcctgatcaagtacttcctgttcgtgttcaacctgttcttcttcgtgctgggcagcctgatcttctgcttcggcatctggatcctgatcgacaagaccagcttcgtgagcttcgtgggcctggccttcgtgcccctgcagatctggagcaaggtgctggccatcagcggcatcttcaccatgggcatcgccctgctgggctgcgtgggcgccctgaaggagctgagatgcctgctgggcctgtacttcggcatgctgctgctgctgttcgccacccagatcaccctgggcatcctgatcagcacccagagagcccagaaggacacccccacctggaccaagggcgacagacacaagcagctgcagagagagacccacggcaagaagagagagcaggagaaggagatcgacgccctgaaggaggagaccgagacctacgagccctag

SEQ ID NO: 75956 - DNA, 642 bp, Artificial Sequence
  Description of Artificial Sequence: Synthetic coding sequence
atgggcatcgccctgctgggctgcgtgggcgccctgaaggagctgagatgcctgctgggcctgtacttcggcatgctgctgctgctgttcgccacccagatcaccctgggcatcctgatcagcacccagagagcccagctggagagaagcctgagagacgtggtggagaagaccatccagaagtacggcaccaaccccgaggagaccgccgccgaggagagctgggactacgtgcagttccagctgagatgctgcggctggcactacccccaggactggttccaggtgctgatcctgagaggcaacggcagcgaggcccacagagtgccctgcagctgctacaacctgagcgccaccaacgacagcaccatcctggacaaggtgatcctgccccagctgagcagactgggccacctggccagaagcagacacagcgccgacatctgcgccgtgcccgccgagagccacatctacagagagggctgcgcccagggcctgcagaagtggctgcacaacaacctgatcagcatcgtgggcatctgcctgggcgtgggcctgctggagctgggcttcatgaccctgagcatcttcctgtgcagaaacctggaccacgtgtacaacagactggccagatacagatag

SEQ ID NO: 75957 - DNA, 813 bp, Artificial Sequence
  Description of Artificial Sequence: Synthetic coding sequence
atgagcgcccaggagagctgcctgagcctgatcaagtacttcctgttcgtgttcaacctgttcttcttcgtgctgggcagcctgatcttctgcttcggcatctggatcctgatcgacaagaccagcttcgtgagcttcgtgggcctggccttcgtgcccctgcagatctggagcaaggtgctggccatcagcggcatcttcaccatgggcatcgccctgctgggctgcgtgggcgccctgaaggagctgagatgcctgctgggcctgtacttcggcatgctgctgctgctgttcgccacccagatcaccctgggcatcctgatcagcacccagagagcccagctggagagaagcctgagagacgtggtggagaagaccatccagaagtacggcaccaaccccgaggagaccgccgccgaggagagctgggactacgtgcagttccagctgagatgctgcggctggcactacccccaggactggttccaggtgctgatcctgagaggcaacggcagcgaggcccacagagtgccctgcagctgctacaacctgagcgccaccaacgacagcaccatcctggacaaggtgatcctgccccagctgagcagactgggccacctggccagaagcagacacagcgccgacatctgcgccgtgcccgccgagagccacatctacagagagggctgcgcccagggcctgcagaagtggctgcacaacaacctgatcagcatcgtgggcatctgcctgggcgtgggcctgctggaggtgatctggcccagaccccaccccagaagcgccctgaacccctag

SEQ ID NO: 75958 - DNA, 1095 bp, Artificial Sequence; identical to SEQ ID NO: 72478
  Description of Artificial Sequence: Synthetic coding sequence

SEQ ID NO: 75959 - DNA, 483 bp, Artificial Sequence
  Description of Artificial Sequence: Synthetic coding sequence
atggccaactgcgagttcagccccgtgagcggcgacaagccctgctgcagactgagcagaagagcccagctgtgcctgggcgtgagcatcctggtgctgatcctggtggtggtgctggccgtggtggtgcccagatggagacagcagtggagcggccccggcaccaccaagagattccccgagaccgtgctggccagatgcgtgaagtacaccgagatccaccccgagatgagacacgtggactgccagagcgtgtgggacgccttcaagggcgccttcatcagcaagcacccctgcaacatcaccgaggaggactaccagcccctgatgaagctgggcacccagaccgtgccctgcaacaagaacgagaccatcaacctggcccagaccggcgagagaaccgccgccaccaccctgttccagtacagcggcaagagattccccgccggcctgcagaagctgcccgtgatgtggagcatgtag

SEQ ID NO: 75960 - DNA, 624 bp, Artificial Sequence
  Description of Artificial Sequence: Synthetic coding sequence
atgcagagcggcacccactggagagtgctgggcctgtgcctgctgagcgtgggcgtgtggggccaggacggcaacgaggagatgggcggcatcacccagaccccctacaaggtgagcatcagcggcaccaccgtgatcctgacctgcccccagtaccccggcagcgagatcctgtggcagcacaacgacaagaacatcggcggcgacgaggacgacaagaacatcggcagcgacgaggaccacctgagcctgaaggagttcagcgagctggagcagagcggctactacgtgtgctaccccagaggcagcaagcccgaggacgccaacttctacctgtacctgagagccagagtgtgcgagaactgcatggagatggacgtgatgagcgtggccaccatcgtgatcgtggacatctgcatcaccggcggcctgctgctgctggtgtactactggagcaagaacagaaaggccaaggccaagcccgtgaccagaggcgccggcgccggcggcagacagagaggccagaacaaggagagacccccccccgtgcccaaccccgactacgagcccatcagaaagggccagagagacctgtacagcggcctgaaccagagaagaatctag

SEQ ID NO: 75961 - DNA, 606 bp, Artificial Sequence
  Description of Artificial Sequence: Synthetic coding sequence
atgcagagcggcacccactggagagtgctgggcctgtgcctgctgagcgtgggcgtgtggggccaggacggcaacgaggagatggcctacaaggtgagcatcagcggcaccaccgtgatcctgacctgcccccagtaccccggcagcgagatcctgtggcagcacaacgacaagaacatcggcggcgacgaggacgacaagaacatcggcagcgacgaggaccacctgagcctgaaggagttcagcgagctggagcagagcggctactacgtgtgctaccccagaggcagcaagcccgaggacgccaacttctacctgtacctgagagccagagtgtgcgagaactgcatggagatggacgtgatgagcgtggccaccatcgtgatcgtggacatctgcatcaccggcggcctgctgctgctggtgtactactggagcaagaacagaaaggccaaggccaagcccgtgaccagaggcgccggcgccggcggcagacagagaggccagaacaaggagagacccccccccgtgcccaaccccgactacgagcccatcagaaagggccagagagacctgtacagcggcctgaaccagagaagaatctag

SEQ ID NO: 75962 - DNA, 237 bp, Artificial Sequence
  Description of Artificial Sequence: Synthetic coding sequence
atgatcggcttcctgaccgaggacaagaagaagtggaacctgggcagcaacgccaaggaccccagaggcatgtaccagtgcaagggcagccagaacaagagcaagcccctgcaggtgtactacagaaccagcgacaagcagaccctgctgcccaacgaccagctgtaccagcccctgaaggacagagaggacgaccagtacagccacctgcagggcaaccagctgagaagaaactag

SEQ ID NO: 75963 - DNA, 549 bp, Artificial Sequence
  Description of Artificial Sequence: Synthetic coding sequence
atggagcagggcaagggcctggccgtgctgatcctggccatcatcctgctgcagggcaccctggcccagagcatcaagggcaaccacctggtgaaggtgtacgactaccaggaggacggcagcgtgctgctgacctgcgacgccgaggccaagaacatcacctggttcaaggacggcaagatgatcggcttcctgaccgaggacaagaagaagtggaacctgggcagcaacgccaaggaccccagaggcatgtaccagtgcaagggcagccagaacaagagcaagcccctgcaggtgtactacagaatgtgccagaactgcatcgagctgaacgccgccaccatcagcggcttcctgttcgccgagatcgtgagcatcttcgtgctggccgtgggcgtgtacttcatcgccggccaggacggcgtgagacagagcagagccagcgacaagcagaccctgctgcccaacgaccagctgtaccagcccctgaaggacagagaggacgaccagtacagccacctgcagggcaaccagctgagaagaaactag

SEQ ID NO: 75964 - DNA, 1200 bp, Artificial Sequence
  Description of Artificial Sequence: Synthetic coding sequence
atggagccccccggcagaagagagtgccccttccccagctggagattccccggcctgctgctggccgccatggtgctgctgctgtacagcttcagcgacgcctgcgaggagccccccaccttcgaggccatggagctgatcggcaagcccaagccctactacgagatcggcgagagagtggactacaagtgcaagaagggctacttctacatcccccccctggccacccacaccatctgcgacagaaaccacacctggctgcccgtgagcgacgacgcctgctacagagagacctgcccctacatcagagaccccctgaacggccaggccgtgcccgccaacggcacctacgagttcggctaccagatgcacttcatctgcaacgagggctactacctgatcggcgaggagatcctgtactgcgagctgaagggcagcgtggccatctggagcggcaagccccccatctgcgagaaggtgctgtgcacccccccccccaagatcaagaacggcaagcacaccttcagcgaggtggaggtgttcgagtacctggacgccgtgacctacagctgcgaccccgcccccggccccgaccccttcagcctgatcggcgagagcaccatctactgcggcgacaacagcgtgtggagcagagccgcccccgagtgcaaggtggtgaagtgcagattccccgtggtggagaacggcaagcagatcagcggcttcggcaagaagttctactacaaggccaccgtgatgttcgagtgcgacaagggcttctacctggacggcagcgacaccatcgtgtgcgacagcaacagcacctgggacccccccgtgcccaagtgcctgaaggtgctgccccccagcagcaccaagccccccgccctgagccacagcgtgagcaccagcagcaccaccaagagccccgccagcagcgccagcggccccagacccacctacaagccccccgtgagcaactaccccggctaccccaagcccgaggagggcatcctggacagcctggacgtgtgggtgatcgccgtgatcgtgatcgccatcgtggtgggcgtggccgtgatctgcgtggtgccctacagatacctgcagagaagaaagaagaagggcaaggccgacggcggcgccgagtacgccacctaccagaccaagagcaccacccccgccgagcagagaggctag

SEQ ID NO: 75965 - DNA, 1050 bp, Artificial Sequence
  Description of Artificial Sequence: Synthetic coding sequence
atggagccccccggcagaagagagtgccccttccccagctggagattccccggcctgctgctggccgccatggtgctgctgctgtacagcttcagcgacgcctgcgaggagccccccaccttcgaggccatggagctgatcggcaagcccaagccctactacgagatcggcgagagagtggactacaagtgcaagaagggctacttctacatcccccccctggccacccacaccatctgcgacagaaaccacacctggctgcccgtgagcgacgacgcctgctacagagagacctgcccctacatcagagaccccctgaacggccaggccgtgcccgccaacggcacctacgagttcggctaccagatgcacttcatctgcaacgagggctactacctgatcggcgaggagatcctgtactgcgagctgaagggcagcgtggccatctggagcggcaagccccccatctgcgagaaggtgctgtgcacccccccccccaagatcaagaacggcaagcacaccttcagcgaggtggaggtgttcgagtacctggacgccgtgacctacagctgcgaccccgcccccggccccgaccccttcagcctgatcggcgagagcaccatctactgcggcgacaacagcgtgtggagcagagccgcccccgagtgcaaggtggtgaagtgcagattccccgtggtggagaacggcaagcagatcagcggcttcggcaagaagttctactacaaggccaccgtgatgttcgagtgcgacaagggcttctacctggacggcagcgacaccatcgtgtgcgacagcaacagcacctgggacccccccgtgcccaagtgcctgaagggccccagacccacctacaagccccccgtgagcaactaccccggctaccccaagcccgaggagggcatcctggacagcctggacgtgtgggtgatcgccgtgatcgtgatcgccatcggcaagcagatggtggagctgaacatgcccctgaccagactgaaccagcccctgcagcagagcagagaggccgagtag

SEQ ID NO: 75966 - DNA, 1155 bp, Artificial Sequence
  Description of Artificial Sequence: Synthetic coding sequence
atggagccccccggcagaagagagtgccccttccccagctggagattccccggcctgctgctggccgccatggtgctgctgctgtacagcttcagcgacgcctgcgaggagccccccaccttcgaggccatggagctgatcggcaagcccaagccctactacgagatcggcgagagagtggactacaagtgcaagaagggctacttctacatcccccccctggccacccacaccatctgcgacagaaaccacacctggctgcccgtgagcgacgacgcctgctacagagagacctgcccctacatcagagaccccctgaacggccaggccgtgcccgccaacggcacctacgagttcggctaccagatgcacttcatctgcaacgagggctactacctgatcggcgaggagatcctgtactgcgagctgaagggcagcgtggccatctggagcggcaagccccccatctgcgagaaggtgctgtgcacccccccccccaagatcaagaacggcaagcacaccttcagcgaggtggaggtgttcgagtacctggacgccgtgacctacagctgcgaccccgcccccggccccgaccccttcagcctgatcggcgagagcaccatctactgcggcgacaacagcgtgtggagcagagccgcccccgagtgcaaggtggtgaagtgcagattccccgtggtggagaacggcaagcagatcagcggcttcggcaagaagttctactacaaggccaccgtgatgttcgagtgcgacaagggcttctacctggacggcagcgacaccatcgtgtgcgacagcaacagcacctgggacccccccgtgcccaagtgcctgaaggtgagcaccagcagcaccaccaagagccccgccagcagcgccagcggccccagacccacctacaagccccccgtgagcaactaccccggctaccccaagcccgaggagggcatcctggacagcctggacgtgtgggtgatcgccgtgatcgtgatcgccatcgtggtgggcgtggccgtgatctgcgtggtgccctacagatacctgcagagaagaaagaagaagggcaaggccgacggcggcgccgagtacgccacctaccagaccaagagcaccacccccgccgagcagagaggctag

SEQ ID NO: 75967 - DNA, 1110 bp, Artificial Sequence
  Description of Artificial Sequence: Synthetic coding sequence
atggagccccccggcagaagagagtgccccttccccagctggagattccccggcctgctgctggccgccatggtgctgctgctgtacagcttcagcgacgcctgcgaggagccccccaccttcgaggccatggagctgatcggcaagcccaagccctactacgagatcggcgagagagtggactacaagtgcaagaagggctacttctacatcccccccctggccacccacaccatctgcgacagaaaccacacctggctgcccgtgagcgacgacgcctgctacagagagacctgcccctacatcagagaccccctgaacggccaggccgtgcccgccaacggcacctacgagttcggctaccagatgcacttcatctgcaacgagggctactacctgatcggcgaggagatcctgtactgcgagctgaagggcagcgtggccatctggagcggcaagccccccatctgcgagaaggtgctgtgcacccccccccccaagatcaagaacggcaagcacaccttcagcgaggtggaggtgttcgagtacctggacgccgtgacctacagctgcgaccccgcccccggccccgaccccttcagcctgatcggcgagagcaccatctactgcggcgacaacagcgtgtggagcagagccgcccccgagtgcaaggtggtgaagtgcagattccccgtggtggagaacggcaagcagatcagcggcttcggcaagaagttctactacaaggccaccgtgatgttcgagtgcgacaagggcttctacctggacggcagcgacaccatcgtgtgcgacagcaacagcacctgggacccccccgtgcccaagtgcctgaagggccccagacccacctacaagccccccgtgagcaactaccccggctaccccaagcccgaggagggcatcctggacagcctggacgtgtgggtgatcgccgtgatcgtgatcgccatcgtggtgggcgtggccgtgatctgcgtggtgccctacagatacctgcagagaagaaagaagaagggcaaggccgacggcggcgccgagtacgccacctaccagaccaagagcaccacccccgccgagcagagaggctag

SEQ ID NO: 75968 - DNA, 1179 bp, Artificial Sequence
  Description of Artificial Sequence: Synthetic coding sequence
atggagccccccggcagaagagagtgccccttccccagctggagattccccggcctgctgctggccgccatggtgctgctgctgtacagcttcagcgacgcctgcgaggagccccccaccttcgaggccatggagctgatcggcaagcccaagccctactacgagatcggcgagagagtggactacaagtgcaagaagggctacttctacatcccccccctggccacccacaccatctgcgacagaaaccacacctggctgcccgtgagcgacgacgcctgctacagagagacctgcccctacatcagagaccccctgaacggccaggccgtgcccgccaacggcacctacgagttcggctaccagatgcacttcatctgcaacgagggctactacctgatcggcgaggagatcctgtactgcgagctgaagggcagcgtggccatctggagcggcaagccccccatctgcgagaaggtgctgtgcacccccccccccaagatcaagaacggcaagcacaccttcagcgaggtggaggtgttcgagtacctggacgccgtgacctacagctgcgaccccgcccccggccccgaccccttcagcctgatcggcgagagcaccatctactgcggcgacaacagcgtgtggagcagagccgcccccgagtgcaaggtggtgaagtgcagattccccgtggtggagaacggcaagcagatcagcggcttcggcaagaagttctactacaaggccaccgtgatgttcgagtgcgacaagggcttctacctggacggcagcgacaccatcgtgtgcgacagcaacagcacctgggacccccccgtgcccaagtgcctgaaggtgctgccccccagcagcaccaagccccccgccctgagccacagcgtgagcaccagcagcaccaccaagagccccgccagcagcgccagcggccccagacccacctacaagccccccgtgagcaactaccccggctaccccaagcccgaggagggcatcctggacagcctggacgtgtgggtgatcgccgtgatcgtgatcgccatcgtggtgggcgtggccgtgatctgcgtggtgccctacagatacctgcagagaagaaagaagaagggcacctacctgaccgacgagacccacagagaggtgaagttcaccagcctgtag

SEQ ID NO: 75969 - DNA, 1068 bp, Artificial Sequence
  Description of Artificial Sequence: Synthetic coding sequence
atggagccccccggcagaagagagtgccccttccccagctggagattccccggcctgctgctggccgccatggtgctgctgctgtacagcttcagcgacgcctgcgaggagccccccaccttcgaggccatggagctgatcggcaagcccaagccctactacgagatcggcgagagagtggactacaagtgcaagaagggctacttctacatcccccccctggccacccacaccatctgcgacagaaaccacacctggctgcccgtgagcgacgacgcctgctacagagagacctgcccctacatcagagaccccctgaacggccaggccgtgcccgccaacggcacctacgagttcggctaccagatgcacttcatctgcaacgagggctactacctgatcggcgaggagatcctgtactgcgagctgaagggcagcgtggccatctggagcggcaagccccccatctgcgagaaggtgctgtgcacccccccccccaagatcaagaacggcaagcacaccttcagcgaggtggaggtgttcgagtacctggacgccgtgacctacagctgcgaccccgcccccggccccgaccccttcagcctgatcggcgagagcaccatctactgcggcgacaacagcgtgtggagcagagccgcccccgagtgcaaggtggtgaagtgcagattccccgtggtggagaacggcaagcagatcagcggcttcggcaagaagttctactacaaggccaccgtgatgttcgagtgcgacaagggcttctacctggacggcagcgacaccatcgtgtgcgacagcaacagcacctgggacccccccgtgcccaagtgcctgaagggctaccccaagcccgaggagggcatcctggacagcctggacgtgtgggtgatcgccgtgatcgtgatcgccatcgtggtgggcgtggccgtgatctgcgtggtgccctacagatacctgcagagaagaaagaagaagggcaaggccgacggcggcgccgagtacgccacctaccagaccaagagcaccacccccgccgagcagagaggctag

SEQ ID NO: 75970 - DNA, 1158 bp, Artificial Sequence
  Description of Artificial Sequence: Synthetic coding sequence
atggagccccccggcagaagagagtgccccttccccagctggagattccccggcctgctgctggccgccatggtgctgctgctgtacagcttcagcgacgcctgcgaggagccccccaccttcgaggccatggagctgatcggcaagcccaagccctactacgagatcggcgagagagtggactacaagtgcaagaagggctacttctacatcccccccctggccacccacaccatctgcgacagaaaccacacctggctgcccgtgagcgacgacgcctgctacagagagacctgcccctacatcagagaccccctgaacggccaggccgtgcccgccaacggcacctacgagttcggctaccagatgcacttcatctgcaacgagggctactacctgatcggcgaggagatcctgtactgcgagctgaagggcagcgtggccatctggagcggcaagccccccatctgcgagaaggtgctgtgcacccccccccccaagatcaagaacggcaagcacaccttcagcgaggtggaggtgttcgagtacctggacgccgtgacctacagctgcgaccccgcccccggccccgaccccttcagcctgatcggcgagagcaccatctactgcggcgacaacagcgtgtggagcagagccgcccccgagtgcaaggtggtgaagtgcagattccccgtggtggagaacggcaagcagatcagcggcttcggcaagaagttctactacaaggccaccgtgatgttcgagtgcgacaagggcttctacctggacggcagcgacaccatcgtgtgcgacagcaacagcacctgggacccccccgtgcccaagtgcctgaaggtgctgccccccagcagcaccaagccccccgccctgagccacagcgtgagcaccagcagcaccaccaagagccccgccagcagcgccagcggctaccccaagcccgaggagggcatcctggacagcctggacgtgtgggtgatcgccgtgatcgtgatcgccatcgtggtgggcgtggccgtgatctgcgtggtgccctacagatacctgcagagaagaaagaagaagggcaaggccgacggcggcgccgagtacgccacctaccagaccaagagcaccacccccgccgagcagagaggctag

SEQ ID NO: 75971 - DNA, 1089 bp, Artificial Sequence
  Description of Artificial Sequence: Synthetic coding sequence
atggagccccccggcagaagagagtgccccttccccagctggagattccccggcctgctgctggccgccatggtgctgctgctgtacagcttcagcgacgcctgcgaggagccccccaccttcgaggccatggagctgatcggcaagcccaagccctactacgagatcggcgagagagtggactacaagtgcaagaagggctacttctacatcccccccctggccacccacaccatctgcgacagaaaccacacctggctgcccgtgagcgacgacgcctgctacagagagacctgcccctacatcagagaccccctgaacggccaggccgtgcccgccaacggcacctacgagttcggctaccagatgcacttcatctgcaacgagggctactacctgatcggcgaggagatcctgtactgcgagctgaagggcagcgtggccatctggagcggcaagccccccatctgcgagaaggtgctgtgcacccccccccccaagatcaagaacggcaagcacaccttcagcgaggtggaggtgttcgagtacctggacgccgtgacctacagctgcgaccccgcccccggccccgaccccttcagcctgatcggcgagagcaccatctactgcggcgacaacagcgtgtggagcagagccgcccccgagtgcaaggtggtgaagtgcagattccccgtggtggagaacggcaagcagatcagcggcttcggcaagaagttctactacaaggccaccgtgatgttcgagtgcgacaagggcttctacctggacggcagcgacaccatcgtgtgcgacagcaacagcacctgggacccccccgtgcccaagtgcctgaagggccccagacccacctacaagccccccgtgagcaactaccccggctaccccaagcccgaggagggcatcctggacagcctggacgtgtgggtgatcgccgtgatcgtgatcgccatcgtggtgggcgtggccgtgatctgcgtggtgccctacagatacctgcagagaagaaagaagaagggcacctacctgaccgacgagacccacagagaggtgaagttcaccagcctgtag

SEQ ID NO: 75972 - DNA, 1134 bp, Artificial Sequence
  Description of Artificial Sequence: Synthetic coding sequence
atggagccccccggcagaagagagtgccccttccccagctggagattccccggcctgctgctggccgccatggtgctgctgctgtacagcttcagcgacgcctgcgaggagccccccaccttcgaggccatggagctgatcggcaagcccaagccctactacgagatcggcgagagagtggactacaagtgcaagaagggctacttctacatcccccccctggccacccacaccatctgcgacagaaaccacacctggctgcccgtgagcgacgacgcctgctacagagagacctgcccctacatcagagaccccctgaacggccaggccgtgcccgccaacggcacctacgagttcggctaccagatgcacttcatctgcaacgagggctactacctgatcggcgaggagatcctgtactgcgagctgaagggcagcgtggccatctggagcggcaagccccccatctgcgagaaggtgctgtgcacccccccccccaagatcaagaacggcaagcacaccttcagcgaggtggaggtgttcgagtacctggacgccgtgacctacagctgcgaccccgcccccggccccgaccccttcagcctgatcggcgagagcaccatctactgcggcgacaacagcgtgtggagcagagccgcccccgagtgcaaggtggtgaagtgcagattccccgtggtggagaacggcaagcagatcagcggcttcggcaagaagttctactacaaggccaccgtgatgttcgagtgcgacaagggcttctacctggacggcagcgacaccatcgtgtgcgacagcaacagcacctgggacccccccgtgcccaagtgcctgaaggtgagcaccagcagcaccaccaagagccccgccagcagcgccagcggccccagacccacctacaagccccccgtgagcaactaccccggctaccccaagcccgaggagggcatcctggacagcctggacgtgtgggtgatcgccgtgatcgtgatcgccatcgtggtgggcgtggccgtgatctgcgtggtgccctacagatacctgcagagaagaaagaagaagggcacctacctgaccgacgagacccacagagaggtgaagttcaccagcctgtag

SEQ ID NO: 75973 - DNA, 1011 bp, Artificial Sequence
  Description of Artificial Sequence: Synthetic coding sequence
atggagccccccggcagaagagagtgccccttccccagctggagattccccggcctgctgctggccgccatggtgctgctgctgtacagcttcagcggcgagacctgcccctacatcagagaccccctgaacggccaggccgtgcccgccaacggcacctacgagttcggctaccagatgcacttcatctgcaacgagggctactacctgatcggcgaggagatcctgtactgcgagctgaagggcagcgtggccatctggagcggcaagccccccatctgcgagaaggtgctgtgcacccccccccccaagatcaagaacggcaagcacaccttcagcgaggtggaggtgttcgagtacctggacgccgtgacctacagctgcgaccccgcccccggccccgaccccttcagcctgatcggcgagagcaccatctactgcggcgacaacagcgtgtggagcagagccgcccccgagtgcaaggtggtgaagtgcagattccccgtggtggagaacggcaagcagatcagcggcttcggcaagaagttctactacaaggccaccgtgatgttcgagtgcgacaagggcttctacctggacggcagcgacaccatcgtgtgcgacagcaacagcacctgggacccccccgtgcccaagtgcctgaaggtgctgccccccagcagcaccaagccccccgccctgagccacagcgtgagcaccagcagcaccaccaagagccccgccagcagcgccagcggccccagacccacctacaagccccccgtgagcaactaccccggctaccccaagcccgaggagggcatcctggacagcctggacgtgtgggtgatcgccgtgatcgtgatcgccatcgtggtgggcgtggccgtgatctgcgtggtgccctacagatacctgcagagaagaaagaagaagggcaaggccgacggcggcgccgagtacgccacctaccagaccaagagcaccacccccgccgagcagagaggctag

SEQ ID NO: 75974 - DNA, 1095 bp, Artificial Sequence
  Description of Artificial Sequence: Synthetic coding sequence
atggagccccccggcagaagagagtgccccttccccagctggagattccccggcctgctgctggccgccatggtgctgctgctgtacagcttcagcgacgcctgcgaggagccccccaccttcgaggccatggagctgatcggcaagcccaagccctactacgagatcggcgagagagtggactacaagtgcaagaagggctacttctacatcccccccctggccacccacaccatctgcgacagaaaccacacctggctgcccgtgagcgacgacgcctgctacagagagacctgcccctacatcagagaccccctgaacggccaggccgtgcccgccaacggcacctacgagttcggctaccagatgcacttcatctgcaacgagggctactacctgatcggcgaggagatcctgtactgcgagctgaagggcagcgtggccatctggagcggcaagccccccatctgcgagaaggtgctgtgcacccccccccccaagatcaagaacggcaagcacaccttcagcgaggtggaggtgttcgagtacctggacgccgtgacctacagctgcgaccccgcccccggccccgaccccttcagcctgatcggcgagagcaccatctactgcggcgacaacagcgtgtggagcagagccgcccccgagtgcaaggtggtgaagtgcagattccccgtggtggagaacggcaagcagatcagcggcttcggcaagaagttctactacaaggccaccgtgatgttcgagtgcgacaagggcttctacctggacggcagcgacaccatcgtgtgcgacagcaacagcacctgggacccccccgtgcccaagtgcctgaaggtgagcaccagcagcaccaccaagagccccgccagcagcgccagcggccccagacccacctacaagccccccgtgagcaactaccccggctaccccaagcccgaggagggcatcctggacagcctggacgtgtgggtgatcgccgtgatcgtgatcgccatcggcaagcagatggtggagctgaacatgcccctgaccagactgaaccagcccctgcagcagagcagagaggccgagtag

SEQ ID NO: 75975 - DNA, 1113 bp, Artificial Sequence
  Description of Artificial Sequence: Synthetic coding sequence
atggagccccccggcagaagagagtgccccttccccagctggagattccccggcctgctgctggccgccatggtgctgctgctgtacagcttcagcgacgcctgcgaggagccccccaccttcgaggccatggagctgatcggcaagcccaagccctactacgagatcggcgagagagtggactacaagtgcaagaagggctacttctacatcccccccctggccacccacaccatctgcgacagaaaccacacctggctgcccgtgagcgacgacgcctgctacagagagacctgcccctacatcagagaccccctgaacggccaggccgtgcccgccaacggcacctacgagttcggctaccagatgcacttcatctgcaacgagggctactacctgatcggcgaggagatcctgtactgcgagctgaagggcagcgtggccatctggagcggcaagccccccatctgcgagaaggtgctgtgcacccccccccccaagatcaagaacggcaagcacaccttcagcgaggtggaggtgttcgagtacctggacgccgtgacctacagctgcgaccccgcccccggccccgaccccttcagcctgatcggcgagagcaccatctactgcggcgacaacagcgtgtggagcagagccgcccccgagtgcaaggtggtgaagtgcagattccccgtggtggagaacggcaagcagatcagcggcttcggcaagaagttctactacaaggccaccgtgatgttcgagtgcgacaagggcttctacctggacggcagcgacaccatcgtgtgcgacagcaacagcacctgggacccccccgtgcccaagtgcctgaaggtgagcaccagcagcaccaccaagagccccgccagcagcgccagcggctaccccaagcccgaggagggcatcctggacagcctggacgtgtgggtgatcgccgtgatcgtgatcgccatcgtggtgggcgtggccgtgatctgcgtggtgccctacagatacctgcagagaagaaagaagaagggcaaggccgacggcggcgccgagtacgccacctaccagaccaagagcaccacccccgccgagcagagaggctag

SEQ ID NO: 75976 - DNA, 510 bp, Artificial Sequence
  Description of Artificial Sequence: Synthetic coding sequence
atgtgcagcagaggctgggacagctgcctggccctggagctgctgctgctgcccctgagcctgctggtgaccagcatccagggccacctggtgcacatgaccgtggtgagcggcagcaacgtgaccctgaacatcagcgagagcctgcccgagaactacaagcagctgacctggttctacaccttcgaccagaagatcgtggagtgggacagcagaaagagcaagtacttcgagagcaagttcaagggcagagtgagactggacccccagagcggcgccctgtacatcagcaaggtgcagaaggaggacaacagcacctacatcatgagagtgctgaagaagaccggcaacgagcaggagtggaagatcaagctgcaggtgctgggcgagagcggcgagcccaagagcaagagccccctgcagtggccccagatggaccactgcagagccagctgggaggcctggggcaccctgggcgaggaggagagaaagaccagcggccaggtgtag

SEQ ID NO: 75977 - DNA, 732 bp, Artificial Sequence
  Description of Artificial Sequence: Synthetic coding sequence
atgtgcagcagaggctgggacagctgcctggccctggagctgctgctgctgcccctgagcctgctggtgaccagcatccagggccacctggtgcacatgaccgtggtgagcggcagcaacgtgaccctgaacatcagcgagagcctgcccgagaactacaagcagctgacctggttctacaccttcgaccagaagatcgtggagtgggacagcagaaagagcaagtacttcgagagcaagttcaagggcagagtgagactggacccccagagcggcgccctgtacatcagcaaggtgcagaaggaggacaacagcacctacatcatgagagtgctgaagaagaccggcaacgagcaggagtggaagatcaagctgcaggtgctggaccccgtgcccaagcccgtgatcaagatcgagaagatcgaggacatggacgacaactgctacctgaagctgagctgcgtgatccccggcgagagcgtgaactacacctggtacggcgacaagagacccttccccaaggagctgcagaacagcgtgctggagaccaccctgatgccccacaactacagcagatgctacacctgccaggtgagcaacagcgtgagcagcaagaacggcaccgtgtgcctgagccccccctgcaccctggccagaagcttcggcgtggagtggatcgccagctggctggtggtgaccgtgcccaccatcctgggcctgctgctgacctag

SEQ ID NO: 75978 - DNA, 1044 bp, Artificial Sequence
  Description of Artificial Sequence: Synthetic coding sequence
atggccctgctgttcagcctgatcctggccatctgcaccagacccggcttcctggccagccccagcggcgtgagactggtgggcggcctgcacagatgcgagggcagagtggaggtggagcagaagggccagtggggcaccgtgtgcgacgacggctgggacatcaaggacgtggccgtgctgtgcagagagctgggctgcggcgccgccagcggcacccccagcggcatcctgtacgagccccccgccgagaaggagcagaaggtgctgatccagagcgtgagctgcaccggcaccgaggacaccctggcccagtgcgagcaggaggaggtgtacgactgcagccacgacgaggacgccggcgccagctgcgagaaccccgagagcagcttcagccccgtgcccgagggcgtgagactggccgacggccccggccactgcaagggcagagtggaggtgaagcaccagaaccagtggtacaccgtgtgccagaccggctggagcctgagagccgccaaggtggtgtgcagacagctgggctgcggcagagccgtgctgacccagaagagatgcaacaagcacgcctacggcagaaagcccatctggctgagccagatgagctgcagcggcagagaggccaccctgcaggactgccccagcggcccctggggcaagaacacctgcaaccacgacgaggacacctgggtggagtgcgaggaccccttcgacctgagactggtgggcggcgacaacctgtgcagcggcagactggaggtgctgcacaagggcgtgtggggcagcgtgtgcgacgacaactggggcgagaaggaggaccaggtggtgtgcaagcagctgggctgcggcaagagcctgagccccagcttcagagacagaaagtgctacggccccggcgtgggcagaatctggctggacaacgtgagatgcagcggcgaggagcagagcctggagcagtgccagcacagattctggggcttccacgactgcacccaccaggaggacgtggccgtgatctgcagcggctag

SEQ ID NO: 75979 - DNA, 660 bp, Artificial Sequence
  Description of Artificial Sequence: Synthetic coding sequence
atgggcatgagcagcctgaagctgctgaagtacgtgctgttcttcttcaacctgctgttctggatctgcggctgctgcatcctgggcttcggcatctacctgctgatccacaacaacttcggcgtgctgttccacaacctgcccagcctgaccctgggcaacgtgttcgtgatcgtgggcagcatcatcatggtggtggccttcctgggctgcatgggcagcatcaaggagaacaagtgcctgctgatgagcttcttcatcctgctgctgatcatcctgctggccgaggtgaccctggccatcctgctgttcgtgtacgagcagaagctgaacgagtacgtggccaagggcctgaccgacagcatccacagataccacagcgacaacagcaccaaggccgcctgggacagcatccagagcttcctgcagtgctgcggcatcaacggcaccagcgactggaccagcggcccccccgccagctgccccagcgacagaaaggtggagggctgctacgccaaggccagactgtggttccacagcaacttcctgtacatcggcatcatcaccatctgcgtgtgcgtgatcgaggtgctgggcatgagcttcgccctgaccctgaactgccagatcgacaagaccagccagaccatcggcctgtag

SEQ ID NO: 75980 - DNA, 483 bp, Artificial Sequence
  Description of Artificial Sequence: Synthetic coding sequence
atgggcatgagcagcctgaagctgctgaagtacgtgctgttcttcttcaacctgctgttctggatctgcggctgctgcatcctgggcttcggcatctacctgctgatccacaacaacttcggcgtgctgttccacaacctgcccagcctgaccctgggcaacgtgttcgtgatcgtgggcagcatcatcatggtggtggccttcctgggctgcatgggcagcatcaaggagaacaagtgcctgctgatgagcttcttcatcctgctgctgatcatcctgctggccgaggtgaccctggccatcctgctgttcgtgtacgagcagaagggctgctacgccaaggccagactgtggttccacagcaacttcctgtacatcggcatcatcaccatctgcgtgtgcgtgatcgaggtgctgggcatgagcttcgccctgaccctgaactgccagatcgacaagaccagccagaccatcggcctgtag

SEQ ID NO: 75981 - DNA, 1323 bp, Artificial Sequence
  Description of Artificial Sequence: Synthetic coding sequence
atgaccgtggccagacccagcgtgcccgccgccctgcccctgctgggcgagctgcccagactgctgctgctggtgctgctgtgcctgcccgccgtgtggggcgactgcggcctgccccccgacgtgcccaacgcccagcccgccctggagggcagaaccagcttccccgaggacaccgtgatcacctacaagtgcgaggagagcttcgtgaagatccccggcgagaaggacagcgtgatctgcctgaagggcagccagtggagcgacatcgaggagttctgcaacagaagctgcgaggtgcccaccagactgaacagcgccagcctgaagcagccctacatcacccagaactacttccccgtgggcaccgtggtggagtacgagtgcagacccggctacagaagagagcccagcctgagccccaagctgacctgcctgcagaacctgaagtggagcaccgccgtggagttctgcaagaagaagagctgccccaaccccggcgagatcagaaacggccagatcgacgtgcccggcggcatcctgttcggcgccaccatcagcttcagctgcaacaccggctacaagctgttcggcagcaccagcagcttctgcctgatcagcggcagcagcgtgcagtggagcgaccccctgcccgagtgcagagagatctactgccccgcccccccccagatcgacaacggcatcatccagggcgagagagaccactacggctacagacagagcgtgacctacgcctgcaacaagggcttcaccatgatcggcgagcacagcatctactgcaccgtgaacaacgacgagggcgagtggagcggccccccccccgagtgcagaggcaagagcctgaccagcaaggtgccccccaccgtgcagaagcccaccaccgtgaacgtgcccaccaccgaggtgagccccaccagccagaagaccaccaccaagaccaccacccccaacgcccaggccaccagaagcacccccgtgagcagaaccaccaagcacttccacgagaccacccccaacaagggcagcggcaccaccagcggcaccaccagactgctgagcggcagcagacccgtgacccaggccggcatgagatggtgcgacagaagcagcctgcagagcagaacccccggcttcaagagaagcttccacttcagcctgcccagcagctggtactacagagcccacgtgttccacgtggacagattcgcctgggacgccagcaaccacggcctggccgacctggccaaggaggagctgagaagaaagtacacccaggtgtacagactgttcctggtgagctag

SEQ ID NO: 75982 - DNA, 1095 bp, Artificial Sequence
  Description of Artificial Sequence: Synthetic coding sequence
atgaccgtggccagacccagcgtgcccgccgccctgcccctgctgggcgagctgcccagactgctgctgctggtgctgctgtgcctgcccgccgtgtggggcgactgcggcctgccccccgacgtgcccaacgcccagcccgccctggagggcagaaccagcttccccgaggacaccgtgatcacctacaagtgcgaggagagcttcgtgaagatccccggcgagaaggacagcgtgatctgcctgaagggcagccagtggagcgacatcgaggagttctgcaacagaagctgcgaggtgcccaccagactgaacagcgccagcctgaagcagccctacatcacccagaactacttccccgtgggcaccgtggtggagtacgagtgcagacccggctacagaagagagcccagcctgagccccaagctgacctgcctgcagaacctgaagtggagcaccgccgtggagttctgcaagaagaagagctgccccaaccccggcgagatcagaaacggccagatcgacgtgcccggcggcatcctgttcggcgccaccatcagcttcagctgcaacaccggctacaagctgttcggcagcaccagcagcttctgcctgatcagcggcagcagcgtgcagtggagcgaccccctgcccgagtgcagagagatctactgccccgcccccccccagatcgacaacggcatcatccagggcgagagagaccactacggctacagacagagcgtgacctacgcctgcaacaagggcttcaccatgatcggcgagcacagcatctactgcaccgtgaacaacgacgagggcgagtggagcggccccccccccgagtgcagaggcaagagcctgaccagcaaggtgccccccaccgtgcagaagcccaccaccgtgaacgtgcccaccaccgaggtgagccccaccagccagaagaccaccaccaagaccaccacccccaacgcccaggccaccagaagcacccccgtgagcagaaccaccaagcacttccacgagaccacccccaacaagggcagcggcaccaccagcggcaccaccagactgctgagcgtgctgttcatgtag

SEQ ID NO: 75983 - DNA, 1146 bp, Artificial Sequence
  Description of Artificial Sequence: Synthetic coding sequence
atgaccgtggccagacccagcgtgcccgccgccctgcccctgctgggcgagctgcccagactgctgctgctggtgctgctgtgcctgcccgccgtgtggggcgactgcggcctgccccccgacgtgcccaacgcccagcccgccctggagggcagaaccagcttccccgaggacaccgtgatcacctacaagtgcgaggagagcttcgtgaagatccccggcgagaaggacagcgtgatctgcctgaagggcagccagtggagcgacatcgaggagttctgcaacagaagctgcgaggtgcccaccagactgaacagcgccagcctgaagcagccctacatcacccagaactacttccccgtgggcaccgtggtggagtacgagtgcagacccggctacagaagagagcccagcctgagccccaagctgacctgcctgcagaacctgaagtggagcaccgccgtggagttctgcaagaagaagagctgccccaaccccggcgagatcagaaacggccagatcgacgtgcccggcggcatcctgttcggcgccaccatcagcttcagctgcaacaccggctacaagctgttcggcagcaccagcagcttctgcctgatcagcggcagcagcgtgcagtggagcgaccccctgcccgagtgcagagagatctactgccccgcccccccccagatcgacaacggcatcatccagggcgagagagaccactacggctacagacagagcgtgacctacgcctgcaacaagggcttcaccatgatcggcgagcacagcatctactgcaccgtgaacaacgacgagggcgagtggagcggccccccccccgagtgcagaggcaagagcctgaccagcaaggtgccccccaccgtgcagaagcccaccaccgtgaacgtgcccaccaccgaggtgagccccaccagccagaagaccaccaccaagaccaccacccccaacgcccaggccaccagaagcacccccgtgagcagaaccaccaagcacttccacgagaccacccccaacaagggcagcggcaccaccagcggcaccaccagactgctgagcggccacacctgcttcaccctgaccggcctgctgggcaccctggtgaccatgggcctgctgacctag

SEQ ID NO: 75984 - DNA, 1320 bp, Artificial Sequence
  Description of Artificial Sequence: Synthetic coding sequence
atgaccgtggccagacccagcgtgcccgccgccctgcccctgctgggcgagctgcccagactgctgctgctggtgctgctgtgcctgcccgccgtgtggggcgactgcggcctgccccccgacgtgcccaacgcccagcccgccctggagggcagaaccagcttccccgaggacaccgtgatcacctacaagtgcgaggagagcttcgtgaagatccccggcgagaaggacagcgtgatctgcctgaagggcagccagtggagcgacatcgaggagttctgcaacagaagctgcgaggtgcccaccagactgaacagcgccagcctgaagcagccctacatcacccagaactacttccccgtgggcaccgtggtggagtacgagtgcagacccggctacagaagagagcccagcctgagccccaagctgacctgcctgcagaacctgaagtggagcaccgccgtggagttctgcaagaagaagagctgccccaaccccggcgagatcagaaacggccagatcgacgtgcccggcggcatcctgttcggcgccaccatcagcttcagctgcaacaccggctacaagctgttcggcagcaccagcagcttctgcctgatcagcggcagcagcgtgcagtggagcgaccccctgcccgagtgcagagagatctactgccccgcccccccccagatcgacaacggcatcatccagggcgagagagaccactacggctacagacagagcgtgacctacgcctgcaacaagggcttcaccatgatcggcgagcacagcatctactgcaccgtgaacaacgacgagggcgagtggagcggccccccccccgagtgcagaggcaagagcctgaccagcaaggtgccccccaccgtgcagaagcccaccaccgtgaacgtgcccaccaccgaggtgagccccaccagccagaagaccaccaccaagaccaccacccccaacgcccaggccaccagaagcacccccgtgagcagaaccaccaagcacttccacgagaccacccccaacaagggcagcggcaccaccagcggcaccaccagactgctgagcgagaccgtgttccacagagtgatccaggacggcctggacctgctggccagcagaagcgcctgcctgggcctgcccaagtgctgggactacagaagagagcccccccacctggccagagcccacgtgttccacgtggacagattcgcctgggacgccagcaaccacggcctggccgacctggccaaggaggagctgagaagaaagtacacccaggtgtacagactgttcctggtgagctag

SEQ ID NO: 75985 - DNA, 390 bp, Artificial Sequence
  Description of Artificial Sequence: Synthetic coding sequence
atgaccgtggccagacccagcgtgcccgccgccctgcccctgctgggcgagctgcccagactgctgctgctggtgctgctgtgcctgcccgccgtgtggggcgactgcggcctgccccccgacgtgcccaacgcccagcccgccctggagggcagaaccagcttccccgaggacaccgtgatcacctacaagtgcgaggagagcttcgtgaagatccccggcgagaaggacagcgtgatctgcctgaagggcagccagtggagcgacatcgaggagttctgcaacagaagctgcgaggtgcccaccagactgcagaagagaaccttcagcatcaccaagaccaacctgcccagcgagttcaagatggtgcacagcagcagaatcctgtag

SEQ ID NO: 75986 - DNA, 1155 bp, Artificial Sequence
  Description of Artificial Sequence: Synthetic coding sequence
atgaccgtggccagacccagcgtgcccgccgccctgcccctgctgggcgagctgcccagactgctgctgctggtgctgctgtgcctgcccgccgtgtggggcgactgcggcctgccccccgacgtgcccaacgcccagcccgccctggagggcagaaccagcttccccgaggacaccgtgatcacctacaagtgcgaggagagcttcgtgaagatccccggcgagaaggacagcgtgatctgcctgaagggcagccagtggagcgacatcgaggagttctgcaacagaagctgcgaggtgcccaccagactgaacagcgccagcctgaagcagccctacatcacccagaactacttccccgtgggcaccgtggtggagtacgagtgcagacccggctacagaagagagcccagcctgagccccaagctgacctgcctgcagaacctgaagtggagcaccgccgtggagttctgcaagaagaagagctgccccaaccccggcgagatcagaaacggccagatcgacgtgcccggcggcatcctgttcggcgccaccatcagcttcagctgcaacaccggctacaagctgttcggcagcaccagcagcttctgcctgatcagcggcagcagcgtgcagtggagcgaccccctgcccgagtgcagagagatctactgccccgcccccccccagatcgacaacggcatcatccagggcgagagagaccactacggctacagacagagcgtgacctacgcctgcaacaagggcttcaccatgatcggcgagcacagcatctactgcaccgtgaacaacgacgagggcgagtggagcggccccccccccgagtgcagaggcaagagcctgaccagcaaggtgccccccaccgtgcagaagcccaccaccgtgaacgtgcccaccaccgaggtgagccccaccagccagaagaccaccaccaagaccaccacccccaacgcccaggccaccagaagcacccccgtgagcagaaccaccaagcacttccacgagaccacccccaacaagggcagcggcaccaccagcggcaccaccagactgctgagcgccctgcaggtgagacccttcgaggtgagcggcagcagccacatcagcagcaagaagatgatgtgcatcctgtag

SEQ ID NO: 75987 - DNA, 954 bp, Artificial Sequence
  Description of Artificial Sequence: Synthetic coding sequence
atgaccgtggccagacccagcgtgcccgccgccctgcccctgctgggcgagctgcccagactgctgctgctggtgctgctgtgcctgcccgccgtgtggggcgactgcggcctgccccccgacgtgcccaacgcccagcccgccctggagggcagaaccagcttccccgaggacaccgtgatcacctacaagtgcgaggagagcttcgtgaagatccccggcgagaaggacagcgtgatctgcctgaagggcagccagtggagcgacatcgaggagttctgcaaccagaagagctgccccaaccccggcgagatcagaaacggccagatcgacgtgcccggcggcatcctgttcggcgccaccatcagcttcagctgcaacaccggctacaagctgttcggcagcaccagcagcttctgcctgatcagcggcagcagcgtgcagtggagcgaccccctgcccgagtgcagagagatctactgccccgcccccccccagatcgacaacggcatcatccagggcgagagagaccactacggctacagacagagcgtgacctacgcctgcaacaagggcttcaccatgatcggcgagcacagcatctactgcaccgtgaacaacgacgagggcgagtggagcggccccccccccgagtgcagaggcaagagcctgaccagcaaggtgccccccaccgtgcagaagcccaccaccgtgaacgtgcccaccaccgaggtgagccccaccagccagaagaccaccaccaagaccaccacccccaacgcccaggccaccagaagcacccccgtgagcagaaccaccaagcacttccacgagaccacccccaacaagggcagcggcaccaccagcggccagctgaccctgttcagcggccacacctgcttcaccctgaccggcctgctgggcaccctggtgaccatgggcctgctgacctag

SEQ ID NO: 75988 - DNA, 753 bp, Artificial Sequence
  Description of Artificial Sequence: Synthetic coding sequence
atggtggccggcagcgacgccggcagagccctgggcgtgctgagcgtggtgtgcctgctgcactgcttcggcttcatcagctgcttcagccagcagatctacggcgtggtgtacggcaacgtgaccttccacgtgcccagcaacgtgcccctgaaggaggtgctgtggaagaagcagaaggacaaggtggccgagctggagaacagcgagttcagagccttcagcagcttcaagaacagagtgtacctggacaccgtgagcggcagcctgaccatctacaacctgaccagcagcgacgaggacgagtacgagatggagagccccaacatcaccgacaccatgaagttcttcctgtacgtgctggagagcctgcccagccccaccctgacctgcgccctgaccaacggcagcatcgaggtgcagtgcatgatccccgagcactacaacagccacagaggcctgatcatgtacagctgggactgccccatggagcagtgcaagagaaacagcaccagcatctacttcaagatggagaacgacctgccccagaagatccagtgcaccctgagcaaccccctgttcaacaccaccagcagcatcatcctgaccacctgcatccccagcagcggccacagcagacacagatacgccctgatccccatccccctggccgtgatcaccacctgcatcgtgctgtacatgaacggcatcctgaagtgcgacagaaagcccgacagaaccaacagcaactag

SEQ ID NO: 75989 - DNA, 747 bp, Artificial Sequence
  Description of Artificial Sequence: Synthetic coding sequence
atggtggccggcagcgacgccggcagagccctgggcgtgctgagcgtggtgtgcctgctgcactgcttcggcttcatcagctgcttcagccagcagatctacggcgtggtgtacggcaacgtgaccttccacgtgcccagcaacgtgcccctgaaggaggtgctgtggaagaagcagaaggacaaggtggccgagctggagaacagcgagttcagagccttcagcagcttcaagaacagagtgtacctggacaccgtgagcggcagcctgaccatctacaacctgaccagcagcgacgaggacgagtacgagatggagagccccaacatcaccgacaccatgaagttcttcctgtacgtgctggagagcctgcccagccccaccctgacctgcgccctgaccaacggcagcatcgaggtgcagtgcatgatccccgagcactacaacagccacagaggcctgatcatgtacagctgggactgccccatggagcagtgcaagagaaacagcaccagcatctacttcaagatggagaacgacctgccccagaagatccagtgcaccctgagcaaccccctgttcaacaccaccagcagcatcatcctgaccacctgcatccccagcagcggccacagcagacacagatacgccctgatccccatccccctggccgtgatcaccacctgcatcgtgctgtacatgaacggcatcctgaagtgcgacagaaagcccgacagaaccaagtag

SEQ ID NO: 75990 - DNA, 387 bp, Artificial Sequence
  Description of Artificial Sequence: Synthetic coding sequence
atgggcatccagggcggcagcgtgctgttcggcctgctgctggtgctggccgtgttctgccacagcggccacagcctgcagtgctacaactgccccaaccccaccgccgactgcaagaccgccgtgaactgcagcagcgacttcgacgcctgcctgatcaccaaggccggcctgcaggtgtacaacaagtgctggaagttcgagcactgcaacttcaacgacgtgaccaccagactgagagagaacgagctgacctactactgctgcaagaaggacctgtgcaacttcaacgagcagctggagaacggcggcaccagcctgagcgagaagaccgtgctgctgctggtgacccccttcctggccgccgcctggagcctgcacccctag

SEQ ID NO: 75991 - DNA, 387 bp, Artificial Sequence; identical to SEQ ID NO: 75990
  Description of Artificial Sequence: Synthetic coding sequence

SEQ ID NO: 75992 - DNA, 387 bp, Artificial Sequence; identical to SEQ ID NO: 75990
  Description of Artificial Sequence: Synthetic coding sequence

SEQ ID NO: 75993 - DNA, 387 bp, Artificial Sequence; identical to SEQ ID NO: 75990
  Description of Artificial Sequence: Synthetic coding sequence

SEQ ID NO: 75994 - DNA, 387 bp, Artificial Sequence; identical to SEQ ID NO: 75990
  Description of Artificial Sequence: Synthetic coding sequence

SEQ ID NO: 75995 - DNA, 387 bp, Artificial Sequence; identical to SEQ ID NO: 75990
  Description of Artificial Sequence: Synthetic coding sequence

SEQ ID NO: 75996 - DNA, 387 bp, Artificial Sequence; identical to SEQ ID NO: 75990
  Description of Artificial Sequence: Synthetic coding sequence

SEQ ID NO: 75997 - DNA, 387 bp, Artificial Sequence; identical to SEQ ID NO: 75990
  Description of Artificial Sequence: Synthetic coding sequence

SEQ ID NO: 75998 - DNA, 387 bp, Artificial Sequence; identical to SEQ ID NO: 75990
  Description of Artificial Sequence: Synthetic coding sequence

SEQ ID NO: 75999 - DNA, 2007 bp, Artificial Sequence
  Description of Artificial Sequence: Synthetic coding sequence
atgtggctgttcttcggcatcaccggcctgctgaccgccgccctgagcggccaccccagccccgccccccccgaccagctgaacaccagcagcgccgagagcgagctgtgggagcccggcgagagactgcccgtgagactgaccaacggcagcagcagctgcagcggcaccgtggaggtgagactggaggccagctgggagcccgcctgcggcgccctgtgggacagcagagccgccgaggccgtgtgcagagccctgggctgcggcggcgccgaggccgccagccagctggccccccccacccccgagctgccccccccccccgccgccggcaacaccagcgtggccgccaacgccaccctggccggcgcccccgccctgctgtgcagcggcgccgagtggagactgtgcgaggtggtggagcacgcctgcagaagcgacggcagaagagccagagtgacctgcgccgagaacagagccctgagactggtggacggcggcggcgcctgcgccggcagagtggagatgctggagcacggcgagtggggcagcgtgtgcgacgacacctgggacctggaggacgcccacgtggtgtgcagacagctgggctgcggctgggccgtgcaggccctgcccggcctgcacttcacccccggcagaggccccatccacagagaccaggtgaactgcagcggcgccgaggcctacctgtgggactgccccggcctgcccggccagcactactgcggccacaaggaggacgccggcgccgtgtgcagcgagcaccagagctggagactgaccggcggcgccgacagatgcgagggccaggtggaggtgcacttcagaggcgtgtggaacaccgtgtgcgacagcgagtggtaccccagcgaggccaaggtgctgtgccagagcctgggctgcggcaccgccgtggagagacccaagggcctgccccacagcctgagcggcagaatgtactacagctgcaacggcgaggagctgaccctgagcaactgcagctggagattcaacaacagcaacctgtgcagccagagcctggccgccagagtgctgtgcagcgccagcagaagcctgcacaacctgagcacccccgaggtgcccgccagcgtgcagaccgtgaccatcgagagcagcgtgaccgtgaagatcgagaacaaggagagcagagagctgatgctgctgatccccagcatcgtgctgggcatcctgctgctgggcagcctgatcttcatcgccttcatcctgctgagaatcaagggcaagtacgccctgcccgtgatggtgaaccaccagcacctgcccaccaccatccccgccggcagcaacagctaccagcccgtgcccatcaccatccccaaggaggtgttcatgctgcccatccaggtgcaggcccccccccccgaggacagcgacagcggcagcgacagcgactacgagcactacgacttcagcgcccagccccccgtggccctgaccaccttctacaacagccagagacacagagtgaccgacgaggaggtgcagcagagcagattccagatgccccccctggaggagggcctggaggagctgcacgccagccacatccccaccgccaaccccggccactgcatcaccgacccccccagcctgggcccccagtaccaccccagaagcaacagcgagagcagcaccagcagcggcgaggactactgcaacagccccaagagcaagctgcccccctggaacccccaggtgttcagcagcgagagaagcagcttcctggagcagccccccaacctggagctggccggcacccagcccgccttcagcgccggcccccccgccgacgacagcagcagcaccagcagcggcgagtggtaccagaacttccagccccccccccagccccccagcgaggagcagttcggctgccccggcagccccagcccccagcccgacagcaccgacaacgacgactacgacgacatcagcgccgcctag

SEQ ID NO: 76000 - DNA, 1911 bp, Artificial Sequence
  Description of Artificial Sequence: Synthetic coding sequence
atgtggctgttcttcggcatcaccggcctgctgaccgccgccctgagcggccaccccagccccgccccccccgaccagctgaacaccagcagcgccgagagcgagctgtgggagcccggcgagagactgcccgtgagactgaccaacggcagcagcagctgcagcggcaccgtggaggtgagactggaggccagctgggagcccgcctgcggcgccctgtgggacagcagagccgccgaggccgtgtgcagagccctgggctgcggcggcgccgaggccgccagccagctggccccccccacccccgagctgccccccccccccgccgccggcaacaccagcgtggccgccaacgccaccctggccggcgcccccgccctgctgtgcagcggcgccgagtggagactgtgcgaggtggtggagcacgcctgcagaagcgacggcagaagagccagagtgacctgcgccgagaacagagccctgagactggtggacggcggcggcgcctgcgccggcagagtggagatgctggagcacggcgagtggggcagcgtgtgcgacgacacctgggacctggaggacgcccacgtggtgtgcagacagctgggctgcggctgggccgtgcaggccctgcccggcctgcacttcacccccggcagaggccccatccacagagaccaggtgaactgcagcggcgccgaggcctacctgtgggactgccccggcctgcccggccagcactactgcggccacaaggaggacgccggcgccgtgtgcagcgagcaccagagctggagactgaccggcggcgccgacagatgcgagggccaggtggaggtgcacttcagaggcgtgtggaacaccgtgtgcgacagcgagtggtaccccagcgaggccaaggtgctgtgccagagcctgggctgcggcaccgccgtggagagacccaagggcctgccccacagcctgagcggcagaatgtactacagctgcaacggcgaggagctgaccctgagcaactgcagctggagattcaacaacagcaacctgtgcagccagagcctggccgccagagtgctgtgcagcgccagcagaagcctgcacaacctgagcacccccgaggtgcccgccagcgtgcagaccgtgaccatcgagagcagcgtgaccgtgaagatcgagaacaaggagagcagagagctgatgctgctgatccccagcatcgtgctgggcatcctgctgctgggcagcctgatcttcatcgccttcatcctgctgagaatcaagggcaagtacgtgttcatgctgcccatccaggtgcaggcccccccccccgaggacagcgacagcggcagcgacagcgactacgagcactacgacttcagcgcccagccccccgtggccctgaccaccttctacaacagccagagacacagagtgaccgacgaggaggtgcagcagagcagattccagatgccccccctggaggagggcctggaggagctgcacgccagccacatccccaccgccaaccccggccactgcatcaccgacccccccagcctgggcccccagtaccaccccagaagcaacagcgagagcagcaccagcagcggcgaggactactgcaacagccccaagagcaagctgcccccctggaacccccaggtgttcagcagcgagagaagcagcttcctggagcagccccccaacctggagctggccggcacccagcccgccttcagcgccggcccccccgccgacgacagcagcagcaccagcagcggcgagtggtaccagaacttccagccccccccccagccccccagcgaggagcagttcggctgccccggcagccccagcccccagcccgacagcaccgacaacgacgactacgacgacatcagcgccgcctag

SEQ ID NO: 76001 - DNA, 1788 bp, Artificial Sequence
  Description of Artificial Sequence: Synthetic coding sequence
atgtggctgttcttcggcatcaccggcctgctgaccgccgccctgagcggccaccccagccccgccccccccgaccagctgaacaccagcagcgccgagagcgagctgtgggagcccggcgagagactgcccgtgagactgaccaacggcagcagcagctgcagcggcaccgtggaggtgagactggaggccagctgggagcccgcctgcggcgccctgtgggacagcagagccgccgaggccgtgtgcagagccctgggctgcggcggcgccgaggccgccagccagctggccccccccacccccgagctgccccccccccccgccgccggcaacaccagcgtggccgccaacgccaccctggccggcgcccccgccctgctgtgcagcggcgccgagtggagactgtgcgaggtggtggagcacgcctgcagaagcgacggcagaagagccagagtgacctgcgccgagaacagagccctgagactggtggacggcggcggcgcctgcgccggcagagtggagatgctggagcacggcgagtggggcagcgtgtgcgacgacacctgggacctggaggacgcccacgtggtgtgcagacagctgggctgcggctgggccgtgcaggccctgcccggcctgcacttcacccccggcagaggccccatccacagagaccaggtgaactgcagcggcgccgaggcctacctgtgggactgccccggcctgcccggccagcactactgcggccacaaggaggacgccggcgccgtgtgcagcgagcaccagagctggagactgaccggcggcgccgacagatgcgagggccaggtggaggtgcacttcagaggcgtgtggaacaccgtgtgcgacagcgagtggtaccccagcgaggccaaggtgctgtgccagagcctgggctgcggcaccgccgtggagagacccaagggcctgccccacagcctgagcggcagaatgtactacagctgcaacggcgaggagctgaccctgagcaactgcagctggagattcaacaacagcaacctgtgcagccagagcctggccgccagagtgctgtgcagcgccagcagaagcctgcacaacctgagcacccccgaggtgcccgccagcgtgcagaccgtgaccatcgagagcagcgtgaccgtgaagatcgagaacaaggagagcagagagctgatgctgctgatccccagcatcgtgctgggcatcctgctgctgggcagcctgatcttcatcgccttcatcctgctgagaatcaagggcaagtacgacagccagagacacagagtgaccgacgaggaggtgcagcagagcagattccagatgccccccctggaggagggcctggaggagctgcacgccagccacatccccaccgccaaccccggccactgcatcaccgacccccccagcctgggcccccagtaccaccccagaagcaacagcgagagcagcaccagcagcggcgaggactactgcaacagccccaagagcaagctgcccccctggaacccccaggtgttcagcagcgagagaagcagcttcctggagcagccccccaacctggagctggccggcacccagcccgccttcagcgccggcccccccgccgacgacagcagcagcaccagcagcggcgagtggtaccagaacttccagccccccccccagccccccagcgaggagcagttcggctgccccggcagccccagcccccagcccgacagcaccgacaacgacgactacgacgacatcagcgccgcctag

SEQ ID NO: 76002 - DNA, 1806 bp, Artificial Sequence
  Description of Artificial Sequence: Synthetic coding sequence
atgtggctgttcttcggcatcaccggcctgctgaccgccgccctgagcggccaccccagccccgccccccccgaccagctgaacaccagcagcgccgagagcgagctgtgggagcccggcgagagactgcccgtgagactgaccaacggcagcagcagctgcagcggcaccgtggaggtgagactggaggccagctgggagcccgcctgcggcgccctgtgggacagcagagccgccgaggccgtgtgcagagccctgggctgcggcggcgccgaggccgccagccagctggccccccccacccccgagctgccccccccccccgccgccggcaacaccagcgtggccgccaacgccaccctggccggcgcccccgccctgctgtgcagcggcgccgagtggagactgtgcgaggtggtggagcacgcctgcagaagcgacggcagaagagccagagtgacctgcgccgagaacagagccctgagactggtggacggcggcggcgcctgcgccggcagagtggagatgctggagcacggcgagtggggcagcgtgtgcgacgacacctgggacctggaggacgcccacgtggtgtgcagacagctgggctgcggctgggccgtgcaggccctgcccggcctgcacttcacccccggcagaggccccatccacagagaccaggtgaactgcagcggcgccgaggcctacctgtgggactgccccggcctgcccggccagcactactgcggccacaaggaggacgccggcgccgtgtgcagcgagcaccagagctggagactgaccggcggcgccgacagatgcgagggccaggtggaggtgcacttcagaggcgtgtggaacaccgtgtgcgacagcgagtggtaccccagcgaggccaaggtgctgtgccagagcctgggctgcggcaccgccgtggagagacccaagggcctgccccacagcctgagcggcagaatgtactacagctgcaacggcgaggagctgaccctgagcaactgcagctggagattcaacaacagcaacctgtgcagccagagcctggccgccagagtgctgtgcagcgccagcagaagcctgcacaacctgagcacccccgaggtgcccgccagcgtgcagaccgtgaccatcgagagcagcgtgaccgtgaagatcgagaacaaggagagcagagagctgatgctgctgatccccagcatcgtgctgggcatcctgctgctgggcagcctgatcttcatcgccttcatcctgctgagaatcaagggcaagtacgtgttcatgctgcccatccaggtgcaggcccccccccccgaggacagcgacagcggcagcgacagcgactacgagcactacgacttcagcgcccagccccccgtggccctgaccaccttctacaacagccagagacacagagtgaccgacgaggaggtgcagcagagcagattccagatgccccccctggaggagggcctggaggagctgcacgccagccacatccccaccgccaaccccggccactgcatcaccgacccccccagcctgggcccccagtaccaccccagaagcaacagcgagagcagcaccagcagcggcgaggactactgcaacagccccaagagcaagctgcccccctggaacccccaggtgttcagcagcgagagaagcagcttcctggagcagccccccaacctggagctggccggcacccagcccgccttcagcggcagccccagcccccagcccgacagcaccgacaacgacgactacgacgacatcagcgccgcctag

SEQ ID NO: 76003 - DNA, 1779 bp, Artificial Sequence
  Description of Artificial Sequence: Synthetic coding sequence
atgtggctgttcttcggcatcaccggcctgctgaccgccgccctgagcggccaccccagccccgccccccccgaccagctgaacaccagcagcgccgagagcgagctgtgggagcccggcgagagactgcccgtgagactgaccaacggcagcagcagctgcagcggcaccgtggaggtgagactggaggccagctgggagcccgcctgcggcgccctgtgggacagcagagccgccgaggccgtgtgcagagccctgggctgcggcggcgccgaggccgccagccagctggccccccccacccccgagctgccccccccccccgccgccggcaacaccagcgtggccgccaacgccaccctggccggcgcccccgccctgctgtgcagcggcgccgagtggagactgtgcgaggtggtggagcacgcctgcagaagcgacggcagaagagccagagtgacctgcgccgagaacagagccctgagactggtggacggcggcggcgcctgcgccggcagagtggagatgctggagcacggcgagtggggcagcgtgtgcgacgacacctgggacctggaggacgcccacgtggtgtgcagacagctgggctgcggctgggccgtgcaggccctgcccggcctgcacttcacccccggcagaggccccatccacagagaccaggtgaactgcagcggcgccgaggcctacctgtgggactgccccggcctgcccggccagcactactgcggccacaaggaggacgccggcgccgtgtgcagcgagcaccagagctggagactgaccggcggcgccgacagatgcgagggccaggtggaggtgcacttcagaggcgtgtggaacaccgtgtgcgacagcgagtggtaccccagcgaggccaaggtgctgtgccagagcctgggctgcggcaccgccgtggagagacccaagggcctgccccacagcctgagcggcagaatgtactacagctgcaacggcgaggagctgaccctgagcaactgcagctggagattcaacaacagcaacctgtgcagccagagcctggccgccagagtgctgtgcagcgccagcagaagcctgcacaacctgagcacccccgaggtgcccgccagcgtgcagaccgtgaccatcgagagcagcgtgaccgtgaagatcgagaacaaggagagcagagagctgatgctgctgatccccagcatcgtgctgggcatcctgctgctgggcagcctgatcttcatcgccttcatcctgctgagaatcaagggcaagtacgccctgcccgtgatggtgaaccaccagcacctgcccaccaccatccccgccggcagcaacagctaccagcccgtgcccatcaccatccccaaggaggacagccagagacacagagtgaccgacgaggaggtgcagcagagcagattccagatgccccccctggaggagggcctggaggagctgcacgccagccacatccccaccgccaaccccggccactgcatcaccgacccccccagcctgggcccccagtaccaccccagaagcaacagcgagagcagcaccagcagcggcgaggactactgcaacagccccaagagcaagctgcccccctggaacccccaggtgttcagcagcgagagaagcagcttcctggagcagccccccaacctggagctggccggcacccagcccgccttcagcggcagccccagcccccagcccgacagcaccgacaacgacgactacgacgacatcagcgccgcctag

SEQ ID NO: 76004 - DNA, 717 bp, Artificial Sequence
  Description of Artificial Sequence: Synthetic coding sequence
atggccgtggagggcggcatgaagtgcgtgaagttcctgctgtacgtgctgctgctggccttctgcgcctgcgccgtgggcctgatcgccgtgggcgtgggcgcccagctggtgctgagccagaccatcatccagggcgccacccccggcagcctgctgcccgtggtgatcatcgccgtgggcgtgttcctgttcctggtggccttcgtgggctgctgcggcgcctgcaaggagaactactgcctgatgatcaccttcgccatcttcctgagcctgatcatgctggtggaggtggccgccgccatcgccggctacgtgttcagagacaaggtgatgagcgagttcaacaacaacttcagacagcagatggagaactaccccaagaacaaccacaccgccagcatcctggacagaatgcaggccgacttcaagtgctgcggcgccgccaactacaccgactgggagaagatccccagcatgagcaagaacagagtgcccgacagctgctgcatcaacgtgaccgtgggctgcggcatcaacttcaacgagaaggccatccacaaggagggctgcgtggagaagatcggcggctggctgagaaagaacgtgctggtggtggccgccgccgccctgggcatcgccttcgtggaggtgctgggcatcgtgttcgcctgctgcctggtgaagagcatcagaagcggctacgaggtgatgtag

SEQ ID NO: 76005 - DNA, 711 bp, Artificial Sequence
  Description of Artificial Sequence: Synthetic coding sequence
atggccgtggagggcggcatgaagtgcgtgaagttcctgctgtacgtgctgctgctggccttctgcgcctgcgccgtgggcctgatcgccgtgggcgtgggcgcccagctggtgctgagccagaccatcatccagggcgccacccccggcagcctgctgcccgtggtgatcatcgccgtgggcgtgttcctgttcctggtggccttcgtgggctgctgcggcgcctgcaaggagaactactgcctgatgatcaccttcgccatcttcctgagcctgatcatgctggtggaggtggccgccgccatcgccggctacgtgttcagagacaaggtgatgagcgagttcaacaacaacttcagacagcagatggagaactaccccaagaacaaccacaccgccagcatcctggacagaatgcaggccgacttcaagtgctgcggcgccgccaactacaccgactgggagaagatccccagcatgagcaagaacagagtgcccgacagctgctgcatcaacgtgaccgtgggctgcggcatcaacttcaacgagaaggccatccacaaggagggctgcgtggagaagatcggcggctggctgagaaagaacgtgctggtggtggccgccgccgccctgggcatcgccttcgtgctgggcatcgtgttcgcctgctgcctggtgaagagcatcagaagcggctacgaggtgatgtag

SEQ ID NO: 76006 - DNA, 402 bp, Artificial Sequence
  Description of Artificial Sequence: Synthetic coding sequence
atggccgtggagggcggcatgaagtgcgtgaagttcctgctgtacgtgctgctgctggccttctgcgcctgcgccgtgggcctgatcgccgtgggcgtgggcgcccagctggtgctgagccagaccatcatccagggcgccacccccggcagcctgctgcccgtggtgatcatcgccgtgggcgtgttcctgttcctggtggccttcgtgggctgctgcggcgcctgcaaggagaactactgcctgatgatcaccttcgccatcttcctgagcctgatcatgctggtggaggtggccgccgccatcgccggctacgtgttcagagacaaggtgatgagcgagttcaacaacaacttcagacagcagatggagaactaccccaagaacaaccacaccgcctag

SEQ ID NO: 76007 - DNA, 717 bp, Artificial Sequence; identical to SEQ ID NO: 76004
  Description of Artificial Sequence: Synthetic coding sequence

SEQ ID NO: 76008 - DNA, 648 bp, Artificial Sequence
  Description of Artificial Sequence: Synthetic coding sequence
atggccgtggagggcggcatgaagtgcgtgaagttcctgctgtacgtgctgctgctggccttctgcgcctgcgccgtgggcctgatcgccgtgggcgtgggcgcccagctggtgctgagccagaccatcatccagggcgccacccccggcagcctgctgcccgtggtgatcatcgccgtgggcgtgttcctgttcctggtggccttcgtgggctgctgcggcgcctgcaaggagaactactgcctgatgatcaccttcgccatcttcctgagcctgatcatgctggtggaggtggccgccgccatcgccggctacgtgttcagagacaaggtgatgagcgagttcaacaacaacttcagacagcagatggagaactaccccaagaacaaccacaccgccagcatcctggacagaatgcaggccgacttcaagtgctgcggcgccgccaactacaccgactgggagaagatccccagcatgagcaagaacagagtgcccgacagctgctgcatcaacgtgaccgtgggctgcggcatcaacttcaacgagaaggccatccacaaggagggctgcgtggagaagatcggcggctggctgagaaagaacgtgctggtggtggccgccgccgccctgggcatcgccttctag

SEQ ID NO: 76009 - DNA, 654 bp, Artificial Sequence
  Description of Artificial Sequence: Synthetic coding sequence
atggccgtggagggcggcatgaagtgcgtgaagttcctgctgtacgtgctgctgctggccttctgcgcctgcgccgtgggcctgatcgccgtgggcgtgggcgcccagctggtgctgagccagaccatcatccagggcgccacccccggcagcctgctgcccgtggtgatcatcgccgtgggcgtgttcctgttcctggtggccttcgtgggctgctgcggcgcctgcaaggagaactactgcctgatgatcaccttcgccatcttcctgagcctgatcatgctggtggaggtggccgccgccatcgccggctacgtgttcagagacaaggtgatgagcgagttcaacaacaacttcagacagcagatggagaactaccccaagaacaaccacaccgccagcatcctggacagaatgcaggccgacttcaagtgctgcggcgccgccaactacaccgactgggagaagatccccagcatgagcaagaacagagtgcccgacagctgctgcatcaacgtgaccgtgggctgcggcatcaacttcaacgagaaggccatccacaaggagggctgcgtggagaagatcggcggctggctgagaaagaacgtgctggtggtggccgccgccgccctgggcatcgccttcgtggagtag

SEQ ID NO: 76010 - DNA, 717 bp, Artificial Sequence; identical to SEQ ID NO: 76004
  Description of Artificial Sequence: Synthetic coding sequence

SEQ ID NO: 76011 - DNA, 648 bp, Artificial Sequence
  Description of Artificial Sequence: Synthetic coding sequence
atggccgtggagggcggcatgaagtgcgtgaagttcctgctgtacgtgctgctgctggccttctgcggcgccacccccggcagcctgctgcccgtggtgatcatcgccgtgggcgtgttcctgttcctggtggccttcgtgggctgctgcggcgcctgcaaggagaactactgcctgatgatcaccttcgccatcttcctgagcctgatcatgctggtggaggtggccgccgccatcgccggctacgtgttcagagacaaggtgatgagcgagttcaacaacaacttcagacagcagatggagaactaccccaagaacaaccacaccgccagcatcctggacagaatgcaggccgacttcaagtgctgcggcgccgccaactacaccgactgggagaagatccccagcatgagcaagaacagagtgcccgacagctgctgcatcaacgtgaccgtgggctgcggcatcaacttcaacgagaaggccatccacaaggagggctgcgtggagaagatcggcggctggctgagaaagaacgtgctggtggtggccgccgccgccctgggcatcgccttcgtggaggtgctgggcatcgtgttcgcctgctgcctggtgaagagcatcagaagcggctacgaggtgatgtag

SEQ ID NO: 76012 - DNA, 471 bp, Artificial Sequence
  Description of Artificial Sequence: Synthetic coding sequence
atgatcaccttcgccatcttcctgagcctgatcatgctggtggaggtggccgccgccatcgccggctacgtgttcagagacaaggtgatgagcgagttcaacaacaacttcagacagcagatggagaactaccccaagaacaaccacaccgccagcatcctggacagaatgcaggccgacttcaagtgctgcggcgccgccaactacaccgactgggagaagatccccagcatgagcaagaacagagtgcccgacagctgctgcatcaacgtgaccgtgggctgcggcatcaacttcaacgagaaggccatccacaaggagggctgcgtggagaagatcggcggctggctgagaaagaacgtgctggtggtggccgccgccgccctgggcatcgccttcgtggaggtgctgggcatcgtgttcgcctgctgcctggtgaagagcatcagaagcggctacgaggtgatgtag

SEQ ID NO: 76013 - DNA, 471 bp, Artificial Sequence; identical to SEQ ID NO: 76012
  Description of Artificial Sequence: Synthetic coding sequence

SEQ ID NO: 76014 - DNA, 1065 bp, Artificial Sequence
  Description of Artificial Sequence: Synthetic coding sequence
atgagactggccgtgctgttcagcggcgccctgctgggcctgctggccgcccagggcaccggcaacgactgcccccacaagaagagcgccaccctgctgcccagcttcaccgtgacccccaccgtgaccgagagcaccggcaccaccagccacagaaccaccaagagccacaagaccaccacccacagaaccaccaccaccggcaccaccagccacggccccaccaccgccacccacaaccccaccaccaccagccacggcaacgtgaccgtgcaccccaccagcaacagcaccgccaccagccagggccccagcaccgccacccacagccccgccaccaccagccacggcaacgccaccgtgcaccccaccagcaacagcaccgccaccagccccggcttcaccagcagcgcccaccccgagccccccccccccagccccagccccagccccaccagcaaggagaccatcggcgactacacctggaccaacggcagccagccctgcgtgcacctgcaggcccagatccagatcagagtgatgtacaccacccagggcggcggcgaggcctggggcatcagcgtgctgaaccccaacaagaccaaggtgcagggcagctgcgagggcgcccacccccacctgctgctgagcttcccctacggccacctgagcttcggcttcatgcaggacctgcagcagaaggtggtgtacctgagctacatggccgtggagtacaacgtgagcttcccccacgccgcccagtggaccttcagcgcccagaacgccagcctgagagacctgcaggcccccctgggccagagcttcagctgcagcaacagcagcatcatcctgagccccgccgtgcacctggacctgctgagcctgagactgcaggccgcccagctgccccacaccggcgtgttcggccagagcttcagctgccccagcgacagaagcatcctgctgcccctgatcatcggcctgatcctgctgggcctgctggccctggtgctgatcgccttctgcatcatcagaagaagacccagcgcctaccaggccctgtag

SEQ ID NO: 76015 - DNA, 894 bp, Artificial Sequence
  Description of Artificial Sequence: Synthetic coding sequence
atgagactggccgtgctgttcagcggcgccctgctgggcctgctggccgagagcaccggcaccaccagccacagaaccaccaagagccacaagaccaccacccacagaaccaccaccaccggcaccaccagccacggccccaccaccgccacccacaaccccaccaccaccagccacggcaacgccaccgtgcaccccaccagcaacagcaccgccaccagccccggcttcaccagcagcgcccaccccgagccccccccccccagccccagccccagccccaccagcaaggagaccatcggcgactacacctggaccaacggcagccagccctgcgtgcacctgcaggcccagatccagatcagagtgatgtacaccacccagggcggcggcgaggcctggggcatcagcgtgctgaaccccaacaagaccaaggtgcagggcagctgcgagggcgcccacccccacctgctgctgagcttcccctacggccacctgagcttcggcttcatgcaggacctgcagcagaaggtggtgtacctgagctacatggccgtggagtacaacgtgagcttcccccacgccgcccagtggaccttcagcgcccagaacgccagcctgagagacctgcaggcccccctgggccagagcttcagctgcagcaacagcagcatcatcctgagccccgccgtgcacctggacctgctgagcctgagactgcaggccgcccagctgccccacaccggcgtgttcggccagagcttcagctgccccagcgacagaagcatcctgctgcccctgatcatcggcctgatcctgctgggcctgctggccctggtgctgatcgccttctgcatcatcagaagaagacccagcgcctaccaggccctgtag

SEQ ID NO: 76016 - DNA, 3018 bp, Artificial Sequence
  Description of Artificial Sequence: Synthetic coding sequence
atgatgagcgacgccagcgacatgctggccgccgccctggagcagatggacggcatcatcgccggcagcaaggccctggagtacagcaacggcatcttcgactgccagagccccaccagccccttcatgggcagcctgagagccctgcacctggtggaggacctgagaggcctgctggagatgatggagaccgacgagaaggagggcctgagatgccagatccccgacagcaccgccgagaccctggtggagtggctgcagagccagatgaccaacggccacctgcccggcaacggcgacgtgtaccaggagagactggccagactggagaacgacaaggagagcctggtgctgcaggtgagcgtgctgaccgaccaggtggaggcccagggcgagaagatcagagacctggagttctgcctggaggagcacagagagaaggtgaacgccaccgaggagatgctgcagcaggagctgctgagcagaaccagcctggagacccagaagctggacctgatggccgagatcagcaacctgaagctgaagctgaccgccgtggagaaggacagactggactacgaggacaagttcagagacaccgagggcctgatccaggagatcaacgacctgagactgaaggtgagcgagatggacagcgagagactgcagtacgagaagaagctgaagagcaccaaggacgagctggccagcctgaaggagcagctggaggagaaggagagcgaggtgaagagactgcaggagaagctggtgtgcaagatgaagggcgagggcgtggagatcgtggacagagacgagaacttcaagaagaagctgaaggagaagaacatcgaggtgcagaagatgaagaaggccgtggagagcctgatggccgccaacgaggagaaggacagaaagatcgaggacctgagacagtgcctgaacagatacaagaagatgcaggacaccgtggtgctggcccagggcaagaagggcaaggacggcgagtacgaggagctgctgaacagcagcagcatcagcagcctgctggacgcccagggcttcagcgacctggagaagagccccagccccacccccgtgatgggcagccccagctgcgaccccttcaacaccagcgtgcccgaggagttccacaccaccatcctgcaggtgagcatccccagcctgctgcccgccaccgtgagcatggagaccagcgagaagagcaagctgacccccaagcccgagaccagcttcgaggagaacgacggcaacatcatcctgggcgccaccgtggacacccagctgtgcgacaagctgctgaccagcagcctgcagaagagcagcagcctgggcaacctgaagaaggagaccagcgacggcgagaaggagaccatccagaagaccagcgaggacagagcccccgccgagagcagacccttcggcaccctgccccccagaccccccggccaggacaccagcatggacgacaaccccttcggcaccagaaaggtgagaagcagcttcggcagaggcttcttcaagatcaagagcaacaagagaaccgccagcgcccccaacctggacagaaagagaagcgccagcgcccccaccctggccgagaccgagaaggagaccgccgagcacctggacctggccggcgccagcagcagacccaaggacagccagagaaacagccccttccagatccccccccccagccccgacagcaagaagaagagcagaggcatcatgaagctgttcggcaagctgagaagaagccagagcaccaccttcaaccccgacgacatgagcgagcccgagttcaagagaggcggcaccagagccaccgccggccccagactgggctggagcagagacctgggccagagcaacagcgacctggacatgcccttcgccaagtggaccaaggagcaggtgtgcaactggctgatggagcagggcctgggcagctacctgaacagcggcaagcactggatcgccagcggccagaccctgctgcaggccagccagcaggacctggagaaggagctgggcatcaagcacagcctgcacagaaagaagctgcagctggccctgcaggccctgggcagcgaggaggagaccaaccacggcaagctggacttcaactgggtgaccagatggctggacgacatcggcctgccccagtacaagacccagttcgacgagggcagagtggacggcagaatgctgcactacatgaccgtggacgacctgctgagcctgaaggtggtgagcgtgctgcaccacctgagcatcaagagagccatccaggtgctgagaatcaacaacttcgagcccaactgcctgagaagaagacccagcgacgagaacaccatcgcccccagcgaggtgcagaagtggaccaaccacagagtgatggagtggctgagaagcgtggacctggccgagtacgcccccaacctgagaggcagcggcgtgcacggcggcctgatggtgctggagcccagattcaacgtggagaccatggcccagctgctgaacatcccccccaacaagaccctgctgagaagacacctggccacccacttcaacctgctgatcggcgccgaggcccagcaccagaagagagacgccatggagctgcccgactacgtgctgctgaccgccaccgccaaggtgaagcccaagaagctggccttcagcaacttcggcaacctgagaaagaagaagcaggaggacggcgaggagtacgtgtgccccatggagctgggccaggccagcggcagcgccagcaagaagggcttcaagcccggcctggacatgagactgtacgaggaggacgacctggacagactggagcagatggaggacagcgagggcaccgtgagacagatcggcgccttcagcgagggcatcaacaacctgacccacatgctgaaggaggacgacatgttcaaggacttcgccgccagaagccccagcgccagcatcaccgacgaggacagcaacgtgtag

SEQ ID NO: 76017 - DNA, 495 bp, Artificial Sequence
  Description of Artificial Sequence: Synthetic coding sequence
atgagcagcgagaactgcttcgtggccgagaacagcagcctgcaccccgagagcggccaggagaacgacgccaccagcccccacttcagcaccagacacgagggcagcttccaggtgcccgtgctgtgcgccgtgatgaacgtggtgttcatcaccatcctgatcatcgccctgatcgccctgagcgtgggccagtacaactgccccggccagtacaccttcagcatgcccagcgacagccacgtgagcagctgcagcgaggactgggtgggctaccagagaaagtgctacttcatcagcaccgtgaagagaagctggaccagcgcccagaacgcctgcagcgagcacggcgccaccctggccgtgatcgacagcgagaaggacatgaacttcctgaagagatacgccggcagagaggagcactgggtgggcctgaagaaggagcccggccacccctggaagtggagcaacggcaaggagttcaacaactggtag

SEQ ID NO: 76018 - DNA, 723 bp, Artificial Sequence
  Description of Artificial Sequence: Synthetic coding sequence
atggccggcccccccagactgctgctgctgcccctgctgctggccctggccagaggcctgcccggcgccctggccgcccaggaggtgcagcagagcccccactgcaccaccgtgcccgtgggcgccagcgtgaacatcacctgcagcaccagcggcggcctgagaggcatctacctgagacagctgggcccccagccccaggacatcatctactacgaggacggcgtggtgcccaccaccgacagaagattcagaggcagaatcgacttcagcggcagccaggacaacctgaccatcaccatgcacagactgcagctgagcgacaccggcacctacacctgccaggccatcaccgaggtgaacgtgtacggcagcggcaccctggtgctggtgaccgaggagcagagccagggctggcacagatgcagcgacgccccccccagagccagcgccctgcccgccccccccaccggcagcgccctgcccgacccccagaccgccagcgccctgcccgacccccccgccgccagcgccctgcccgccgccctggccgtgatcagcttcctgctgggcctgggcctgggcgtggcctgcgtgctggccagaacccagatcaagaagctgtgcagctggagagacaagaacagcgccgcctgcgtggtgtacgaggacatgagccacagcagatgcaacaccctgagcagccccaaccagtaccagtag

SEQ ID NO: 76019 - DNA, 1080 bp, Artificial Sequence
  Description of Artificial Sequence: Synthetic coding sequence
atggccgaggccatcacctacgccgacctgagattcgtgaaggcccccctgaagaagagcatcagcagcagactgggccaggaccccggcgccgacgacgacggcgagatcacctacgagaacgtgcaggtgcccgccgtgctgggcgtgcccagcagcctggccagcagcgtgctgggcgacaaggccgccgtgaagagcgagcagcccaccgccagctggagagccgtgaccagccccgccgtgggcagaatcctgccctgcagaaccacctgcctgagatacctgctgctgggcctgctgctgacctgcctgctgctgggcgtgaccgccatctgcctgggcgtgagatacctgcaggtgagccagcagctgcagcagaccaacagagtgctggaggtgaccaacagcagcctgagacagcagctgagactgaagatcacccagctgggccagagcgccgaggacctgcagggcagcagaagagagctggcccagagccaggaggccctgcaggtggagcagagagcccaccaggccgccgagggccagctgcaggcctgccaggccgacagacagaagaccaaggagaccctgcagagcgaggagcagcagagaagagccctggagcagaagctgagcaacatggagaacagactgaagcccttcttcacctgcggcagcgccgacacctgctgccccagcggctggatcatgcaccagaagagctgcttctacatcagcctgaccagcaagaactggcaggagagccagaagcagtgcgagaccctgagcagcaagctggccaccttcagcgagatctacccccagagccacagctactacttcctgaacagcctgctgcccaacggcggcagcggcaacagctactggaccggcctgagcagcaacaaggactggaagctgaccgacgacacccagagaaccagaacctacgcccagagcagcaagtgcaacaaggtgcacaagacctggagctggtggaccctggagagcgagagctgcagaagcagcctgccctacatctgcgagatgaccgccttcagattccccgactag

SEQ ID NO: 76020 - DNA, 363 bp, Artificial Sequence
  Description of Artificial Sequence: Synthetic coding sequence
atggccgaggccatcacctacgccgacctgagattcgtgaaggcccccctgaagaagagcatcagcagcagactgggccaggaccccggcgccgacgacgacggcgagatcacctacgagaacgtgcaggtgcccgccgtgctgggcgtgcccagcagcctggccagcagcgtgctgggcgacaaggccgccgtgaagagcgagcagcccaccgccagctggagagccgtgaccagccccgccgtgggcagaatcctgccctgcgagtgcgcctgcgccggccagcccagaggccaggtgctggcccccgtgcccgccgccgacggcgccggccccagaggcgtgcagctgctgcccggctag

SEQ ID NO: 76021 - DNA, 360 bp, Artificial Sequence
  Description of Artificial Sequence: Synthetic coding sequence
atggccgaggccatcacctacgccgacctgagattcgtgaaggcccccctgaagaagagcatcagcagcagactgggccaggaccccggcgccgacgacgacggcgagatcacctacgagaacgtgcaggtgcccgccgtgctgggcgtgcccagcagcctggccagcagcgtgctgggcgacaaggccgccgtgaagagcgagcagcccaccgccagctggagagccgtgaccagccccgccgtgggcagaatcctgccctgcagaaccacctgcctgagatacctgctgctgggcctgctgctgacctgcctgctgctgggcgtgaccgccatctgcctgggcgtgagatgcgagtag

SEQ ID NO: 76022 - DNA, 1080 bp, Artificial Sequence; identical to SEQ ID NO: 76019
  Description of Artificial Sequence: Synthetic coding sequence

SEQ ID NO: 76023 - DNA, 1080 bp, Artificial Sequence
  Description of Artificial Sequence: Synthetic coding sequence
atgcagaccagaaacccccagagccacggcgagaacggcgccagcccctggagctggggcgacagactgggccccggccccgaccccggcgccgacgacgacggcgagatcacctacgagaacgtgcaggtgcccgccgtgctgggcgtgcccagcagcctggccagcagcgtgctgggcgacaaggccgccgtgaagagcgagcagcccaccgccagctggagagccgtgaccagccccgccgtgggcagaatcctgccctgcagaaccacctgcctgagatacctgctgctgggcctgctgctgacctgcctgctgctgggcgtgaccgccatctgcctgggcgtgagatacctgcaggtgagccagcagctgcagcagaccaacagagtgctggaggtgaccaacagcagcctgagacagcagctgagactgaagatcacccagctgggccagagcgccgaggacctgcagggcagcagaagagagctggcccagagccaggaggccctgcaggtggagcagagagcccaccaggccgccgagggccagctgcaggcctgccaggccgacagacagaagaccaaggagaccctgcagagcgaggagcagcagagaagagccctggagcagaagctgagcaacatggagaacagactgaagcccttcttcacctgcggcagcgccgacacctgctgccccagcggctggatcatgcaccagaagagctgcttctacatcagcctgaccagcaagaactggcaggagagccagaagcagtgcgagaccctgagcagcaagctggccaccttcagcgagatctacccccagagccacagctactacttcctgaacagcctgctgcccaacggcggcagcggcaacagctactggaccggcctgagcagcaacaaggactggaagctgaccgacgacacccagagaaccagaacctacgcccagagcagcaagtgcaacaaggtgcacaagacctggagctggtggaccctggagagcgagagctgcagaagcagcctgccctacatctgcgagatgaccgccttcagattccccgactag

SEQ ID NO: 76024 - DNA, 891 bp, Artificial Sequence
  Description of Artificial Sequence: Synthetic coding sequence
atgcacagaagaagaagcagaagctgcagagaggaccagaagcccgtgatggacgaccagagagacctgatcagcaacaacgagcagctgcccatgctgggcagaagacccggcgcccccgagagcaagtgcagcagaggcgccctgtacaccggcttcagcatcctggtgaccctgctgctggccggccaggccaccaccgcctacttcctgtaccagcagcagggcagactggacaagctgaccgtgaccagccagaacctgcagctggagaacctgagaatgaagctgcccaagccccccaagcccgtgagcaagatgagaatggccacccccctgctgatgcaggccctgcccatgggcgccctgccccagggccccatgcagaacgccaccaagtacggcaacatgaccgaggaccacgtgatgcacctgctgcagaacgccgaccccctgaaggtgtacccccccctgaagggcagcttccccgagaacctgagacacctgaagaacaccatggagaccatcgactggaaggtgttcgagagctggatgcaccactggctgctgttcgagatgagcagacacagcctggagcagaagcccaccgacgccccccccaaggtgctgaccaagtgccaggaggaggtgagccacatccccgccgtgcaccccggcagcttcagacccaagtgcgacgagaacggcaactacctgcccctgcagtgctacggcagcatcggctactgctggtgcgtgttccccaacggcaccgaggtgcccaacaccagaagcagaggccaccacaactgcagcgagagcctggagctggaggaccccagcagcggcctgggcgtgaccaagcaggacctgggccccgtgcccatgtag

SEQ ID NO: 76025 - DNA, 699 bp, Artificial Sequence
  Description of Artificial Sequence: Synthetic coding sequence
atgcacagaagaagaagcagaagctgcagagaggaccagaagcccgtgatggacgaccagagagacctgatcagcaacaacgagcagctgcccatgctgggcagaagacccggcgcccccgagagcaagtgcagcagaggcgccctgtacaccggcttcagcatcctggtgaccctgctgctggccggccaggccaccaccgcctacttcctgtaccagcagcagggcagactggacaagctgaccgtgaccagccagaacctgcagctggagaacctgagaatgaagctgcccaagccccccaagcccgtgagcaagatgagaatggccacccccctgctgatgcaggccctgcccatgggcgccctgccccagggccccatgcagaacgccaccaagtacggcaacatgaccgaggaccacgtgatgcacctgctgcagaacgccgaccccctgaaggtgtacccccccctgaagggcagcttccccgagaacctgagacacctgaagaacaccatggagaccatcgactggaaggtgttcgagagctggatgcaccactggctgctgttcgagatgagcagacacagcctggagcagaagcccaccgacgccccccccaaggagagcctggagctggaggaccccagcagcggcctgggcgtgaccaagcaggacctgggccccgtgcccatgtag

SEQ ID NO: 76026 - DNA, 483 bp, Artificial Sequence
  Description of Artificial Sequence: Synthetic coding sequence
atgcacagaagaagaagcagaagctgcagagaggaccagaagcccgtgatggacgaccagagagacctgatcagcaacaacgagcagctgcccatgctgggcagaagacccggcgcccccgagagcaagtgcagcagaggcgccctgtacaccggcttcagcatcctggtgaccctgctgctggccggccaggccaccaccgcctacttcctgtaccagcagcagggcagactggacaagctgaccgtgaccagccagaacctgcagctggagaacctgagaatgaagctgcccaagccccccaagcccgtgagcaagatgagaatggccacccccctgctgatgcaggccctgcccatgggcgccctgccccagggccccatgcagaacgccaccaagtacggcaacatgaccgaggaccacgtgatgcacctgctgcagagccactggaactggagaaccagactgctgggctgggtgtag

SEQ ID NO: 76027 - DNA, 951 bp, Artificial Sequence
  Description of Artificial Sequence: Synthetic coding sequence
tgaagaagctgcagagaggaccagaagcccgtgatggacgaccagagagacctgatcagcaacaacgagcagctgcccatgctgggcagaagacccggcgcccccgagagcaagtgcagcagaggcgccctgtacaccggcttcagcatcctggtgaccctgctgctggccggccaggccaccaccgcctacttcctgtaccagcagcagggcagactggacaagctgaccgtgaccagccagaacctgcagctggagaacctgagaatgaagctgcccaagccccccaagcccgtgagcaagatgagaatggccacccccctgctgatgcaggccctgcccatgggcgccctgccccagggccccatgcagaacgccaccaagtacggcaacatgaccgaggaccacgtgatgcacctgctgcagaacgccgaccccctgaaggtgtacccccccctgaagggcagcttccccgagaacctgagacacctgaagaacaccatggagaccatcgactggaaggtgttcgagagctggatgcaccactggctgctgttcgagatgagcagacacagcctggagcagaagcccaccgacgccccccccaaggtgctgaccaagtgccaggaggaggtgagccacatccccgccgtgcaccccggcagcttcagacccaagtgcgacgagaacggcaactacctgcccctgcagtgctacggcagcatcggctactgctggtgcgtgttccccaacggcaccgaggtgcccaacaccagaagcagaggccaccacaactgcagcgagagcctggagctggaggaccccagcagcggcctgggcgtgaccaagcaggacctgggccccggcaagggcctggccgagggccacctggtgaccagcagcagcagccccgccggccccgcccccctgtgggccggcgagggcgtgtag

SEQ ID NO: 76028 - DNA, 369 bp, Artificial Sequence
  Description of Artificial Sequence: Synthetic coding sequence
atgcacagaagaagaagcagaagctgcagagaggaccagaagcccgtgatggacgaccagagagacctgatcagcaacaacgagcagctgcccatgctgggcagaagacccggcgcccccgagagcaagtgcagcagaggcgccctgtacaccggcttcagcatcctggtgaccctgctgctggccggccaggccaccaccgcctacttcctgtaccagcagcagggcagactggacaagctgaccgtgaccagccagaacctgcagctggagaacctgagaatgaagctgcccaagccccacgccgagtgccaccaggtgtggcagcacgacagaggcccctgcgacgcccccgcccccgagtgctag

SEQ ID NO: 76029 - DNA, 459 bp, Artificial Sequence
  Description of Artificial Sequence: Synthetic coding sequence
atgcacagaagaagaagcagaagctgcagagaggaccagaagcccgtgatggacgaccagagagacctgatcagcaacaacgagcagctgcccatgctgggcagaagacccggcgcccccgagagcaagtgcagcagaggcgccctgtacaccggcttcagcatcctggtgaccctgctgctggccggccaggccaccaccgcctacttcctgtaccagcagcagggcagactggacaagctgaccgtgaccagccagaacctgcagctggagaacctgagaatgaagctgcccaagccccccaagcccgtgagcaagatgagaatggccacccccctgctgatgcaggccctgcccatgggcgccctgccccagggccccatgcagaacgccaccaagtacggcaacatgaccgaggaccacgtgatgcacctgctgcaggaggtggccaagagctag

SEQ ID NO: 76030 - DNA, 690 bp, Artificial Sequence
  Description of Artificial Sequence: Synthetic coding sequence
atggccagactggccctgagccccgtgcccagccactggatggtggccctgctgctgctgctgagcgccgagcccgtgcccgccgccagaagcgaggacagatacagaaaccccaagggcagcgcctgcagcagaatctggcagagccccagattcatcgccagaaagagaggcttcaccgtgaagatgcactgctacatgaacagcgccagcggcaacgtgagctggctgtggaagcaggagatggacgagaacccccagcagctgaagctggagaagggcagaatggaggagagccagaacgagagcctggccaccctgaccatccagggcatcagattcgaggacaacggcatctacttctgccagcagaagtgcaacaacaccagcgaggtgtaccagggctgcggcaccgagctgagagtgatgggcttcagcaccctggcccagctgaagcagagaaacaccctgaaggacggcatcatcatgatccagaccctgctgatcatcctgttcatcatcgtgcccatcttcctgctgctggacaaggacgacagcaaggccggcatggaggaggaccacacctacgagggcctggacatcgaccagaccgccacctacgaggacatcgtgaccctgagaaccggcgaggtgaagtggagcgtgggcgagcaccccggccaggagtag

SEQ ID NO: 76031 - DNA, 378 bp, Artificial Sequence
  Description of Artificial Sequence: Synthetic coding sequence
atggccagactggccctgagccccgtgcccagccactggatggtggccctgctgctgctgctgagcgccgagcccgtgcccgccgccagaagcgaggacagatacagaaaccccaagggcttcagcaccctggcccagctgaagcagagaaacaccctgaaggacggcatcatcatgatccagaccctgctgatcatcctgttcatcatcgtgcccatcttcctgctgctggacaaggacgacagcaaggccggcatggaggaggaccacacctacgagggcctggacatcgaccagaccgccacctacgaggacatcgtgaccctgagaaccggcgaggtgaagtggagcgtgggcgagcaccccggccaggagtag

SEQ ID NO: 76032 - DNA, 693 bp, Artificial Sequence
  Description of Artificial Sequence: Synthetic coding sequence
atggccagactggccctgagccccgtgcccagccactggatggtggccctgctgctgctgctgagcgccgccgagcccgtgcccgccgccagaagcgaggacagatacagaaaccccaagggcagcgcctgcagcagaatctggcagagccccagattcatcgccagaaagagaggcttcaccgtgaagatgcactgctacatgaacagcgccagcggcaacgtgagctggctgtggaagcaggagatggacgagaacccccagcagctgaagctggagaagggcagaatggaggagagccagaacgagagcctggccaccctgaccatccagggcatcagattcgaggacaacggcatctacttctgccagcagaagtgcaacaacaccagcgaggtgtaccagggctgcggcaccgagctgagagtgatgggcttcagcaccctggcccagctgaagcagagaaacaccctgaaggacggcatcatcatgatccagaccctgctgatcatcctgttcatcatcgtgcccatcttcctgctgctggacaaggacgacagcaaggccggcatggaggaggaccacacctacgagggcctggacatcgaccagaccgccacctacgaggacatcgtgaccctgagaaccggcgaggtgaagtggagcgtgggcgagcaccccggccaggagtag

SEQ ID NO: 76033 - DNA, 711 bp, Artificial Sequence
  Description of Artificial Sequence: Synthetic coding sequence
atgggcgtggagggctgcaccaagtgcatcaagtacctgctgttcgtgttcaacttcgtgttctggctggccggcggcgtgatcctgggcgtggccctgtggctgagacacgacccccagaccaccaacctgctgtacctggagctgggcgacaagcccgcccccaacaccttctacgtgggcatctacatcctgatcgccgtgggcgccgtgatgatgttcgtgggcttcctgggctgctacggcgccatccaggagagccagtgcctgctgggcaccttcttcacctgcctggtgatcctgttcgcctgcgaggtggccgccggcatctggggcttcgtgaacaaggaccagatcgccaaggacgtgaagcagttctacgaccaggccctgcagcaggccgtggtggacgacgacgccaacaacgccaaggccgtggtgaagaccttccacgagaccctggactgctgcggcagcagcaccctgaccgccctgaccaccagcgtgctgaagaacaacctgtgccccagcggcagcaacatcatcagcaacctgttcaaggaggactgccaccagaagatcgacgacctgttcagcggcaagctgtacctgatcggcatcgccgccatcgtggtggccgtgatcatgatcttcgagatgatcctgagcatggtgctgtgctgcggcatcagaaacagcagcgtgtactag

SEQ ID NO: 76034 - DNA, 618 bp, Artificial Sequence
  Description of Artificial Sequence: Synthetic coding sequence
atgagcagaggcctgcagctgctgctgctgagctgcgcctacagcctggcccccgccacccccgaggtgaaggtggcctgcagcgaggacgtggacctgccctgcaccgccccctgggacccccaggtgccctacaccgtgagctgggtgaagctgctggagggcggcgaggagagaatggagaccccccaggaggaccacctgagaggccagcactaccaccagaagggccagaacggcagcttcgacgcccccaacgagagaccctacagcctgaagatcagaaacaccaccagctgcaacagcggcacctacagatgcaccctgcaggaccccgacggccagagaaacctgagcggcaaggtgatcctgagagtgaccggctgccccgcccagagaaaggaggagaccttcaagaagtacagagccgagatcgtgctgctgctggccctggtgatcttctacctgaccctgatcatcttcacctgcaagttcgccagactgcagagcatcttccccgacttcagcaaggccggcatggagagagccttcctgcccgtgaccagccccaacaagcacctgggcctggtgaccccccacaagaccgagctggtgtag

SEQ ID NO: 76035 - DNA, 351 bp, Artificial Sequence
  Description of Artificial Sequence: Synthetic coding sequence
atggacccccagtgcaccatgggcctgagcaacatcctgttcgtgatggccttcctgctgagcgagctggaggacccccagcccccccccgaccacatcccctggatcaccgccgtgctgcccaccgtgatcatctgcgtgatggtgttctgcctgatcctgtggaagtggaagaagaagaagagacccagaaacagctacaagtgcggcaccaacaccatggagagagaggagagcgagcagaccaagaagagagagaagatccacatccccgagagaagcgacgaggcccagagagtgttcaagagcagcaagaccagcagctgcgacaagagcgacacctgcttctag

SEQ ID NO: 76036 - DNA, 990 bp, Artificial Sequence
  Description of Artificial Sequence: Synthetic coding sequence
atggacccccagtgcaccatgggcctgagcaacatcctgttcgtgatggccttcctgctgagcggcgccgcccccctgaagatccaggcctacttcaacgagaccgccgacctgccctgccagttcgccaacagccagaaccagagcctgagcgagctggtggtgttctggcaggaccaggagaacctggtgctgaacgaggtgtacctgggcaaggagaagttcgacagcgtgcacagcaagtacatgggcagaaccagcttcgacagcgacagctggaccctgagactgcacaacctgcagatcaaggacaagggcctgtaccagtgcatcatccaccacaagaagcccaccggcatgatcagaatccaccagatgaacagcgagctgagcgtgctggccaacttcagccagcccgagatcgtgcccatcagcaacatcaccgagaacgtgtacatcaacctgacctgcagcagcatccacggctaccccgagcccaagaagatgagcgtgctgctgagaaccaagaacagcaccatcgagtacgacggcgtgatgcagaagagccaggacaacgtgaccgagctgtacgacgtgagcatcagcctgagcgtgagcttccccgacgtgaccagcaacatgaccatcttctgcatcctggagaccgacaagaccagactgctgagcagccccttcagcatcgagctggaggacccccagcccccccccgaccacatcccctggatcaccgccgtgctgcccaccgtgatcatctgcgtgatggtgttctgcctgatcctgtggaagtggaagaagaagaagagacccagaaacagctacaagtgcggcaccaacaccatggagagagaggagagcgagcagaccaagaagagagagaagatccacatccccgagagaagcgacgaggcccagagagtgttcaagagcagcaagaccagcagctgcgacaagagcgacacctgcttctag

SEQ ID NO: 76037 - DNA, 972 bp, Artificial Sequence
  Description of Artificial Sequence: Synthetic coding sequence
atgggcctgagcaacatcctgttcgtgatggccttcctgctgagcggcgccgcccccctgaagatccaggcctacttcaacgagaccgccgacctgccctgccagttcgccaacagccagaaccagagcctgagcgagctggtggtgttctggcaggaccaggagaacctggtgctgaacgaggtgtacctgggcaaggagaagttcgacagcgtgcacagcaagtacatgggcagaaccagcttcgacagcgacagctggaccctgagactgcacaacctgcagatcaaggacaagggcctgtaccagtgcatcatccaccacaagaagcccaccggcatgatcagaatccaccagatgaacagcgagctgagcgtgctggccaacttcagccagcccgagatcgtgcccatcagcaacatcaccgagaacgtgtacatcaacctgacctgcagcagcatccacggctaccccgagcccaagaagatgagcgtgctgctgagaaccaagaacagcaccatcgagtacgacggcgtgatgcagaagagccaggacaacgtgaccgagctgtacgacgtgagcatcagcctgagcgtgagcttccccgacgtgaccagcaacatgaccatcttctgcatcctggagaccgacaagaccagactgctgagcagccccttcagcatcgagctggaggacccccagcccccccccgaccacatcccctggatcaccgccgtgctgcccaccgtgatcatctgcgtgatggtgttctgcctgatcctgtggaagtggaagaagaagaagagacccagaaacagctacaagtgcggcaccaacaccatggagagagaggagagcgagcagaccaagaagagagagaagatccacatccccgagagaagcgacgaggcccagagagtgttcaagagcagcaagaccagcagctgcgacaagagcgacacctgcttctag

SEQ ID NO: 76038 - DNA, 504 bp, Artificial Sequence
  Description of Artificial Sequence: Synthetic coding sequence
atgggcctgagcaacatcctgttcgtgatggccttcctgctgagcggcgccgcccccctgaagatccaggcctacttcaacgagaccgccgacctgccctgccagttcgccaacagccagaaccagagcctgagcgagctggtggtgttctggcaggaccaggagaacctggtgctgaacgaggtgtacctgggcaaggagaagttcgacagcgtgcacagcaagtacatgggcagaaccagcttcgacagcgacagctggaccctgagactgcacaacctgcagatcaaggacaagggcctgtaccagtgcatcatccaccacaagaagcccaccggcatgatcagaatccaccagatgaacagcgagctgagcgtgctggccaacttcagccagcccgagatcgtgcccatcagcaacatcaccgagaacgtgtacatcaacctgacctgcagcagcatccacggctaccccgagcccaagaagatgagcgtgctgctgtag

SEQ ID NO: 76039 - DNA, 744 bp, Artificial Sequence
  Description of Artificial Sequence: Synthetic coding sequence
atgggcagaaccagcttcgacagcgacagctggaccctgagactgcacaacctgcagatcaaggacaagggcctgtaccagtgcatcatccaccacaagaagcccaccggcatgatcagaatccaccagatgaacagcgagctgagcgtgctggccaacttcagccagcccgagatcgtgcccatcagcaacatcaccgagaacgtgtacatcaacctgacctgcagcagcatccacggctaccccgagcccaagaagatgagcgtgctgctgagaaccaagaacagcaccatcgagtacgacggcgtgatgcagaagagccaggacaacgtgaccgagctgtacgacgtgagcatcagcctgagcgtgagcttccccgacgtgaccagcaacatgaccatcttctgcatcctggagaccgacaagaccagactgctgagcagccccttcagcatcgagctggaggacccccagcccccccccgaccacatcccctggatcaccgccgtgctgcccaccgtgatcatctgcgtgatggtgttctgcctgatcctgtggaagtggaagaagaagaagagacccagaaacagctacaagtgcggcaccaacaccatggagagagaggagagcgagcagaccaagaagagagagaagatccacatccccgagagaagcgacgaggcccagagagtgttcaagagcagcaagaccagcagctgcgacaagagcgacacctgcttctag

SEQ ID NO: 76040 - DNA, 654 bp, Artificial Sequence
  Description of Artificial Sequence: Synthetic coding sequence
atggacccccagtgcaccatgggcctgagcaacatcctgttcgtgatggccttcctgctgagcgccaacttcagccagcccgagatcgtgcccatcagcaacatcaccgagaacgtgtacatcaacctgacctgcagcagcatccacggctaccccgagcccaagaagatgagcgtgctgctgagaaccaagaacagcaccatcgagtacgacggcgtgatgcagaagagccaggacaacgtgaccgagctgtacgacgtgagcatcagcctgagcgtgagcttccccgacgtgaccagcaacatgaccatcttctgcatcctggagaccgacaagaccagactgctgagcagccccttcagcatcgagctggaggacccccagcccccccccgaccacatcccctggatcaccgccgtgctgcccaccgtgatcatctgcgtgatggtgttctgcctgatcctgtggaagtggaagaagaagaagagacccagaaacagctacaagtgcggcaccaacaccatggagagagaggagagcgagcagaccaagaagagagagaagatccacatccccgagagaagcgacgaggcccagagagtgttcaagagcagcaagaccagcagctgcgacaagagcgacacctgcttctag

SEQ ID NO: 76041 - DNA, 732 bp, Artificial Sequence
  Description of Artificial Sequence: Synthetic coding sequence
atgagacccagactgtggctgctgctggccgcccagctgaccgtgctgcacggcaacagcgtgctgcagcagacccccgcctacatcaaggtgcagaccaacaagatggtgatgctgagctgcgaggccaagatcagcctgagcaacatgagaatctactggctgagacagagacaggcccccagcagcgacagccaccacgagttcctggccctgtgggacagcgccaagggcaccatccacggcgaggaggtggagcaggagaagatcgccgtgttcagagacgccagcagattcatcctgaacctgaccagcgtgaagcccgaggacagcggcatctacttctgcatgatcgtgggcagccccgagctgaccttcggcaagggcacccagctgagcgtggtggacttcctgcccaccaccgcccagcccaccaagaagagcaccctgaagaagagagtgtgcagactgcccagacccgagacccagaagggccccctgtgcagccccatcaccctgggcctgctggtggccggcgtgctggtgctgctggtgagcctgggcgtggccatccacctgtgctgcagaagaagaagagccagactgagattcatgaagcagccccagggcgagggcatcagcggcaccttcgtgccccagtgcctgcacggctactacagcaacaccaccaccagccagaagctgctgaacccctggatcctgaagacctag

SEQ ID NO: 76042 - DNA, 642 bp, Artificial Sequence
  Description of Artificial Sequence: Synthetic coding sequence
atgagacccagactgtggctgctgctggccgcccagctgaccgtgctgcacggcaacagcgtgctgcagcagacccccgcctacatcaaggtgcagaccaacaagatggtgatgctgagctgcgaggccaagatcagcctgagcaacatgagaatctactggctgagacagagacaggcccccagcagcgacagccaccacgagttcctggccctgtgggacagcgccaagggcaccatccacggcgaggaggtggagcaggagaagatcgccgtgttcagagacgccagcagattcatcctgaacctgaccagcgtgaagcccgaggacagcggcatctacttctgcatgatcgtgggcagccccgagctgaccttcggcaagggcacccagctgagcgtggtggacttcctgcccaccaccgcccagcccaccaagaagagcaccctgaagaagagagtgtgcagactgcccagacccgagacccagaagggcagaagaagaagagccagactgagattcatgaagcagccccagggcgagggcatcagcggcaccttcgtgccccagtgcctgcacggctactacagcaacaccaccaccagccagaagctgctgaacccctggatcctgaagacctag

SEQ ID NO: 76043 - DNA, 633 bp, Artificial Sequence
  Description of Artificial Sequence: Synthetic coding sequence
atgagacccagactgtggctgctgctggccgcccagctgaccgtgctgcacggcaacagcgtgctgcagcagacccccgcctacatcaaggtgcagaccaacaagatggtgatgctgagctgcgaggccaagatcagcctgagcaacatgagaatctactggctgagacagagacaggcccccagcagcgacagccaccacgagttcctggccctgtgggacagcgccaagggcaccatccacggcgaggaggtggagcaggagaagatcgccgtgttcagagacgccagcagattcatcctgaacctgaccagcgtgaagcccgaggacagcggcatctacttctgcatgatcgtgggcagccccgagctgaccttcggcaagggcacccagctgagcgtggtggacttcctgcccaccaccgcccagcccaccaagaagagcaccctgaagaagagagtgtgcagactgcccagacccgagacccagaagggccccctgtgcagccccatcaccctgggcctgctggtggccggcgtgctggtgctgctggtgagcctgggcgtggccatccacctgtgctgcagaagaagaagagccagactgagattcatgaagcagttctacaagtag

SEQ ID NO: 76044 - DNA, 666 bp, Artificial Sequence
  Description of Artificial Sequence: Synthetic coding sequence
atgagacccagactgtggctgctgctggccgcccagctgaccgtgctgcacggcaacagcgtgctgcagcagacccccgcctacatcaaggtgcagaccaacaagatggtgatgctgagctgcgaggccaagatcagcctgagcaacatgagaatctactggctgagacagagacaggcccccagcagcgacagccaccacgagttcctggccctgtgggacagcgccaagggcaccatccacggcgaggaggtggagcaggagaagatcgccgtgttcagagacgccagcagattcatcctgaacctgaccagcgtgaagcccgaggacagcggcatctacttctgcatgatcgtgggcagccccgagctgaccttcggcaagggcacccagctgagcgtggtggacttcctgcccaccaccgcccagcccaccaagaagagcaccctgaagaagagagtgtgcagactgcccagacccgagacccagaagggccccctgtgcagccccatcaccctgggcctgctggtggccggcgtgctggtgctgctggtgagcctgggcgtggccatccacctgtgctgcagaagaagaagagccagactgagattcatgaagcagctgagactgcaccccctggagaagtgcagcagaatggactactag

SEQ ID NO: 76045 - DNA, 597 bp, Artificial Sequence
  Description of Artificial Sequence: Synthetic coding sequence
atgagacccagactgtggctgctgctggccgcccagctgaccgtgctgcacggcaacagcgtgctgcagcagacccccgcctacatcaaggtgcagaccaacaagatggtgatgctgagctgcgaggccaagatcagcctgagcaacatgagaatctactggctgagacagagacaggcccccagcagcgacagccaccacgagttcctggccctgtgggacagcgccaagggcaccatccacggcgaggaggtggagcaggagaagatcgccgtgttcagagacgccagcagattcatcctgaacctgaccagcgtgaagcccgaggacagcggcatctacttctgcatgatcgtgggcagccccgagctgaccttcggcaagggcacccagctgagcgtggtggacttcctgcccaccaccgcccagcccaccaagaagagcaccctgaagaagagagtgtgcagactgcccagacccgagacccagaagggcctgaagggcaaggtgtaccaggagcccctgagccccaacgcctgcatggacaccaccgccatcctgcagccccacagaagctgcctgacccacggcagctag

SEQ ID NO: 76046 - DNA, 93 bp, Artificial Sequence
  Description of Artificial Sequence: Synthetic coding sequence
atgagacccagactgtggctgctgctggccgcccagctgaccggcagaagaagaagagccagactgagattcatgaagcagctgtacaagtag

SEQ ID NO: 76047 - DNA, 624 bp, Artificial Sequence
  Description of Artificial Sequence: Synthetic coding sequence
atgagacccagactgtggctgctgctggccgcccagctgaccgtgctgcacggcaacagcgtgctgcagcagacccccgcctacatcaaggtgcagaccaacaagatggtgatgctgagctgcgaggccaagatcagcctgagcaacatgagaatctactggctgagacagagacaggcccccagcagcgacagccaccacgagttcctggccctgtgggacagcgccaagggcaccatccacggcgaggaggtggagcaggagaagatcgccgtgttcagagacgccagcagattcatcctgaacctgaccagcgtgaagcccgaggacagcggcatctacttctgcatgatcgtgggcagccccgagctgaccttcggcaagggcacccagctgagcgtggtggacttcctgcccaccaccgcccagcccaccaagaagagcaccctgaagaagagagtgtgcagactgcccagacccgagacccagaagggccccctgtgcagccccatcaccctgggcctgctggtggccggcgtgctggtgctgctggtgagcctgggcgtggccatccacctgtgctgcagaagaagaagagccagactgagattcatgaagcagtag

SEQ ID NO: 76048 - DNA, 153 bp, Artificial Sequence
  Description of Artificial Sequence: Synthetic coding sequence
gagagaggcagagagagaagagtgaagctgagattcagcgccagaccccagggcgagggcatcagcggcaccttcgtgccccagtgcctgcacggctactacagcaacaccaccaccagccagaagctgctgaacccctggatcctgaagtag

SEQ ID NO: 76049 - DNA, 687 bp, Artificial Sequence
  Description of Artificial Sequence: Synthetic coding sequence
atgcccgtgaagggcggcaccaagtgcatcaagtacctgctgttcggcttcaacttcatcttctggctggccggcatcgccgtgctggccatcggcctgtggctgagattcgacagccagaccaagagcatcttcgagcaggagaccaacaacaacaacagcagcttctacaccggcgtgtacatcctgatcggcgccggcgccctgatgatgctggtgggcttcctgggctgctgcggcgccgtgcaggagagccagtgcatgctgggcctgttcttcggcttcctgctggtgatcttcgccatcgagatcgccgccgccatctggggctacagccacaaggacgaggtgatcaaggaggtgcaggagttctacaaggacacctacaacaagctgaagaccaaggacgagccccagagagagaccctgaaggccatccactacgccctgaactgctgcggcctggccggcggcgtggagcagttcatcagcgacatctgccccaagaaggacgtgctggagaccttcaccgtgaagagctgccccgacgccatcaaggaggtgttcgacaacaagttccacatcatcggcgccgtgggcatcggcatcgccgtggtgatgatcttcggcatgatcttcagcatgatcctgtgctgcgccatcagaagaaacagagagatggtgtag

SEQ ID NO: 76050 - DNA, 480 bp, Artificial Sequence
  Description of Artificial Sequence: Synthetic coding sequence
atgatgctggtgggcttcctgggctgctgcggcgccgtgcaggagagccagtgcatgctgggcctgttcttcggcttcctgctggtgatcttcgccatcgagatcgccgccgccatctggggctacagccacaaggacgaggtgatcaaggaggtgcaggagttctacaaggacacctacaacaagctgaagaccaaggacgagccccagagagagaccctgaaggccatccactacgccctgaactgctgcggcctggccggcggcgtggagcagttcatcagcgacatctgccccaagaaggacgtgctggagaccttcaccgtgaagagctgccccgacgccatcaaggaggtgttcgacaacaagttccacatcatcggcgccgtgggcatcggcatcgccgtggtgatgatcttcggcatgatcttcagcatgatcctgtgctgcgccatcagaagaaacagagagatggtgtag

SEQ ID NO: 76051 - DNA, 687 bp, Artificial Sequence; identical to SEQ ID NO: 76049
  Description of Artificial Sequence: Synthetic coding sequence

SEQ ID NO: 76052 - DNA, 687 bp, Artificial Sequence
  Description of Artificial Sequence: Synthetic coding sequence
atgcccgtgaagggcggcaccaagtgcatcaagtacctgctgttcggcttcaacttcatcttctggctggccggcatcgccgtgctggccatcggcctgtggctgagattcgacagccagaccaagagcatcttcgagcaggagaccaacaacaacaacagcagcttctacaccggcgtgtacatcctgatcggcgccggcgccctgatgatgctggtgggcttcctgggctgctgcggcgccgtgcaggagagccagtgcatgctgggcctggccaccaagagaaccatgttcccccccttcctggaggaccacgtgtgcttcttcagcctgaacccccagttcttcggcttcctgctggtgatcttcgccatcgagatcgccgccgccatctggggctacagccacaaggacgaggtgatcaaggaggtgcaggagttctacaaggacacctacaacaagctgaagaccaaggacgagccccagagagagaccctgaaggccatccactacgccctgaactgctgcggcctggccggcggcgtggagcagttcatcagcgacatctgccccaagaaggacgtgctggagaccttcaccgtgaagagctgccccgacgccatcaaggaggtgttcgacaacaagttccacatcatcggcgccgtgggcatcggcatcgccgtgtag

SEQ ID NO: 76053 - DNA, 546 bp, Artificial Sequence
  Description of Artificial Sequence: Synthetic coding sequence
atgcccgtgaagggcggcaccaagtgcatcaagtacctgctgttcggcttcaacttcatcttctggctggccggcatcgccgtgctggccatcggcctgtggctgagattcgacagccagaccaagagcatcttcgagcaggagaccaacaacaacaacagcagcttctacaccggcgtgtacatcctgatcggcgccggcgccctgatgatgctggtgggcttcctgggctgctgcggcgccgtgcaggagagccagtgcatgctgggcctgttcttcggcttcctgctggtgatcttcgccatcgagatcgccgccgccatctggggctacagccacaaggacgaggtgatcaaggaggtgcaggagttctacaaggacacctacaacaagctgaagaccaaggacgagccccagagagagaccctgaaggccatccactacgccctgaacctgtggttcggctggggcagaggcaccgtgtacctgagacacctgccccaggagggcagaaccagaaacctgcacagagaggtgctgagctag

SEQ ID NO: 76054 - DNA, 426 bp, Artificial Sequence
  Description of Artificial Sequence: Synthetic coding sequence
atgctgggcctgttcttcggcttcctgctggtgatcttcgccatcgagatcgccgccgccatctggggctacagccacaaggacgaggtgatcaaggaggtgcaggagttctacaaggacacctacaacaagctgaagaccaaggacgagccccagagagagaccctgaaggccatccactacgccctgaactgctgcggcctggccggcggcgtggagcagttcatcagcgacatctgccccaagaaggacgtgctggagaccttcaccgtgaagagctgccccgacgccatcaaggaggtgttcgacaacaagttccacatcatcggcgccgtgggcatcggcatcgccgtggtgatgatcttcggcatgatcttcagcatgatcctgtgctgcgccatcagaagaaacagagagatggtgtag

SEQ ID NO: 76055 - DNA, 1758 bp, Artificial Sequence
  Description of Artificial Sequence: Synthetic coding sequence
atggagaagaagtggaagtactgcgccgtgtactacatcatccagatccacttcgtgaagggcgtgtgggagaagaccgtgaacaccgaggagaacgtgtacgccaccctgggcagcgacgtgaacctgacctgccagacccagaccgtgggcttcttcgtgcagatgcagtggagcaaggtgaccaacaagatcgacctgatcgccgtgtaccacccccagtacggcttctactgcgcctacggcagaccctgcgagagcctggtgaccttcaccgagacccccgagaacggcagcaagtggaccctgcacctgagaaacatgagctgcagcgtgagcggcagatacgagtgcatgctggtgctgtaccccgagggcatccagaccaagatctacaacctgctgatccagacccacgtgaccgccgacgagtggaacagcaaccacaccatcgagatcgagatcaaccagaccctggagatcccctgcttccagaacagcagcagcaagatcagcagcgagttcacctacgcctggagcgtggagaacagcagcaccgacagctgggtgctgctgagcaagggcatcaaggaggacaacggcacccaggagaccctgatcagccagaaccacctgatcagcaacagcaccctgctgaaggacagagtgaagctgggcaccgactacagactgcacctgagccccgtgcagatcttcgacgacggcagaaagttcagctgccacatcagagtgggccccaacaagatcctgagaagcagcaccaccgtgaaggtgttcgccaagcccgagatccccgtgatcgtggagaacaacagcaccgacgtgctggtggagagaagattcacctgcctgctgaagaacgtgttccccaaggccaacatcacctggttcatcgacggcagcttcctgcacgacgagaaggagggcatctacatcaccaacgaggagagaaagggcaaggacggcttcctggagctgaagagcgtgctgaccagagtgcacagcaacaagcccgcccagagcgacaacctgaccatctggtgcatggccctgagccccgtgcccggcaacaaggtgtggaacatcagcagcgagaagatcaccttcctgctgggcagcgagatcagcagcaccgacccccccctgagcgtgaccgagagcaccctggacacccagcccagccccgccagcagcgtgagccccgccagataccccgccaccagcagcgtgaccctggtggacgtgagcgccctgagacccaacaccaccccccagcccagcaacagcagcatgaccaccagaggcttcaactacccctggaccagcagcggcaccgacaccaagaagagcgtgagcagaatccccagcgagacctacagcagcagccccagcggcgccggcagcaccctgcacgacaacgtgttcaccagcaccgccagagccttcagcgaggtgcccaccaccgccaacggcagcaccaagaccaaccacgtgcacatcaccggcatcgtggtgaacaagcccaaggacggcatgagctggcccgtgatcgtggccgccctgctgttctgctgcatgatcctgttcggcctgggcgtgagaaagtggtgccagtaccagaaggagatcatggagagacccccccccttcaagcccccccccccccccatcaagtacacctgcatccaggagcccaacgagagcgacctgccctaccacgagatggagaccctgtag

SEQ ID NO: 76056 - DNA, 1710 bp, Artificial Sequence
  Description of Artificial Sequence: Synthetic coding sequence
atggagaagaagtggaagtactgcgccgtgtactacatcatccagatccacttcgtgaagggcgtgtgggagaagaccgtgaacaccgaggagaacgtgtacgccaccctgggcagcgacgtgaacctgacctgccagacccagaccgtgggcttcttcgtgcagatgcagtggagcaaggtgaccaacaagatcgacctgatcgccgtgtaccacccccagtacggcttctactgcgcctacggcagaccctgcgagagcctggtgaccttcaccgagacccccgagaacggcagcaagtggaccctgcacctgagaaacatgagctgcagcgtgagcggcagatacgagtgcatgctggtgctgtaccccgagggcatccagaccaagatctacaacctgctgatccagacccacgtgaccgccgacgagtggaacagcaaccacaccatcgagatcgagatcaaccagaccctggagatcccctgcttccagaacagcagcagcaagatcagcagcgagttcacctacgcctggagcgtggaggacaacggcacccaggagaccctgatcagccagaaccacctgatcagcaacagcaccctgctgaaggacagagtgaagctgggcaccgactacagactgcacctgagccccgtgcagatcttcgacgacggcagaaagttcagctgccacatcagagtgggccccaacaagatcctgagaagcagcaccaccgtgaaggtgttcgccaagcccgagatccccgtgatcgtggagaacaacagcaccgacgtgctggtggagagaagattcacctgcctgctgaagaacgtgttccccaaggccaacatcacctggttcatcgacggcagcttcctgcacgacgagaaggagggcatctacatcaccaacgaggagagaaagggcaaggacggcttcctggagctgaagagcgtgctgaccagagtgcacagcaacaagcccgcccagagcgacaacctgaccatctggtgcatggccctgagccccgtgcccggcaacaaggtgtggaacatcagcagcgagaagatcaccttcctgctgggcagcgagatcagcagcaccgacccccccctgagcgtgaccgagagcaccctggacacccagcccagccccgccagcagcgtgagccccgccagataccccgccaccagcagcgtgaccctggtggacgtgagcgccctgagacccaacaccaccccccagcccagcaacagcagcatgaccaccagaggcttcaactacccctggaccagcagcggcaccgacaccaagaagagcgtgagcagaatccccagcgagacctacagcagcagccccagcggcgccggcagcaccctgcacgacaacgtgttcaccagcaccgccagagccttcagcgaggtgcccaccaccgccaacggcagcaccaagaccaaccacgtgcacatcaccggcatcgtggtgaacaagcccaaggacggcatgagctggcccgtgatcgtggccgccctgctgttctgctgcatgatcctgttcggcctgggcgtgagaaagtggtgccagtaccagaaggagatcatggagagacccccccccttcaagcccccccccccccccatcaagtacacctgcatccaggagcccaacgagagcgacctgccctaccacgagatggagaccctgtag

SEQ ID NO: 76057 - DNA, 2508 bp, Artificial Sequence
  Description of Artificial Sequence: Synthetic coding sequence
atgggcggcagagtgttcctggccttctgcgtgtggctgaccctgcccggcgccgagacccaggacagcagaggctgcgccagatggtgcccccagaacagcagctgcgtgaacgccaccgcctgcagatgcaaccccggcttcagcagcttcagcgagatcatcaccacccccaccgagacctgcgacgacatcaacgagtgcgccacccccagcaaggtgagctgcggcaagttcagcgactgctggaacaccgagggcagctacgactgcgtgtgcagccccggctacgagcccgtgagcggcgccaagaccttcaagaacgagagcgagaacacctgccaggacgtggacgagtgccagcagaaccccagactgtgcaagagctacggcacctgcgtgaacaccctgggcagctacacctgccagtgcctgcccggcttcaagttcatccccgaggaccccaaggtgtgcaccgacgtgaacgagtgcaccagcggccagaacccctgccacagcagcacccactgcctgaacaacgtgggcagctaccagtgcagatgcagacccggctggcagcccatccccggcagccccaacggccccaacaacaccgtgtgcgaggacgtggacgagtgcagcagcggccagcaccagtgcgacagcagcaccgtgtgcttcaacaccgtgggcagctacagctgcagatgcagacccggctggaagcccagacacggcatccccaacaaccagaaggacaccgtgtgcgaggacatgaccttcagcacctggacccccccccccggcgtgcacagccagaccctgagcagattcttcgacaaggtgcaggacctgggcagagacagcaagaccagcagcgccgaggtgaccatccagaacgtgatcaagctggtggacgagctgatggaggcccccggcgacgtggaggccctggccccccccgtgagacacctgatcgccacccagctgctgagcaacctggaggacatcatgagaatcctggccaagagcctgcccaagggccccttcacctacatcagccccagcaacaccgagctgaccctgatgatccaggagagaggcgacaagaacgtgaccatgggccagagcagcgccagaatgaagctgaactgggccgtggccgccggcgccgaggaccccggccccgccgtggccggcatcctgagcatccagaacatgaccaccctgctggccaacgccagcctgaacctgcacagcaagaagcaggccgagctggaggagatctacgagagcagcatcagaggcgtgcagctgagaagactgagcgccgtgaacagcatcttcctgagccacaacaacaccaaggagctgaacagccccatcctgttcgccttcagccacctggagagcagcgacggcgaggccggcagagacccccccgccaaggacgtgatgcccggccccagacaggagctgctgtgcgccttctggaagagcgacagcgacagaggcggccactgggccaccgagggctgccaggtgctgggcagcaagaacggcagcaccacctgccagtgcagccacctgagcagcttcgccatcctgatggcccactacgacgtggaggactggaagctgaccctgatcaccagagtgggcctggccctgagcctgttctgcctgctgctgtgcatcctgaccttcctgctggtgagacccatccagggcagcagaaccaccatccacctgcacctgtgcatctgcctgttcgtgggcagcaccatcttcctggccggcatcgagaacgagggcggccaggtgggcctgagatgcagactggtggccggcctgctgcactactgcttcctggccgccttctgctggatgagcctggagggcctggagctgtacttcctggtggtgagagtgttccagggccagggcctgagcaccagatggctgtgcctgatcggctacggcgtgcccctgctgatcgtgggcgtgagcgccgccatctacagcaagggctacggcagacccagatactgctggctggacttcgagcagggcttcctgtggagcttcctgggccccgtgaccttcatcatcctgtgcaacgccgtgatcttcgtgaccaccgtgtggaagctgacccagaagttcagcgagatcaaccccgacatgaagaagctgaagaaggccagagccctgaccatcaccgccatcgcccagctgttcctgctgggctgcacctgggtgttcggcctgttcatcttcgacgacagaagcctggtgctgacctacgtgttcaccatcctgaactgcctgcagggcgccttcctgtacctgctgcactgcctgctgaacaagaaggtgagagaggagtacagaaagtgggcctgcctggtggccggcggcagcaagtacagcgagttcaccagcaccaccagcggcaccggccacaaccagaccagagccctgagagccagcgagagcggcatctag

SEQ ID NO: 76058 - DNA, 2361 bp, Artificial Sequence
  Description of Artificial Sequence: Synthetic coding sequence
atgggcggcagagtgttcctggccttctgcgtgtggctgaccctgcccggcgccgagacccaggacagcagaggctgcgccagatggtgcccccagaacagcagctgcgtgaacgccaccgcctgcagatgcaaccccggcttcagcagcttcagcgagatcatcaccacccccaccgagacctgcgacgacatcaacgagtgcgccacccccagcaaggtgagctgcggcaagttcagcgactgctggaacaccgagggcagctacgactgcgtgtgcagccccggctacgagcccgtgagcggcgccaagaccttcaagaacgagagcgagaacacctgccaggacgtggacgagtgccagcagaaccccagactgtgcaagagctacggcacctgcgtgaacaccctgggcagctacacctgccagtgcctgcccggcttcaagttcatccccgaggaccccaaggtgtgcaccgacgtggacgagtgcagcagcggccagcaccagtgcgacagcagcaccgtgtgcttcaacaccgtgggcagctacagctgcagatgcagacccggctggaagcccagacacggcatccccaacaaccagaaggacaccgtgtgcgaggacatgaccttcagcacctggacccccccccccggcgtgcacagccagaccctgagcagattcttcgacaaggtgcaggacctgggcagagacagcaagaccagcagcgccgaggtgaccatccagaacgtgatcaagctggtggacgagctgatggaggcccccggcgacgtggaggccctggccccccccgtgagacacctgatcgccacccagctgctgagcaacctggaggacatcatgagaatcctggccaagagcctgcccaagggccccttcacctacatcagccccagcaacaccgagctgaccctgatgatccaggagagaggcgacaagaacgtgaccatgggccagagcagcgccagaatgaagctgaactgggccgtggccgccggcgccgaggaccccggccccgccgtggccggcatcctgagcatccagaacatgaccaccctgctggccaacgccagcctgaacctgcacagcaagaagcaggccgagctggaggagatctacgagagcagcatcagaggcgtgcagctgagaagactgagcgccgtgaacagcatcttcctgagccacaacaacaccaaggagctgaacagccccatcctgttcgccttcagccacctggagagcagcgacggcgaggccggcagagacccccccgccaaggacgtgatgcccggccccagacaggagctgctgtgcgccttctggaagagcgacagcgacagaggcggccactgggccaccgagggctgccaggtgctgggcagcaagaacggcagcaccacctgccagtgcagccacctgagcagcttcgccatcctgatggcccactacgacgtggaggactggaagctgaccctgatcaccagagtgggcctggccctgagcctgttctgcctgctgctgtgcatcctgaccttcctgctggtgagacccatccagggcagcagaaccaccatccacctgcacctgtgcatctgcctgttcgtgggcagcaccatcttcctggccggcatcgagaacgagggcggccaggtgggcctgagatgcagactggtggccggcctgctgcactactgcttcctggccgccttctgctggatgagcctggagggcctggagctgtacttcctggtggtgagagtgttccagggccagggcctgagcaccagatggctgtgcctgatcggctacggcgtgcccctgctgatcgtgggcgtgagcgccgccatctacagcaagggctacggcagacccagatactgctggctggacttcgagcagggcttcctgtggagcttcctgggccccgtgaccttcatcatcctgtgcaacgccgtgatcttcgtgaccaccgtgtggaagctgacccagaagttcagcgagatcaaccccgacatgaagaagctgaagaaggccagagccctgaccatcaccgccatcgcccagctgttcctgctgggctgcacctgggtgttcggcctgttcatcttcgacgacagaagcctggtgctgacctacgtgttcaccatcctgaactgcctgcagggcgccttcctgtacctgctgcactgcctgctgaacaagaaggtgagagaggagtacagaaagtgggcctgcctggtggccggcggcagcaagtacagcgagttcaccagcaccaccagcggcaccggccacaaccagaccagagccctgagagccagcgagagcggcatctag

SEQ ID NO: 76059 - DNA, 2229 bp, Artificial Sequence
  Description of Artificial Sequence: Synthetic coding sequence
atgggcggcagagtgttcctggccttctgcgtgtggctgaccctgcccggcgccgagacccaggacagcagaggctgcgccagatggtgcccccagaacagcagctgcgtgaacgccaccgcctgcagatgcaaccccggcttcagcagcttcagcgagatcatcaccacccccaccgagacctgcgacgacatcaacgagtgcgccacccccagcaaggtgagctgcggcaagttcagcgactgctggaacaccgagggcagctacgactgcgtgtgcagccccggctacgagcccgtgagcggcgccaagaccttcaagaacgagagcgagaacacctgccaggacgtggacgagtgcagcagcggccagcaccagtgcgacagcagcaccgtgtgcttcaacaccgtgggcagctacagctgcagatgcagacccggctggaagcccagacacggcatccccaacaaccagaaggacaccgtgtgcgaggacatgaccttcagcacctggacccccccccccggcgtgcacagccagaccctgagcagattcttcgacaaggtgcaggacctgggcagagacagcaagaccagcagcgccgaggtgaccatccagaacgtgatcaagctggtggacgagctgatggaggcccccggcgacgtggaggccctggccccccccgtgagacacctgatcgccacccagctgctgagcaacctggaggacatcatgagaatcctggccaagagcctgcccaagggccccttcacctacatcagccccagcaacaccgagctgaccctgatgatccaggagagaggcgacaagaacgtgaccatgggccagagcagcgccagaatgaagctgaactgggccgtggccgccggcgccgaggaccccggccccgccgtggccggcatcctgagcatccagaacatgaccaccctgctggccaacgccagcctgaacctgcacagcaagaagcaggccgagctggaggagatctacgagagcagcatcagaggcgtgcagctgagaagactgagcgccgtgaacagcatcttcctgagccacaacaacaccaaggagctgaacagccccatcctgttcgccttcagccacctggagagcagcgacggcgaggccggcagagacccccccgccaaggacgtgatgcccggccccagacaggagctgctgtgcgccttctggaagagcgacagcgacagaggcggccactgggccaccgagggctgccaggtgctgggcagcaagaacggcagcaccacctgccagtgcagccacctgagcagcttcgccatcctgatggcccactacgacgtggaggactggaagctgaccctgatcaccagagtgggcctggccctgagcctgttctgcctgctgctgtgcatcctgaccttcctgctggtgagacccatccagggcagcagaaccaccatccacctgcacctgtgcatctgcctgttcgtgggcagcaccatcttcctggccggcatcgagaacgagggcggccaggtgggcctgagatgcagactggtggccggcctgctgcactactgcttcctggccgccttctgctggatgagcctggagggcctggagctgtacttcctggtggtgagagtgttccagggccagggcctgagcaccagatggctgtgcctgatcggctacggcgtgcccctgctgatcgtgggcgtgagcgccgccatctacagcaagggctacggcagacccagatactgctggctggacttcgagcagggcttcctgtggagcttcctgggccccgtgaccttcatcatcctgtgcaacgccgtgatcttcgtgaccaccgtgtggaagctgacccagaagttcagcgagatcaaccccgacatgaagaagctgaagaaggccagagccctgaccatcaccgccatcgcccagctgttcctgctgggctgcacctgggtgttcggcctgttcatcttcgacgacagaagcctggtgctgacctacgtgttcaccatcctgaactgcctgcagggcgccttcctgtacctgctgcactgcctgctgaacaagaaggtgagagaggagtacagaaagtgggcctgcctggtggccggcggcagcaagtacagcgagttcaccagcaccaccagcggcaccggccacaaccagaccagagccctgagagccagcgagagcggcatctag

SEQ ID NO: 76060 - DNA, 2358 bp, Artificial Sequence
  Description of Artificial Sequence: Synthetic coding sequence
ggcggcagaatcatgagagccttctgcgtgtggctgaccctgcccggcgccgagacccaggacagcagaggctgcgccagatggtgcccccagaacagcagctgcgtgaacgccaccgcctgcagatgcaaccccggcttcagcagcttcagcgagatcatcaccacccccaccgagacctgcgacgacatcaacgagtgcgccacccccagcaaggtgagctgcggcaagttcagcgactgctggaacaccgagggcagctacgactgcgtgtgcagccccggctacgagcccgtgagcggcgccaagaccttcaagaacgagagcgagaacacctgccaggacgtggacgagtgccagcagaaccccagactgtgcaagagctacggcacctgcgtgaacaccctgggcagctacacctgccagtgcctgcccggcttcaagttcatccccgaggaccccaaggtgtgcaccgacgtggacgagtgcagcagcggccagcaccagtgcgacagcagcaccgtgtgcttcaacaccgtgggcagctacagctgcagatgcagacccggctggaagcccagacacggcatccccaacaaccagaaggacaccgtgtgcgaggacatgaccttcagcacctggacccccccccccggcgtgcacagccagaccctgagcagattcttcgacaaggtgcaggacctgggcagagacagcaagaccagcagcgccgaggtgaccatccagaacgtgatcaagctggtggacgagctgatggaggcccccggcgacgtggaggccctggccccccccgtgagacacctgatcgccacccagctgctgagcaacctggaggacatcatgagaatcctggccaagagcctgcccaagggccccttcacctacatcagccccagcaacaccgagctgaccctgatgatccaggagagaggcgacaagaacgtgaccatgggccagagcagcgccagaatgaagctgaactgggccgtggccgccggcgccgaggaccccggccccgccgtggccggcatcctgagcatccagaacatgaccaccctgctggccaacgccagcctgaacctgcacagcaagaagcaggccgagctggaggagatctacgagagcagcatcagaggcgtgcagctgagaagactgagcgccgtgaacagcatcttcctgagccacaacaacaccaaggagctgaacagccccatcctgttcgccttcagccacctggagagcagcgacggcgaggccggcagagacccccccgccaaggacgtgatgcccggccccagacaggagctgctgtgcgccttctggaagagcgacagcgacagaggcggccactgggccaccgagggctgccaggtgctgggcagcaagaacggcagcaccacctgccagtgcagccacctgagcagcttcgccatcctgatggcccactacgacgtggaggactggaagctgaccctgatcaccagagtgggcctggccctgagcctgttctgcctgctgctgtgcatcctgaccttcctgctggtgagacccatccagggcagcagaaccaccatccacctgcacctgtgcatctgcctgttcgtgggcagcaccatcttcctggccggcatcgagaacgagggcggccaggtgggcctgagatgcagactggtggccggcctgctgcactactgcttcctggccgccttctgctggatgagcctggagggcctggagctgtacttcctggtggtgagagtgttccagggccagggcctgagcaccagatggctgtgcctgatcggctacggcgtgcccctgctgatcgtgggcgtgagcgccgccatctacagcaagggctacggcagacccagatactgctggctggacttcgagcagggcttcctgtggagcttcctgggccccgtgaccttcatcatcctgtgcaacgccgtgatcttcgtgaccaccgtgtggaagctgacccagaagttcagcgagatcaaccccgacatgaagaagctgaagaaggccagagccctgaccatcaccgccatcgcccagctgttcctgctgggctgcacctgggtgttcggcctgttcatcttcgacgacagaagcctggtgctgacctacgtgttcaccatcctgaactgcctgcagggcgccttcctgtacctgctgcactgcctgctgaacaagaaggtgagagaggagtacagaaagtgggcctgcctggtggccggcggcagcaagtacagcgagttcaccagcaccaccagcggcaccggccacaaccagaccagagccctgagagccagcgagagcggcatctag

SEQ ID NO: 76061 - DNA, 297 bp, Artificial Sequence
  Description of Artificial Sequence: Synthetic coding sequence
atgagcgtgagactgcacgtgcccagcggcagcagaggcagcgagctgagcgccctgatccaggccatcggcgccagcaccagcggcaagcccaagtgcttcgtgtgcatcctgagaagcggcctgagcgtggccctgagcctgagcgtgtacttcctgctgctgttcagcagaaccagaggcggcggccacggcgagccccccgagtgccagagaagagccagctgcagcgcctacagcttcagagagatcgaggactgcagacagaagcagcccagaagatggcagcagggctag

SEQ ID NO: 76062 - DNA, 231 bp, Artificial Sequence
  Description of Artificial Sequence: Synthetic coding sequence
atggccagaggcgccgccctggccctgctgctgttcggcctgctgggcgtgctggtggccgcccccggcttcggcgacctgagactgcaggccgccagaggcggcagacccggcgtggcctgccacagccacgccctgagacccggccccaagttcggcatcgccagaagcctgagacccggctggtggggcgagggcaaggagaagctggagaagaacttcgagccctag

SEQ ID NO: 76063 - DNA, 534 bp, Artificial Sequence
  Description of Artificial Sequence: Synthetic coding sequence
atggccagaggcgccgccctggccctgctgctgttcggcctgctgggcgtgctggtggccgcccccgacggcggcttcgacctgagcgacgccctgcccgacaacgagaacaagaagcccaccgccatccccaagaagcccagcgccggcgacgacttcgacctgggcgacgccgtggtggacggcgagaacgacgaccccagaccccccaacccccccaagcccatgcccaaccccaaccccaaccaccccagcagcagcggcagcttcagcgacgccgacctggccgacggcgtgagcggcggcgagggcaagggcggcagcgacggcggcggcagccacagaaaggagggcgaggaggccgacgcccccggcgtgatccccggcatcgtgggcgccgtggtggtggccgtggccggcgccatcagcagcttcatcgcctaccagaagaagaagctgtgcttcaaggagaacggccagctggccggcagcctgggcccctgcatcggcatcagaagagaggccgacggctag

SEQ ID NO: 76064 - DNA, 510 bp, Artificial Sequence
  Description of Artificial Sequence: Synthetic coding sequence
atggccagaggcgccgccctggccctgctgctgttcggcctgctgggcgtgctggtggccgcccccgacggcggcttcgacctgagcgacgccctgcccggcgacgacttcgacctgggcgacgccgtggtggacggcgagaacgacgaccccagaccccccaacccccccaagcccatgcccaaccccaaccccaaccaccccagcagcagcggcagcttcagcgacgccgacctggccgacggcgtgagcggcggcgagggcaagggcggcagcgacggcggcggcagccacagaaaggagggcgaggaggccgacgcccccggcgtgatccccggcatcgtgggcgccgtggtggtggccgtggccggcgccatcagcagcttcatcgcctaccagaagaagaagctgtgcttcaaggagaacgccgagcagggcgaggtggacatggagagccacagaaacgccaacgccgagcccgccgtgcagagaaccctgctggagaagtag

SEQ ID NO: 76065 - DNA, 558 bp, Artificial Sequence
  Description of Artificial Sequence: Synthetic coding sequence
atggccagaggcgccgccctggccctgctgctgttcggcctgctgggcgtgctggtggccgcccccgacggcggcttcgacctgagcgacgccctgcccgacaacgagaacaagaagcccaccgccatccccaagaagcccagcgccggcgacgacttcgacctgggcgacgccgtggtggacggcgagaacgacgaccccagaccccccaacccccccaagcccatgcccaaccccaaccccaaccaccccagcagcagcggcagcttcagcgacgccgacctggccgacggcgtgagcggcggcgagggcaagggcggcagcgacggcggcggcagccacagaaaggagggcgaggaggccgacgcccccggcgtgatccccggcatcgtgggcgccgtggtggtggccgtggccggcgccatcagcagcttcatcgcctaccagaagaagaagctgtgcttcaaggagaacgccgagcagggcgaggtggacatggagagccacagaaacgccaacgccgagcccgccgtgcagagaaccctgctggagaagtag

SEQ ID NO: 76066 - DNA, 606 bp, Artificial Sequence
  Description of Artificial Sequence: Synthetic coding sequence
agaagatggggcagacccgccggcacccccggcgccagcagcctgcccggcagaaccagatgcgcccacggcggccccggccccgaggaggcccccaccttcagccccaccctgttcctggagcccttccagagagagaagagcgccttcgtggtgggcgtggccaacagctacatgtggggcggcctgggcagagacggcggcttcgacctgagcgacgccctgcccgacaacgagaacaagaagcccaccgccatccccaagaagcccagcgccggcgacgacttcgacctgggcgacgccgtggtggacggcgagaacgacgaccccagaccccccaacccccccaagcccatgcccaaccccaaccccaaccaccccagcagcagcggcagcttcagcgacgccgacctggccgacggcgtgagcggcggcgagggcaagggcggcagcgacggcggcggcagccacagaaaggagggcgaggaggccgacgcccccggcgtgatccccggcatcgtgggcgccgtggtggtggccgtggccggcgccatcagcagcttcatcgcctaccagaagaagaagctgtgcttcaaggagaactag

SEQ ID NO: 76067 - DNA, 438 bp, Artificial Sequence
  Description of Artificial Sequence: Synthetic coding sequence
atggtggcctggagaagcgccttcctggtgtgcctggccttcagcctggccaccctggtgcagagaggcagcggcgacttcgacgacttcaacctggaggacgccgtgaaggagaccagcagcgtgaagcccgccctgggcatgtaccacaagctggacggcctgaagcagcagaacttcatcctgagcctgttctggatgctggaggtgctgtaccagggcgtgggctgggccaccttcagcctgaaggccctgggcaagaacctgagcctgaccttccccaccagcggcggcagcagatgcagcctggtgtgcggctgcatcacccccatcagcgccagcgtggtgacctggtgcagccccttctgcgtgagcctgctgagcctgaccaagatgctggtgagcggcttcaaggcccacctggacaaccccggctag

SEQ ID NO: 76068 - DNA, 573 bp, Artificial Sequence
  Description of Artificial Sequence: Synthetic coding sequence
atggtggcctggagaagcgccttcctggtgtgcctggccttcagcctggccaccctggtgcagagaggcagcggcgacttcgacgacttcaacctggaggacgccgtgaaggagaccagcagcgtgaagagaaacgacttcgacctggccgacgccctggacgacagaaacgacagagacgacggcagaagaaagcccatcgccggcggcggcggcttcagcgacaaggacctggaggacatcgtgggcggcggcgagtacaagcccgacaagggcaagggcgacggcagatacggcagcaacgacgaccccggcagcggcatggtggccgagcccggcaccatcgccggcgtggccagcgccctggccatggccctgatcggcgccgtgagcagctacatcagctaccagcagaagaagttctgcttcagcatccagcagggcctgaacgccgactacgtgaagggcgagaacctggaggccgtggtgtgcgaggagccccaggtgaagtacagcaccctgcacacccagagcgccgagcccccccccccccccgagcccgccagaatctag

SEQ ID NO: 76069 - DNA, 789 bp, Artificial Sequence
  Description of Artificial Sequence: Synthetic coding sequence
atggtggcctggagaagcgccttcctggtgtgcctggccttcagcctggccaccctggtgcagagaggcagcggcgacttcgacgacttcaacctggaggacgccgtgaaggagaccagcagcgtgaagcagccctgggaccacaccaccaccaccaccaccaacagacccggcaccaccagagcccccgccaagccccccggcagcggcctggacctggccgacgccctggacgaccaggacgacggcagaagaaagcccggcatcggcggcagagagagatggaaccacgtgaccaccaccaccaagagacccgtgaccaccagagcccccgccaacaccctgggcaacgacttcgacctggccgacgccctggacgacagaaacgacagagacgacggcagaagaaagcccatcgccggcggcggcggcttcagcgacaaggacctggaggacatcgtgggcggcggcgagtacaagcccgacaagggcaagggcgacggcagatacggcagcaacgacgaccccggcagcggcatggtggccgagcccggcaccatcgccggcgtggccagcgccctggccatggccctgatcggcgccgtgagcagctacatcagctaccagcagaagaagttctgcttcagcatccagcagggcctgaacgccgactacgtgaagggcgagaacctggaggccgtggtgtgcgaggagccccaggtgaagtacagcaccctgcacacccagagcgccgagcccccccccccccccgagcccgccagaatctag

SEQ ID NO: 76070 - DNA, 474 bp, Artificial Sequence
  Description of Artificial Sequence: Synthetic coding sequence
gagaccagcagcgtgaagcagccctgggaccacaccaccaccaccaccaccaacagacccggcaccaccagagcccccgccaagccccccggcagcggcctggacctggccgacgccctggacgaccaggacgacggcagaagaaagcccggcatcggcggcagagagagatggaaccacgtgaccaccaccaccaagagacccgtgaccaccagagcccccgccaacaccctgggcaacgacttcgacctggccgacgccctggacgacagaaacgacagagacgacggcagaagaaagcccatcgccggcggcggcggcttcagcgacaaggacctggaggacatcgtgggcggcggcgagtacaagcccgacaagggcaagggcgacggcagatacggcagcaacgacgaccccggcagcggcggcttcctgaaccccgaggcccccgtgggccacgtgaagggcaagtag

SEQ ID NO: 76071 - DNA, 570 bp, Artificial Sequence
  Description of Artificial Sequence: Synthetic coding sequence
atggtggcctggagaagcgccttcctggtgtgcctggccttcagcctggccaccctggtgcagagaggcagcggcgacttcgacgacttcaacctggaggacgccgtgaaggagaccagcagcgtgaagcagccctgggaccacaccaccaccaccaccaccaacagacccggcaccaccagagcccccgccaagccccccggcagcggcctggacctggccgacgccctggacgaccaggacgacggcagaagaaagcccggcatcggcggcagaggcgacggcagatacggcagcaacgacgaccccggcagcggcatggtggccgagcccggcaccatcgccggcgtggccagcgccctggccatggccctgatcggcgccgtgagcagctacatcagctaccagcagaagaagttctgcttcagcatccagcagggcctgaacgccgactacgtgaagggcgagaacctggaggccgtggtgtgcgaggagccccaggtgaagtacagcaccctgcacacccagagcgccgagcccccccccccccccgagcccgccagaatctag

SEQ ID NO: 76072 - DNA, 819 bp, Artificial Sequence
  Description of Artificial Sequence: Synthetic coding sequence
atggtggcctggagaagcgccttcctggtgtgcctggccttcagcctggccaccctggtgcagagaggcagcggcgacttcgacgacttcaacctggaggacgccgtgaaggagaccagcagcgtgaagcagccctgggaccacaccaccaccaccaccaccaacagacccggcaccaccagagcccccgccaagccccccggccccaccgagggcagcggcctggacctggccgacgccctggacgaccaggacgacggcagaagaaagcccggcatcggcggcagagagagatggaaccacgtgaccaccaccaccaagagacccgtgaccaccagagcccccgccaacaccctgggcaacgacttcgacctggccgacgccctggacgacagaaacgacagagacgacggcagaagaaagcccatcgccggcggcggcggcttcagcgacaaggacctggaggacatcgtgggcggcggcgagtacaagcccgacaagggcaagggcgacggcagatacggcagcaacgacgaccccggcagcggcatggtggccgagcccggcaccatcgccggcgtggccagcgccctggccatggccctgatcggcgccgtgagcagctacatcagctaccagcagaagaagttctgcttcagcatccagcacgccgccgccggccaggagggcctgaacgccgactacgtgaagggcgagaacctggaggccgtggtgtgcgaggagccccaggtgaagtacagcaccctgcacacccagagcgccgagcccccccccccccccgagcccgccagaatctag

SEQ ID NO: 76073 - DNA, 642 bp, Artificial Sequence
  Description of Artificial Sequence: Synthetic coding sequence
atggtggcctggagaagcgccttcctggtgtgcctggccttcagcctggccaccctggtgcagagaggcagcggcgacttcgacgacttcaacctggaggacgccgtgaaggagaccagcagcgtgaagcagagatggaaccacgtgaccaccaccaccaagagacccgtgaccaccagagcccccgccaacaccctgggcaacgacttcgacctggccgacgccctggacgacagaaacgacagagacgacggcagaagaaagcccatcgccggcggcggcggcttcagcgacaaggacctggaggacatcgtgggcggcggcgagtacaagcccgacaagggcaagggcgacggcagatacggcagcaacgacgaccccggcagcggcatggtggccgagcccggcaccatcgccggcgtggccagcgccctggccatggccctgatcggcgccgtgagcagctacatcagctaccagcagaagaagttctgcttcagcatccagcagggcctgaacgccgactacgtgaagggcgagaacctggaggccgtggtgtgcgaggagccccaggtgaagtacagcaccctgcacacccagagcgccgagcccccccccccccccgagcccgccagaatctag

SEQ ID NO: 76074 - DNA, 1785 bp, Artificial Sequence
  Description of Artificial Sequence: Synthetic coding sequence
atggccgccgagagcggcgagctgatcggcgcctgcgagttcatgaaggacagactgtacttcgccaccctgagaaacagacccaagagcaccgtgaacacccactacttcagcatcgacgaggagctggtgtacgagaacttctacgccgacttcggccccctgaacctggccatggtgtacagatactgctgcaagctgaacaagaagctgaagagctacagcctgagcagaaagaagatcgtgcactacacctgcttcgaccagagaaagagagccaacgccgccttcctgatcggcgcctacgccgtgatctacctgaagaagacccccgaggaggcctacagagccctgctgagcggcagcaaccccccctacctgcccttcagagacgccagcttcggcaactgcacctacaacctgaccatcctggactgcctgcagggcatcagaaagggcctgcagcacggcttcttcgacttcgagaccttcgacgtggacgagtacgagcactacgagagagtggagaacggcgacttcaactggatcgtgcccggcaagttcctggccttcagcggcccccaccccaagagcaagatcgagaacggctaccccctgcacgcccccgaggcctacttcccctacttcaagaagcacaacgtgaccgccgtggtgagactgaacaagaagatctacgaggccaagagattcaccgacgccggcttcgagcactacgacctgttcttcatcgacggcagcacccccagcgacaacatcgtgagaagattcctgaacatctgcgagaacaccgagggcgccatcgccgtgcactgcaaggccggcctgggcagaaccggcaccctgatcgcctgctacgtgatgaagcactacagattcacccacgccgagatcatcgcctggatcagaatctgcagacccggcagcatcatcggcccccagcagcacttcctggaggagaagcaggccagcctgtgggtgcagggcgacatcttcagaagcaagctgaagaacagacccagcagcgagggcagcatcaacaagatcctgagcggcctggacgacatgagcatcggcggcaacctgagcaagacccagaacatggagagattcggcgaggacaacctggaggacgacgacgtggagatgaagaacggcatcacccagggcgacaagctgagagccctgaagagccagagacagcccagaaccagccccagctgcgccttcagaagcgacgacaccaagggccaccccagagccgtgagccagcccttcagactgagcagcagcctgcagggcagcgccgtgaccctgaagaccagcaagatggccctgagccccagcgccaccgccaagagaatcaacagaaccagcctgagcagcggcgccaccgtgagaagcttcagcatcaacagcagactggccagcagcctgggcaacctgaacgccgccaccgacgaccccgagaacaagaagaccagcagcagcagcaaggccggcttcaccgccagccccttcaccaacctgctgaacggcagcagccagcccaccaccagaaactaccccgagctgaacaacaaccagtacaacagaagcagcaacagcaacggcggcaacctgaacagcccccccggcccccacagcgccaagaccgaggagcacaccaccatcctgagacccagctacaccggcctgagcagcagcagcgccagattcctgagcagaagcatccccagcctgcagagcgagtacgtgcactactag

SEQ ID NO: 76075 - DNA, 1872 bp, Artificial Sequence
  Description of Artificial Sequence: Synthetic coding sequence
atggccgccgagagcggcgagctgatcggcgcctgcgagttcatgaaggacagactgtacttcgccaccctgagaaacagacccaagagcaccgtgaacacccactacttcagcatcgacgaggagctggtgtacgagaacttctacgccgacttcggccccctgaacctggccatggtgtacagatactgctgcaagctgaacaagaagctgaagagctacagcctgagcagaaagaagatcgtgcactacacctgcttcgaccagagaaagagagccaacgccgccttcctgatcggcgcctacgccgtgatctacctgaagaagacccccgaggaggcctacagagccctgctgagcggcagcaaccccccctacctgcccttcagagacgccagcttcggcaactgcacctacaacctgaccatcctggactgcctgcagggcatcagaaagggcctgcagcacggcttcttcgacttcgagaccttcgacgtggacgagtacgagcactacgagagagtggagaacggcgacttcaactggatcgtgcccggcaagttcctggccttcagcggcccccaccccaagagcaagatcgagaacggctaccccctgcacgcccccgaggcctacttcccctacttcaagaagcacaacgtgaccgccgtggtgagactgaacaagaagatctacgaggccaagagattcaccgacgccggcttcgagcactacgacctgttcttcatcgacggcagcacccccagcgacaacatcgtgagaagattcctgaacatctgcgagaacaccgagggcgccatcgccgtgcactgcaaggccggcctgggcagaaccggcaccctgatcgcctgctacgtgatgaagcactacagattcacccacgccgagatcatcgcctggatcagaatctgcagacccggcagcatcatcggcccccagcagcacttcctggaggagaagcaggccagcctgtgggtgcagggcgacatcttcagaagcaagctgaagaacagacccagcagcgagggcagcatcaacaagatcctgagcggcctggacgacatgagcatcggcggcaacctgagcaagacccagaacatggagagattcggcgaggacaacctggaggacgacgacgtggagatgaagaacggcatcacccagggcgacaagctgagagccctgaagagccagagacagcccagaaccagccccagctgcgccttcagaagcgacgacaccaagggccaccccagagccgtgagccagcccttcagactgagcagcagcctgcagggcagcgccgtgaccctgaagaccagcaagatggccctgagccccagcgccaccgccaagagaatcaacagaaccagcctgagcagcggcgccaccgtgagaagcttcagcatcaacagcagactggccagcagcctgggcaacctgaacgccgccaccgacgaccccgagaacaagaagaccagcagcagcagcaaggccggcttcaccgccagccccttcaccaacctgctgaacggcagcagccagcccaccaccagaaactaccccgagctgaacaacaaccagtacaacagaagcagcaacagcaacggcggcaacctgaacagcccccccggcccccacagcgccaagaccgaggagcacaccaccatcctgagacccagctacaccggcctgagcagcagcagcgccagattcctgagcagaagcatccccgtgagcgcccagacccccccccccggcccccagaaccccgagtgcaacttctgcgccctgcccagccagcccagactgccccccaagaagttcaacagcgccaaggaggccttctag

SEQ ID NO: 76076 - DNA, 1152 bp, Artificial Sequence
  Description of Artificial Sequence: Synthetic coding sequence
atggccgccgagagcggcgagctgatcggcgcctgcgagttcatgaaggacagactgtacttcgccaccctgagaaacagacccaagagcaccgtgaacacccactacttcagcatcgacgaggagctggtgtacgagaacttctacgccgacttcggccccctgaacctggccatggtgtacagatactgctgcaagctgaacaagaagctgaagagctacagcctgagcagaaagaagatcgtgcactacacctgcttcgaccagagaaagagagccaacgccgccttcctgatcggcgcctacgccgtgatctacctgaagaagacccccgaggaggcctacagagccctgctgagcggcagcaaccccccctacctgcccttcagagacgccagcttcggcaactgcacctacaacctgaccatcctggactgcctgcagggcatcagaaagggcctgcagcacggcttcttcgacttcgagaccttcgacgtggacgagtacgagcactacgagagagtggagaacggcgacttcaactggatcgtgcccggcaagttcctggccttcagcggcccccaccccaagagcaagatcgagaacggctaccccctgcacgcccccgaggcctacttcccctacttcaagaagcacaacgtgaccgccgtggtgagactgaacaagaagatctacgaggccaagagattcaccgacgccggcttcgagcactacgacctgttcttcatcgacggcagcacccccagcgacaacatcgtgagaagattcctgaacatctgcgagaacaccgagggcgccatcgccgtgcactgcaaggccggcctgggcagaaccggcaccctgatcgcctgctacgtgatgaagcactacagattcacccacgccgagatcatcgcctggatcagaatctgcagacccggcagcatcatcggcccccagcagcacttcctggaggagaagcaggccagcctgtgggtgcagggcgacatcttcagaagcaagctgaagaacagacccagcagcgagggcagcatcaacaagatcctgagcggcctggacgacatgagcatcggcggcaacctgagcaagacccagaacatggagagattcggcgaggtgagcttcccctag

SEQ ID NO: 76077 - DNA, 576 bp, Artificial Sequence
  Description of Artificial Sequence: Synthetic coding sequence
atggccgccgagagcggcgagctgatcggcgcctgcgagttcatgaaggacagactgtacttcgccaccctgagaaacagacccaagagcaccgtgaacacccactacttcagcatcgacgaggagctggtgtacgagaacttctacgccgacttcggccccctgaacctggccatggtgtacagatactgctgcaagctgaacaagaagctgaagagctacagcctgagcagaaagaagatcgtgcactacacctgcttcgaccagagaaagagagccaacgccgccttcctgatcggcgcctacgccgtgatctacctgaagaagacccccgaggaggcctacagagccctgctgagcggcagcaaccccccctacctgcccttcagagacgccagcttcggcaactgcacctacaacctgaccatcctggactgcctgcagggcatcagaaagggcctgcagcacggcttcttcgacttcgagaccttcgacgtggacgagtacgagcactacgaggtgatcctgttcacccccctgaagcccaccttcctgatcagcaagagcatcatgtag

SEQ ID NO: 76078 - DNA, 822 bp, Artificial Sequence
  Description of Artificial Sequence: Synthetic coding sequence
atgggcaacttcctgagcagagagaacaaggtgcaggtgatcagcgagagcgacagactgtacttcgccaccctgagaaacagacccaagagcaccgtgaacacccactacttcagcatcgacgaggagctggtgtacgagaacttctacgccgacttcggccccctgaacctggccatggtgtacagatactgctgcaagctgaacaagaagctgaagagctacagcctgagcagaaagaagatcgtgcactacacctgcttcgaccagagaaagagagccaacgccgccttcctgatcggcgcctacgccgtgatctacctgaagaagacccccgaggaggcctacagagccctgctgagcggcagcaaccccccctacctgcccttcagagacgccagcttcggcaactgcacctacaacctgaccatcctggactgcctgcagggcatcagaaagggcctgcagcacggcttcttcgacttcgagaccttcgacgtggacgagtacgagcactacgagagagtggagaacggcgacttcaactggatcgtgcccggcaagttcctggccttcagcggcccccaccccaagagcaagatcgagaacggctaccccctgcacgcccccgaggcctacttcccctacttcaagaagcacaacgtgaccgccgtggtgagactgaacaagaagatctacgaggccaagagattcaccgacgccggcttcgagcactacgacctgttcttcatcgacggcagcacccccagcgacaacatcgtgagaagattcctgaacatctgcgagaacaccgagggctag

SEQ ID NO: 76079 - DNA, 1698 bp, Artificial Sequence
  Description of Artificial Sequence: Synthetic coding sequence
atggtgtacagatactgctgcaagctgaacaagaagctgaagagctacagcctgagcagaaagaagatcgtgcactacacctgcttcgaccagagaaagagagccaacgccgccttcctgatcggcgcctacgccgtgatctacctgaagaagacccccgaggaggcctacagagccctgctgagcggcagcaaccccccctacctgcccttcagagacgccagcttcggcaactgcacctacaacctgaccatcctggactgcctgcagggcatcagaaagggcctgcagcacggcttcttcgacttcgagaccttcgacgtggacgagtacgagcactacgagagagtggagaacggcgacttcaactggatcgtgcccggcaagttcctggccttcagcggcccccaccccaagagcaagatcgagaacggctaccccctgcacgcccccgaggcctacttcccctacttcaagaagcacaacgtgaccgccgtggtgagactgaacaagaagatctacgaggccaagagattcaccgacgccggcttcgagcactacgacctgttcttcatcgacggcagcacccccagcgacaacatcgtgagaagattcctgaacatctgcgagaacaccgagggcgccatcgccgtgcactgcaaggccggcctgggcagaaccggcaccctgatcgcctgctacgtgatgaagcactacagattcacccacgccgagatcatcgcctggatcagaatctgcagacccggcagcatcatcggcccccagcagcacttcctggaggagaagcaggccagcctgtgggtgcagggcgacatcttcagaagcaagctgaagaacagacccagcagcgagggcagcatcaacaagatcctgagcggcctggacgacatgagcatcggcggcaacctgagcaagacccagaacatggagagattcggcgaggacaacctggaggacgacgacgtggagatgaagaacggcatcacccagggcgacaagctgagagccctgaagagccagagacagcccagaaccagccccagctgcgccttcagaagcgacgacaccaagggccaccccagagccgtgagccagcccttcagactgagcagcagcctgcagggcagcgccgtgaccctgaagaccagcaagatggccctgagccccagcgccaccgccaagagaatcaacagaaccagcctgagcagcggcgccaccgtgagaagcttcagcatcaacagcagactggccagcagcctgggcaacctgaacgccgccaccgacgaccccgagaacaagaagaccagcagcagcagcaaggccggcttcaccgccagccccttcaccaacctgctgaacggcagcagccagcccaccaccagaaactaccccgagctgaacaacaaccagtacaacagaagcagcaacagcaacggcggcaacctgaacagcccccccggcccccacagcgccaagaccgaggagcacaccaccatcctgagacccagctacaccggcctgagcagcagcagcgccagattcctgagcagaagcatccccgtgagcgcccagacccccccccccggcccccagaaccccgagtgcaacttctgcgccctgcccagccagcccagactgccccccaagaagttcaacagcgccaaggaggccttctag

SEQ ID NO: 76080 - DNA, 1833 bp, Artificial Sequence
  Description of Artificial Sequence: Synthetic coding sequence
atggccgccgagagcggcgagctgatcggcgcctgcgagttcatgaaggacagactgtacttcgccaccctgagaaacagacccaagagcaccgtgaacacccactacttcagcatcgacgaggagctggtgtacgagaacttctacgccgacttcggccccctgaacctggccatggtgtacagatactgctgcaagctgaacaagaagctgaagagctacagcctgagcagaaagaagatcgtgcactacacctgcttcgaccagagaaagagagccaacgccgccttcctgatcggcgcctacgccgtgatctacctgaagaagacccccgaggaggcctacagagccctgctgagcggcagcaaccccccctacctgcccttcagagacgccagcttcggcaactgcacctacaacctgaccatcctggactgcctgcagggcatcagaaagggcctgcagcacggcttcttcgacttcgagaccttcgacgtggacgagtacgagcactacgagagagtggagaacggcgacttcaactggatcgtgcccggcaagttcctggccttcagcggcccccaccccaagagcaagatcgagaacggctaccccctgcacgcccccgaggcctacttcccctacttcaagaagcacaacgtgaccgccgtggtgagactgaacaagaagatctacgaggccaagagattcaccgacgccggcttcgagcactacgacctgttcttcatcgacggcagcacccccagcgacaacatcgtgagaagattcctgaacatctgcgagaacaccgagggcgccatcgccgtgcactgcaaggccggcctgggcagaaccggcaccctgatcgcctgctacgtgatgaagcactacagattcacccacgccgagatcatcgcctggatcagaatctgcagacccggcagcatcatcggcccccagcagcacttcctggaggagaagcaggccagcctgtgggtgcagggcgacatcttcagaagcaagctgaagaacagacccagcagcgagggcagcatcaacaagatcctgagcggcctggacgacatgagcatcggcggcaacctgagcaagacccagaacatggagagattcggcgaggacaacctggaggacgacgacgtggagatgaagaacggcatcacccagggcgacaagctgagagccctgaagagccagagacagcccagaaccagccccagctgcgccttcagaagcgacgacaccaagggccaccccagagccgtgagccagcccttcagactgagcagcagcctgcagggcagcgccgtgaccctgaagaccagcaagatggccctgagccccagcgccaccgccaagagaatcaacagaaccagcctgagcagcggcgccaccgtgagaagcttcagcatcaacagcagactggccagcagcctgggcaacctgaacgccgccaccgacgaccccgagaacaagaagaccagcagcagcagcaaggccggcttcaccgccagccccttcaccaacctgctgaacggcagcagccagcccaccaccagaaactaccccgagctgaacaacaaccagtacaacagaagcagcaacagcaacggcggcaacctgaacagcccccccggcccccacagcgccaagaccgaggagcacaccaccatcctgagacccagctacaccggcctgagcagcagcagcgccagattcctgagcagaagcatcccctgcagctgcctgctgctggtgttcagaaagcccttcctgggcagccccctgctgagcctgcccatcagccacctgtag

SEQ ID NO: 76081 - DNA, 1416 bp, Artificial Sequence
  Description of Artificial Sequence: Synthetic coding sequence
atgaagagaaagagcgagagaagaagcagctgggccgccgcccccccctgcagcagaagatgcagcagcaccagccccggcgtgaagaagatcagaagcagcacccagcaggaccccagaagaagagacccccaggacgacgtgtacctggacatcaccgacagactgtgcttcgccatcctgtacagcagacccaagagcgccagcaacgtgcactacttcagcatcgacaacgagctggagtacgagaacttctacgccgacttcggccccctgaacctggccatggtgtacagatactgctgcaagatcaacaagaagctgaagagcatcaccatgctgagaaagaagatcgtgcacttcaccggcagcgaccagagaaagcaggccaacgccgccttcctggtgggctgctacatggtgatctacctgggcagaacccccgaggaggcctacagaatcctgatcttcggcgagaccagctacatccccttcagagacgccgcctacggcagctgcaacttctacatcaccctgctggactgcttccacgccgtgaagaaggccatgcagtacggcttcctgaacttcaacagcttcaacctggacgagtacgagcactacgagaaggccgagaacggcgacctgaactggatcatccccgacagattcatcgccttctgcggcccccacagcagagccagactggagagcggctaccaccagcacagccccgagacctacatccagtacttcaagaaccacaacgtgaccaccatcatcagactgaacaagagaatgtacgacgccaagagattcaccgacgccggcttcgaccaccacgacctgttcttcgccgacggcagcacccccaccgacgccatcgtgaaggagttcctggacatctgcgagaacgccgagggcgccatcgccgtgcactgcaaggccggcctgggcagaaccggcaccctgatcgcctgctacatcatgaagcactacagaatgaccgccgccgagaccatcgcctgggtgagaatctgcagacccggcagcgtgatcggcccccagcagcagttcctggtgatgaagcagaccaacctgtggctggagggcgactacttcagacagaagctgaagggccaggagaacggccagcacagagccgccttcagcaagctgctgagcggcgtggacgacatcagcatcaacggcgtggagaaccaggaccagcaggagcccgagccctacagcgacgacgacgagatcaacggcgtgacccagggcgacagactgagagccctgaagagcagaagacagagcaagaccaacgccatccccctgaccgacggctggctgagccaggccgtgaccttcctggacagactgctgatctggctgggcatccacaaggactag

SEQ ID NO: 76082 - DNA, 1458 bp, Artificial Sequence
  Description of Artificial Sequence: Synthetic coding sequence
atgaagagaaagagcgagagaagaagcagctgggccgccgcccccccctgcagcagaagatgcagcagcaccagccccggcgtgaagaagatcagaagcagcacccagcaggaccccagaagaagagacccccaggacgacgtgtacctggacatcaccgacagactgtgcttcgccatcctgtacagcagacccaagagcgccagcaacgtgcactacttcagcatcgacaacgagctggagtacgagaacttctacgccgacttcggccccctgaacctggccatggtgtacagatactgctgcaagatcaacaagaagctgaagagcatcaccatgctgagaaagaagatcgtgcacttcaccggcagcgaccagagaaagcaggccaacgccgccttcctggtgggctgctacatggtgatctacctgggcagaacccccgaggaggcctacagaatcctgatcttcggcgagaccagctacatccccttcagagacgccgcctacggcagctgcaacttctacatcaccctgctggactgcttccacgccgtgaagaaggccatgcagtacggcttcctgaacttcaacagcttcaacctggacgagtacgagcactacgagaaggccgagaacggcgacctgaactggatcatccccgacagattcatcgccttctgcggcccccacagcagagccagactggagagcggctaccaccagcacagccccgagacctacatccagtacttcaagaaccacaacgtgaccaccatcatcagactgaacaagagaatgtacgacgccaagagattcaccgacgccggcttcgaccaccacgacctgttcttcgccgacggcagcacccccaccgacgccatcgtgaaggagttcctggacatctgcgagaacgccgagggcgccatcgccgtgcactgcaaggccggcctgggcagaaccggcaccctgatcgcctgctacatcatgaagcactacagaatgaccgccgccgagaccatcgcctgggtgagaatctgcagacccggcagcgtgatcggcccccagcagcagttcctggtgatgaagcagaccaacctgtggctggagggcgactacttcagacagaagctgaagggccaggagaacggccagcacagagccgccttcagcaagctgctgagcggcgtggacgacatcagcatcaacggcgtggagaaccaggaccagcaggagcccgagccctacagcgacgacgacgagatcaacggcgtgacccagggcgacagactgagagccctgaagagcagaagacagagcaagaccaacgccatccccctgacctgccccctggccgtgctgaccagcgccctgtgcagcgtggtgatctggtggatcgtgtgcgactacatcctgcccatcctgctgttctgcctggacggcttcagaacccagtag

SEQ ID NO: 76083 - DNA, 1380 bp, Artificial Sequence
  Description of Artificial Sequence: Synthetic coding sequence
atgaagagaaagagcgagagaagaagcagctgggccgccgcccccccctgcagcagaagatgcagcagcaccagccccggcgtgaagaagatcagaagcagcacccagcaggaccccagaagaagagacccccaggacgacgtgtacctggacatcaccgacagactgtgcttcgccatcctgtacagcagacccaagagcgccagcaacgtgcactacttcagcatcgacaacgagctggagtacgagaacttctacgccgacttcggccccctgaacctggccatggtgtacagatactgctgcaagatcaacaagaagctgaagagcatcaccatgctgagaaagaagatcgtgcacttcaccggcagcgaccagagaaagcaggccaacgccgccttcctggtgggctgctacatggtgatctacctgggcagaacccccgaggaggcctacagaatcctgatcttcggcgagaccagctacatccccttcagagacgccgcctacggcagctgcaacttctacatcaccctgctggactgcttccacgccgtgaagaaggccatgcagtacggcttcctgaacttcaacagcttcaacctggacgagtacgagcactacgagaaggccgagaacggcgacctgaactggatcatccccgacagattcatcgccttctgcggcccccacagcagagccagactggagagcggctaccaccagcacagccccgagacctacatccagtacttcaagaaccacaacgtgaccaccatcatcagactgaacaagagaatgtacgacgccaagagattcaccgacgccggcttcgaccaccacgacctgttcttcgccgacggcagcacccccaccgacgccatcgtgaaggagttcctggacatctgcgagaacgccgagggcgccatcgccgtgcactgcaaggccggcctgggcagaaccggcaccctgatcgcctgctacatcatgaagcactacagaatgaccgccgccgagaccatcgcctgggtgagaatctgcagacccggcagcgtgatcggcccccagcagcagttcctggtgatgaagcagaccaacctgtggctggagggcgactacttcagacagaagctgaagggccaggagaacggccagcacagagccgccttcagcaagctgctgagcggcgtggacgacatcagcatcaacggcgtggagaaccaggaccagcaggagcccgagccctacagcgacgacgacgagatcaacggcgtgacccagggcgacagactgagagccctgaagagcagaagacagagcaagaccaacgccatccccctgaccctgagcatcagcagaaccaagaccgtgctgagatag

SEQ ID NO: 76084 - DNA, 1497 bp, Artificial Sequence
  Description of Artificial Sequence: Synthetic coding sequence
atgaagagaaagagcgagagaagaagcagctgggccgccgcccccccctgcagcagaagatgcagcagcaccagccccggcgtgaagaagatcagaagcagcacccagcaggaccccagaagaagagacccccaggacgacgtgtacctggacatcaccgacagactgtgcttcgccatcctgtacagcagacccaagagcgccagcaacgtgcactacttcagcatcgacaacgagctggagtacgagaacttctacgccgacttcggccccctgaacctggccatggtgtacagatactgctgcaagatcaacaagaagctgaagagcatcaccatgctgagaaagaagatcgtgcacttcaccggcagcgaccagagaaagcaggccaacgccgccttcctggtgggctgctacatggtgatctacctgggcagaacccccgaggaggcctacagaatcctgatcttcggcgagaccagctacatccccttcagagacgccgcctacggcagctgcaacttctacatcaccctgctggactgcttccacgccgtgaagaaggccatgcagtacggcttcctgaacttcaacagcttcaacctggacgagtacgagcactacgagaaggccgagaacggcgacctgaactggatcatccccgacagattcatcgccttctgcggcccccacagcagagccagactggagagcggctaccaccagcacagccccgagacctacatccagtacttcaagaaccacaacgtgaccaccatcatcagactgaacaagagaatgtacgacgccaagagattcaccgacgccggcttcgaccaccacgacctgttcttcgccgacggcagcacccccaccgacgccatcgtgaaggagttcctggacatctgcgagaacgccgagggcgccatcgccgtgcactgcaaggccggcctgggcagaaccggcaccctgatcgcctgctacatcatgaagcactacagaatgaccgccgccgagaccatcgcctgggtgagaatctgcagacccggcagcgtgatcggcccccagcagcagttcctggtgatgaagcagaccaacctgtggctggagggcgactacttcagacagaagctgaagggccaggagaacggccagcacagagccgccttcagcaagctgctgagcggcgtggacgacatcagcatcaacggcgtggagaaccaggaccagcaggagcccgagccctacagcgacgacgacgagatcaacggcgtgacccagggcgacagactgagagccctgaagagcagaagacagagcaagaccaacgccatccccctgaccgtgatcctgcagagcagcgtgcagagctgcaagaccagcgagcccaacatcagcggcagcgccggcatcaccaagagaaccaccagaagcgccagcagaaagagcagcgtgaagagcctgagcatcagcagaaccaagaccgtgctgagatag

SEQ ID NO: 76085 - DNA, 1386 bp, Artificial Sequence
  Description of Artificial Sequence: Synthetic coding sequence
atgagcagagagggcgccggcgccgccctggtggccgaggtgatcaaggacagactgtgcttcgccatcctgtacagcagacccaagagcgccagcaacgtgcactacttcagcatcgacaacgagctggagtacgagaacttctacgccgacttcggccccctgaacctggccatggtgtacagatactgctgcaagatcaacaagaagctgaagagcatcaccatgctgagaaagaagatcgtgcacttcaccggcagcgaccagagaaagcaggccaacgccgccttcctggtgggctgctacatggtgatctacctgggcagaacccccgaggaggcctacagaatcctgatcttcggcgagaccagctacatccccttcagagacgccgcctacggcagctgcaacttctacatcaccctgctggactgcttccacgccgtgaagaaggccatgcagtacggcttcctgaacttcaacagcttcaacctggacgagtacgagcactacgagaaggccgagaacggcgacctgaactggatcatccccgacagattcatcgccttctgcggcccccacagcagagccagactggagagcggctaccaccagcacagccccgagacctacatccagtacttcaagaaccacaacgtgaccaccatcatcagactgaacaagagaatgtacgacgccaagagattcaccgacgccggcttcgaccaccacgacctgttcttcgccgacggcagcacccccaccgacgccatcgtgaaggagttcctggacatctgcgagaacgccgagggcgccatcgccgtgcactgcaaggccggcctgggcagaaccggcaccctgatcgcctgctacatcatgaagcactacagaatgaccgccgccgagaccatcgcctgggtgagaatctgcagacccggcagcgtgatcggcccccagcagcagttcctggtgatgaagcagaccaacctgtggctggagggcgactacttcagacagaagctgaagggccaggagaacggccagcacagagccgccttcagcaagctgctgagcggcgtggacgacatcagcatcaacggcgtggagaaccaggaccagcaggagcccgagccctacagcgacgacgacgagatcaacggcgtgacccagggcgacagactgagagccctgaagagcagaagacagagcaagaccaacgccatccccctgaccgtgatcctgcagagcagcgtgcagagctgcaagaccagcgagcccaacatcagcggcagcgccggcatcaccaagagaaccaccagaagcgccagcagaaagagcagcgtgaagagcctgagcatcagcagaaccaagaccgtgctgagatag

SEQ ID NO: 76086 - DNA, 1458 bp, Artificial Sequence; identical to SEQ ID NO: 76082
  Description of Artificial Sequence: Synthetic coding sequence

SEQ ID NO: 76087 - DNA, 5346 bp, Artificial Sequence
  Description of Artificial Sequence: Synthetic coding sequence
atgagcggcgaggtgagactgagacagctggagcagttcatcctggacggccccgcccagaccaacggccagtgcttcagcgtggagaccctgctggacatcctgatctgcctgtacgacgagtgcaacaacagccccctgagaagagagaagaacatcctggagtacctggagtgggccaagcccttcaccagcaaggtgaagcagatgagactgcacagagaggacttcgagatcctgaaggtgatcggcagaggcgccttcggcgaggtggccgtggtgaagctgaagaacgccgacaaggtgttcgccatgaagatcctgaacaagtgggagatgctgaagagagccgagaccgcctgcttcagagaggagagagacgtgctggtgaacggcgacaacaagtggatcaccaccctgcactacgccttccaggacgacaacaacctgtacctggtgatggactactacgtgggcggcgacctgctgaccctgctgagcaagttcgaggacagactgcccgaggacatggccagattctacctggccgagatggtgatcgccatcgacagcgtgcaccagctgcactacgtgcacagagacatcaagcccgacaacatcctgatggacatgaacggccacatcagactggccgacttcggcagctgcctgaagctgatggaggacggcaccgtgcagagcagcgtggccgtgggcacccccgactacatcagccccgagatcctgcaggccatggaggacggcaagggcagatacggccccgagtgcgactggtggagcctgggcgtgtgcatgtacgagatgctgtacggcgagacccccttctacgccgagagcctggtggagacctacggcaagatcatgaaccacaaggagagattccagttccccgcccaggtgaccgacgtgagcgagaacgccaaggacctgatcagaagactgatctgcagcagagagcacagactgggccagaacggcatcgaggacttcaagaagcaccccttcttcagcggcatcgactgggacaacatcagaaactgcgaggccccctacatccccgaggtgagcagccccaccgacaccagcaacttcgacgtggacgacgactgcctgaagaacagcgagaccatgcccccccccacccacaccgccttcagcggccaccacctgcccttcgtgggcttcacctacaccagcagctgcgtgctgagcgacagaagctgcctgagagtgaccgccggccccaccagcctggacctggacgtgaacgtgcagagaaccctggacaacaacctggccaccgaggcctacgagagaagaatcaagagactggagcaggagaagctggagctgagcagaaagctgcaggagagcacccagaccgtgcaggccctgcagtacagcaccgtggacggccccctgaccgccagcaaggacctggagatcaagaacctgaaggaggagatcgagaagctgagaaagcaggtgaccgagagcagccacctggagcagcagctggaggaggccaacgccgtgagacaggagctggacgacgccttcagacagatcaaggcctacgagaagcagatcaagaccctgcagcaggagagagaggacctgaacaaggagctggtgcaggccagcgagagactgaagaaccagagcaaggagctgaaggacgcccactgccagagaaagctggccatgcaggagttcatggagatcaacgagagactgaccgagctgcacacccagaagcagaagctggccagacacgtgagagacaaggaggaggaggtggacctggtgatgcagaaggtggagagcctgagacaggagctgagaagaaccgagagagccaagaaggagctggaggtgcacaccgaggccctggccgccgaggccagcaaggacagaaagctgagagagcagagcgagcactacagcaagcagctggagaacgagctggagggcctgaagcagaagcagatcagctacagccccggcgtgtgcagcatcgagcaccagcaggagatcaccaagctgaagaccgacctggagaagaagagcatcttctacgaggaggagctgagcaagagagagggcatccacgccaacgagatcaagaacctgaagaaggagctgcacgacagcgagggccagcagctggccctgaacaaggagatcatgatcctgaaggacaagctggagaagaccagaagagagagccagagcgagagagaggagttcgagagcgagttcaagcagcagtacgagagagagaaggtgctgctgaccgaggagaacaagaagctgaccagcgagctggacaagctgaccaccctgtacgagaacctgagcatccacaaccagcagctggaggaggaggtgaaggacctggccgacaagaaggagagcgtggcccactgggaggcccagatcaccgagatcatccagtgggtgagcgacgagaaggacgccagaggctacctgcaggccctggccagcaagatgaccgaggagctggaggccctgagaaacagcagcctgggcaccagagccaccgacatgccctggaagatgagaagattcgccaagctggacatgagcgccagactggagctgcagagcgccctggacgccgagatcagagccaagcaggccatccaggaggagctgaacaaggtgaaggccagcaacatcatcaccgagtgcaagctgaaggacagcgagaagaagaacctggagctgctgagcgagatcgagcagctgatcaaggacaccgaggagctgagaagcgagaagggcatcgagcaccaggacagccagcacagcttcctggccttcctgaacacccccaccgacgccctggaccagttcgagaccgtggacagcacccccctgagcgtgcacacccccaccctgagaaagaagggctgccccggcagcaccggcttcccccccaagagaaagacccaccagttcttcgtgaagagcttcaccacccccaccaagtgccaccagtgcaccagcctgatggtgggcctgatcagacagggctgcagctgcgaggtgtgcggcttcagctgccacatcacctgcgtgaacaaggcccccaccacctgccccgtgccccccgagcagaccaagggccccctgggcatcgacccccagaagggcatcggcaccgcctacgagggccacgtgagaatccccaagcccgccggcgtgaagaagggctggcagagagccctggccatcgtgtgcgacttcaagctgttcctgtacgacatcgccgagggcaaggccagccagcccagcgtggtgatcagccaggtgatcgacatgagagacgaggagttcagcgtgagcagcgtgctggccagcgacgtgatccacgccagcagaaaggacatcccctgcatcttcagagtgaccgccagccagctgagcgccagcaacaacaagtgcagcatcctgatgctggccgacaccgagaacgagaagaacaagtgggtgggcgtgctgagcgagctgcacaagatcctgaagaagaacaagttcagagacagaagcgtgtacgtgcccaaggaggcctacgacagcaccctgcccctgatcaagaccacccaggccgccgccatcatcgaccacgagagaatcgccctgggcaacgaggagggcctgttcgtggtgcacgtgaccaaggacgagatcatcagagtgggcgacaacaagaagatccaccagatcgagctgatccccaacgaccagctggtggccgtgatcagcggcagaaacagacacgtgagactgttccccatgagcgccctggacggcagagagaccgacttctacaagctgagcgagaccaagggctgccagaccgtgaccagcggcaaggtgagacacggcgccctgacctgcctgtgcgtggccatgaagagacaggtgctgtgctacgagctgttccagagcaagaccagacacagaaagttcaaggagatccaggtgccctacaacgtgcagtggatggccatcttcagcgagcagctgtgcgtgggcttccagagcggcttcctgagataccccctgaacggcgagggcaacccctacagcatgctgcacagcaacgaccacaccctgagcttcatcgcccaccagcccatggacgccatctgcgccgtggagatcagcagcaaggagtacctgctgtgcttcaacagcatcggcatctacaccgactgccagggcagaagaagcagacagcaggagctgatgtggcccgccaaccccagcagctgctgctacaacgccccctacctgagcgtgtacagcgagaacgccgtggacatcttcgacgtgaacagcatggagtggatccagaccctgcccctgaagaaggtgagacccctgaacaacgagggcagcctgaacctgctgggcctggagaccatcagactgatctacttcaagaacaagatggccgagggcgacgagctggtggtgcccgagaccagcgacaacagcagaaagcagatggtgagaaacatcaacaacaagagaagatacagcttcagagtgcccgaggaggagagaatgcagcagagaagagagatgctgagagaccccgagatgagaaacaagctgatcagcaaccccaccaacttcaaccacatcgcccacatgggccccggcgacggcatccagatcctgaaggacctgcccatgcccggcttcccctaccccagcccccaccaccacagcggcctgatcagcagccccatcaacttcgagcacatctaccacatgaccgtgaacagcgccgagaagttcctgagccccgacagcatcaaccccgagtacagccccagcctgagaagcgtgcccggcacccccagcttcatgaccctgagaaaccccagaccccaggagagcagaaccgtgttcagcggcagcgtgagcatccccagcatcaccaagagcagacccgagcccggcagaagcatgagcgccagcagcggcctgagcgccagaagcagcgcccagaacggcagcgccctgaagagagagttcagcggcggcagctacagcgccaagagacagcccatgcccagccccagcgagggcagcctgagcagcggcggcatggaccagggcagcgacgcccccgccagagacttcgacggcgaggacagcgacagccccagacacagcaccgccagcaacagcagcaacctgagcagcccccccagccccgccagccccagaaagaccaagagcctgagcctggagagcaccgacagaggcagctgggacccctag

SEQ ID NO: 76088 - DNA, 2457 bp, Artificial Sequence
  Description of Artificial Sequence: Synthetic coding sequence
atgatcctgaaggacaagctggagaagaccagaagagagagccagagcgagagagaggagttcgagagcgagttcaagcagcagtacgagagagagaaggtgctgctgaccgaggagaacaagaagctgaccagcgagctggacaagctgaccaccctgtacgagaacctgagcatccacaaccagcagctggaggaggaggtgaaggacctggccgacaagaaggagagcgtggcccactgggaggcccagatcaccgagatcatccagtgggtgagcgacgagaaggacgccagaggctacctgcaggccctggccagcaagatgaccgaggagctggaggccctgagaaacagcagcctgggcaccagagccaccgacatgccctggaagatgagaagattcgccaagctggacatgagcgccagactggagctgcagagcgccctggacgccgagatcagagccaagcaggccatccaggaggagctgaacaaggtgaaggccagcaacatcatcaccgagtgcaagctgaaggacagcgagaagaagaacctggagctgctgagcgagatcgagcagctgatcaaggacaccgaggagctgagaagcgagaagggcatcgagcaccaggacagccagcacagcttcctggccttcctgaacacccccaccgacgccctggaccagttcgaggacagcttcagcagcagcagcagcagcctgatcgacttcctggacgacaccgaccccgtggagaacacctacgtgtggaaccccagcgtgaagttccacatccagagcagaagcaccagccccagcaccagcagcgaggccgagcccgtgaagaccgtggacagcacccccctgagcgtgcacacccccaccctgagaaagaagggctgccccggcagcaccggcttcccccccaagagaaagacccaccagttcttcgtgaagagcttcaccacccccaccaagtgccaccagtgcaccagcctgatggtgggcctgatcagacagggctgcagctgcgaggtgtgcggcttcagctgccacatcacctgcgtgaacaaggcccccaccacctgccccgtgccccccgagcagaccaagggccccctgggcatcgacccccagaagggcatcggcaccgcctacgagggccacgtgagaatccccaagcccgccggcgtgaagaagggctggcagagagccctggccatcgtgtgcgacttcaagctgttcctgtacgacatcgccgagggcaaggccagccagcccagcgtggtgatcagccaggtgatcgacatgagagacgaggagttcagcgtgagcagcgtgctggccagcgacgtgatccacgccagcagaaaggacatcccctgcatcttcagagtgaccgccagccagctgagcgccagcaacaacaagtgcagcatcctgatgctggccgacaccgagaacgagaagaacaagtgggtgggcgtgctgagcgagctgcacaagatcctgaagaagaacaagttcagagacagaagcgtgtacgtgcccaaggaggcctacgacagcaccctgcccctgatcaagaccacccaggccgccgccatcatcgaccacgagagaatcgccctgggcaacgaggagggcctgttcgtggtgcacgtgaccaaggacgagatcatcagagtgggcgacaacaagaagatccaccagatcgagctgatccccaacgaccagctggtggccgtgatcagcggcagaaacagacacgtgagactgttccccatgagcgccctggacggcagagagaccgacttctacaagctgagcgagaccaagggctgccagaccgtgaccagcggcaaggtgagacacggcgccctgacctgcctgtgcgtggccatgaagagacaggtgctgtgctacgagctgttccagagcaagaccagacacagaaagttcaaggagatccaggtgccctacaacgtgcagtggatggccatcttcagcgagcagctgtgcgtgggcttccagagcggcttcctgagataccccctgaacggcgagggcaacccctacagcatgctgcacagcaacgaccacaccctgagcttcatcgcccaccagcccatggacgccatctgcgccgtggagatcagcagcaaggagtacctgctgtgcttcaacagcatcggcatctacaccgactgccagggcagaagaagcagacagcaggagctgatgtggcccgccaaccccagcagctgctgctacaacgccccctacctgagcgtgtacagcgagaacgccgtggacatcttcgacgtgaacagcatggagtggatccagaccctgcccctgaagaaggtgagacccctgaacaacgagggcagcctgaacctgctgggcctggagaccatcagactgatctacttcaagaacaagatggcctag

SEQ ID NO: 76089 - DNA, 5076 bp, Artificial Sequence
  Description of Artificial Sequence: Synthetic coding sequence
atgagcggcgaggtgagactgagacagctggagcagttcatcctggacggccccgcccagaccaacggccagtgcttcagcgtggagaccctgctggacatcctgatctgcctgtacgacgagtgcaacaacagccccctgagaagagagaagaacatcctggagtacctggagtgggccaagcccttcaccagcaaggtgaagcagatgagactgcacagagaggacttcgagatcctgaaggtgatcggcagaggcgccttcggcgaggtggccgtggtgaagctgaagaacgccgacaaggtgttcgccatgaagatcctgaacaagtgggagatgctgaagagagccgagaccgcctgcttcagagaggagagagacgtgctggtgaacggcgacaacaagtggatcaccaccctgcactacgccttccaggacgacaacaacctgtacctggtgatggactactacgtgggcggcgacctgctgaccctgctgagcaagttcgaggacagactgcccgaggacatggccagattctacctggccgagatggtgatcgccatcgacagcgtgcaccagctgcactacgtgcacagagacatcaagcccgacaacatcctgatggacatgaacggccacatcagactggccgacttcggcagctgcctgaagctgatggaggacggcaccgtgcagagcagcgtggccgtgggcacccccgactacatcagccccgagatcctgcaggccatggaggacggcaagggcagatacggccccgagtgcgactggtggagcctgggcgtgtgcatgtacgagatgctgtacggcgagacccccttctacgccgagagcctggtggagacctacggcaagatcatgaaccacaaggagagattccagttccccgcccaggtgaccgacgtgagcgagaacgccaaggacctgatcagaagactgatctgcagcagagagcacagactgggccagaacggcatcgaggacttcaagaagcaccccttcttcagcggcatcgactgggacaacatcagaaactgcgaggccccctacatccccgaggtgagcagccccaccgacaccagcaacttcgacgtggacgacgactgcctgaagaacagcgagaccatgcccccccccacccacaccgccttcagcggccaccacctgcccttcgtgggcttcacctacaccagcagctgcgtgctgagcgacagaagctgcctgagagtgaccgccggccccaccagcctggacctggacgtgaacgtgcagagaaccctggacaacaacctggccaccgaggcctacgagagaagaatcaagagactggagcaggagaagctggagctgagcagaaagctgcaggagagcacccagaccgtgcaggccctgcagtacagcaccgtggacggccccctgaccgccagcaaggacctggagatcaagaacctgaaggaggagatcgagaagctgagaaagcaggtgaccgagagcagccacctggagcagcagctggaggaggccaacgccgtgagacaggagctggacgacgccttcagacagatcaaggcctacgagaagcagatcaagaccctgcagcaggagagagaggacctgaacaaggagctggtgcaggccagcgagagactgaagaaccagagcaaggagctgaaggacgcccactgccagagaaagctggccatgcaggagttcatggagatcaacgagagactgaccgagctgcacacccagaagcagaagctggccagacacgtgagagacaaggaggaggaggtggacctggtgatgcagaaggtggagagcctgagacaggagctgagaagaaccgagagagccaagaaggagctggaggtgcacaccgaggccctggccgccgaggccagcaaggacagaaagctgagagagcagagcgagcactacagcaagcagctggagaacgagctggagggcctgaagcagaagcagatcagctacagccccggcgtgtgcagcatcgagcaccagcaggagatcaccaagctgaagaccgacctggagaagaagagcatcttctacgaggaggagctgagcaagagagagggcatccacgccaacgagatcaagaacctgaagaaggagctgcacgacagcgagggccagcagctggccctgaacaaggagatcatgatcctgaaggacaagctggagaagaccagaagagagagccagagcgagagagaggagttcgagagcgagttcaagcagcagtacgagagagagaaggtgctgctgaccgaggagaacaagaagctgaccagcgagctggacaagctgaccaccctgtacgagaacctgagcatccacaaccagcagctggaggaggaggtgaaggacctggccgacaagaaggagagcgtggcccactgggaggcccagatcaccgagatcatccagtgggtgagcgacgagaaggacgccagaggctacctgcaggccctggccagcaagatgaccgaggagctggaggccctgagaaacagcagcctgggcaccagagccaccgacatgccctggaagatgagaagattcgccaagctggacatgagcgccagactggagctgcagagcgccctggacgccgagatcagagccaagcaggccatccaggaggagctgaacaaggtgaaggccagcaacatcatcaccgagtgcaagctgaaggacagcgagaagaagaacctggagctgctgagcgagatcgagcagctgatcaaggacaccgaggagctgagaagcgagaagggcatcgagcaccaggacagccagcacagcttcctggccttcctgaacacccccaccgacgccctggaccagttcgagagaaagacccaccagttcttcgtgaagagcttcaccacccccaccaagtgccaccagtgcaccagcctgatggtgggcctgatcagacagggctgcagctgcgaggtgtgcggcttcagctgccacatcacctgcgtgaacaaggcccccaccacctgccccgtgccccccgagcagaccaagggccccctgggcatcgacccccagaagggcatcggcaccgcctacgagggccacgtgagaatccccaagcccgccggcgtgaagaagggctggcagagagccctggccatcgtgtgcgacttcaagctgttcctgtacgacatcgccgagggcaaggccagccagcccagcgtggtgatcagccaggtgatcgacatgagagacgaggagttcagcgtgagcagcgtgctggccagcgacgtgatccacgccagcagaaaggacatcccctgcatcttcagagtgaccgccagccagctgagcgccagcaacaacaagtgcagcatcctgatgctggccgacaccgagaacgagaagaacaagtgggtgggcgtgctgagcgagctgcacaagatcctgaagaagaacaagttcagagacagaagcgtgtacgtgcccaaggaggcctacgacagcaccctgcccctgatcaagaccacccaggccgccgccatcatcgaccacgagagaatcgccctgggcaacgaggagggcctgttcgtggtgcacgtgaccaaggacgagatcatcagagtgggcgacaacaagaagatccaccagatcgagctgatccccaacgaccagctggtggccgtgatcagcggcagaaacagacacgtgagactgttccccatgagcgccctggacggcagagagaccgacttctacaagctgagcgagaccaagggctgccagaccgtgaccagcggcaaggtgagacacggcgccctgacctgcctgtgcgtggccatgaagagacaggtgctgtgctacgagctgttccagagcaagaccagacacagaaagttcaaggagatccaggtgccctacaacgtgcagtggatggccatcttcagcgagcagctgtgcgtgggcttccagagcggcttcctgagataccccctgaacggcgagggcaacccctacagcatgctgcacagcaacgaccacaccctgagcttcatcgcccaccagcccatggacgccatctgcgccgtggagatcagcagcaaggagtacctgctgtgcttcaacagcatcggcatctacaccgactgccagggcagaagaagcagacagcaggagctgatgtggcccgccaaccccagcagctgctgctacaacgccccctacctgagcgtgtacagcgagaacgccgtggacatcttcgacgtgaacagcatggagtggatccagaccctgcccctgaagaaggtgagacccctgaacaacgagggcagcctgaacctgctgggcctggagaccatcagactgatctacttcaagaacaagatggccgagggcgacgagctggtggtgcccgagaccagcgacaacagcagaaagcagatggtgagaaacatcaacaacaagagaagatacagcttcagagtgcccgaggaggagagaatgcagcagagaagagagatgctgagagaccccgagatgagaaacaagctgatcagcaaccccaccaacttcaaccacatcgcccacatgggccccggcgacggcatccagatcctgaaggacctgcccatgaaccccagaccccaggagagcagaaccgtgttcagcggcagcgtgagcatccccagcatcaccaagagcagacccgagcccggcagaagcatgagcgccagcagcggcctgagcgccagaagcagcgcccagaacggcagcgccctgaagagagagttcagcggcggcagctacagcgccaagagacagcccatgcccagccccagcgagggcagcctgagcagcggcggcatggaccagggcagcgacgcccccgccagagacttcgacggcgaggacagcgacagccccagacacagcaccgccagcaacagcagcaacctgagcagcccccccagccccgccagccccagaaagaccaagagcctgagcctggagagcaccgacagaggcagctgggacccctag

SEQ ID NO: 76090 - DNA, 5199 bp, Artificial Sequence
  Description of Artificial Sequence: Synthetic coding sequence
atgagcggcgaggtgagactgagacagctggagcagttcatcctggacggccccgcccagaccaacggccagtgcttcagcgtggagaccctgctggacatcctgatctgcctgtacgacgagtgcaacaacagccccctgagaagagagaagaacatcctggagtacctggagtgggccaagcccttcaccagcaaggtgaagcagatgagactgcacagagaggacttcgagatcctgaaggtgatcggcagaggcgccttcggcgaggtggccgtggtgaagctgaagaacgccgacaaggtgttcgccatgaagatcctgaacaagtgggagatgctgaagagagccgagaccgcctgcttcagagaggagagagacgtgctggtgaacggcgacaacaagtggatcaccaccctgcactacgccttccaggacgacaacaacctgtacctggtgatggactactacgtgggcggcgacctgctgaccctgctgagcaagttcgaggacagactgcccgaggacatggccagattctacctggccgagatggtgatcgccatcgacagcgtgcaccagctgcactacgtgcacagagacatcaagcccgacaacatcctgatggacatgaacggccacatcagactggccgacttcggcagctgcctgaagctgatggaggacggcaccgtgcagagcagcgtggccgtgggcacccccgactacatcagccccgagatcctgcaggccatggaggacggcaagggcagatacggccccgagtgcgactggtggagcctgggcgtgtgcatgtacgagatgctgtacggcgagacccccttctacgccgagagcctggtggagacctacggcaagatcatgaaccacaaggagagattccagttccccgcccaggtgaccgacgtgagcgagaacgccaaggacctgatcagaagactgatctgcagcagagagcacagactgggccagaacggcatcgaggacttcaagaagcaccccttcttcagcggcatcgactgggacaacatcagaaactgcgaggccccctacatccccgaggtgagcagccccaccgacaccagcaacttcgacgtggacgacgactgcctgaagaacagcgagaccatgcccccccccacccacaccgccttcagcggccaccacctgcccttcgtgggcttcacctacaccagcagctgcgtgctgagcgacagaagctgcctgagagtgaccgccggccccaccagcctggacctggacgtgaacgtgcagagaaccctggacaacaacctggccaccgaggcctacgagagaagaatcaagagactggagcaggagaagctggagctgagcagaaagctgcaggagagcacccagaccgtgcaggccctgcagtacagcaccgtggacggccccctgaccgccagcaaggacctggagatcaagaacctgaaggaggagatcgagaagctgagaaagcaggtgaccgagagcagccacctggagcagcagctggaggaggccaacgccgtgagacaggagctggacgacgccttcagacagatcaaggcctacgagaagcagatcaagaccctgcagcaggagagagaggacctgaacaaggagctggtgcaggccagcgagagactgaagaaccagagcaaggagctgaaggacgcccactgccagagaaagctggccatgcaggagttcatggagatcaacgagagactgaccgagctgcacacccagaagcagaagctggccagacacgtgagagacaaggaggaggaggtggacctggtgatgcagaaggtggagagcctgagacaggagctgagaagaaccgagagagccaagaaggagctggaggtgcacaccgaggccctggccgccgaggccagcaaggacagaaagctgagagagcagagcgagcactacagcaagcagctggagaacgagctggagggcctgaagcagaagcagatcagctacagccccggcgtgtgcagcatcgagcaccagcaggagatcaccaagctgaagaccgacctggagaagaagagcatcttctacgaggaggagctgagcaagagagagggcatccacgccaacgagatcaagaacctgaagaaggagctgcacgacagcgagggccagcagctggccctgaacaaggagatcatgatcctgaaggacaagctggagaagaccagaagagagagccagagcgagagagaggagttcgagagcgagttcaagcagcagtacgagagagagaaggtgctgctgaccgaggagaacaagaagctgaccagcgagctggacaagctgaccaccctgtacgagaacctgagcatccacaaccagcagctggaggaggaggtgaaggacctggccgacaagaaggagagcgtggcccactgggaggcccagatcaccgagatcatccagtgggtgagcgacgagaaggacgccagaggctacctgcaggccctggccagcaagatgaccgaggagctggaggccctgagaaacagcagcctgggcaccagagccaccgacatgccctggaagatgagaagattcgccaagctggacatgagcgccagactggagctgcagagcgccctggacgccgagatcagagccaagcaggccatccaggaggagctgaacaaggtgaaggccagcaacatcatcaccgagtgcaagctgaaggacagcgagaagaagaacctggagctgctgagcgagatcgagcagctgatcaaggacaccgaggagctgagaagcgagaagggcatcgagcaccaggacagccagcacagcttcctggccttcctgaacacccccaccgacgccctggaccagttcgagagaagccccagctgcacccccgccagcaagggcagaagaaccgtggacagcacccccctgagcgtgcacacccccaccctgagaaagaagggctgccccggcagcaccggcttcccccccaagagaaagacccaccagttcttcgtgaagagcttcaccacccccaccaagtgccaccagtgcaccagcctgatggtgggcctgatcagacagggctgcagctgcgaggtgtgcggcttcagctgccacatcacctgcgtgaacaaggcccccaccacctgccccgtgccccccgagcagaccaagggccccctgggcatcgacccccagaagggcatcggcaccgcctacgagggccacgtgagaatccccaagcccgccggcgtgaagaagggctggcagagagccctggccatcgtgtgcgacttcaagctgttcctgtacgacatcgccgagggcaaggccagccagcccagcgtggtgatcagccaggtgatcgacatgagagacgaggagttcagcgtgagcagcgtgctggccagcgacgtgatccacgccagcagaaaggacatcccctgcatcttcagagtgaccgccagccagctgagcgccagcaacaacaagtgcagcatcctgatgctggccgacaccgagaacgagaagaacaagtgggtgggcgtgctgagcgagctgcacaagatcctgaagaagaacaagttcagagacagaagcgtgtacgtgcccaaggaggcctacgacagcaccctgcccctgatcaagaccacccaggccgccgccatcatcgaccacgagagaatcgccctgggcaacgaggagggcctgttcgtggtgcacgtgaccaaggacgagatcatcagagtgggcgacaacaagaagatccaccagatcgagctgatccccaacgaccagctggtggccgtgatcagcggcagaaacagacacgtgagactgttccccatgagcgccctggacggcagagagaccgacttctacaagctgagcgagaccaagggctgccagaccgtgaccagcggcaaggtgagacacggcgccctgacctgcctgtgcgtggccatgaagagacaggtgctgtgctacgagctgttccagagcaagaccagacacagaaagttcaaggagatccaggtgccctacaacgtgcagtggatggccatcttcagcgagcagctgtgcgtgggcttccagagcggcttcctgagataccccctgaacggcgagggcaacccctacagcatgctgcacagcaacgaccacaccctgagcttcatcgcccaccagcccatggacgccatctgcgccgtggagatcagcagcaaggagtacctgctgtgcttcaacagcatcggcatctacaccgactgccagggcagaagaagcagacagcaggagctgatgtggcccgccaaccccagcagctgctgctacaacgccccctacctgagcgtgtacagcgagaacgccgtggacatcttcgacgtgaacagcatggagtggatccagaccctgcccctgaagaaggtgagacccctgaacaacgagggcagcctgaacctgctgggcctggagaccatcagactgatctacttcaagaacaagatggccgagggcgacgagctggtggtgcccgagaccagcgacaacagcagaaagcagatggtgagaaacatcaacaacaagagaagatacagcttcagagtgcccgaggaggagagaatgcagcagagaagagagatgctgagagaccccgagatgagaaacaagctgatcagcaaccccaccaacttcaaccacatcgcccacatgggccccggcgacggcatccagatcctgaaggacctgcccatgaaccccagaccccaggagagcagaaccgtgttcagcggcagcgtgagcatccccagcatcaccaagagcagacccgagcccggcagaagcatgagcgccagcagcggcctgagcgccagaagcagcgcccagaacggcagcgccctgaagagagagttcagcggcggcagctacagcgccaagagacagcccatgcccagccccagcgagggcagcctgagcagcggcggcatggaccagggcagcgacgcccccgccagagacttcgacggcgaggacagcgacagccccagacacagcaccgccagcaacagcagcaacctgagcagcccccccagccccgccagccccagaaagaccaagagcctgagcctggagagcaccgacagaggcagctgggacccctag

SEQ ID NO: 76091 - DNA, 5265 bp, Artificial Sequence
  Description of Artificial Sequence: Synthetic coding sequence
atgagcggcgaggtgagactgagacagctggagcagttcatcctggacggccccgcccagaccaacggccagtgcttcagcgtggagaccctgctggacatcctgatctgcctgtacgacgagtgcaacaacagccccctgagaagagagaagaacatcctggagtacctggagtgggccaagcccttcaccagcaaggtgaagcagatgagactgcacagagaggacttcgagatcctgaaggtgatcggcagaggcgccttcggcgaggtggccgtggtgaagctgaagaacgccgacaaggtgttcgccatgaagatcctgaacaagtgggagatgctgaagagagccgagaccgcctgcttcagagaggagagagacgtgctggtgaacggcgacaacaagtggatcaccaccctgcactacgccttccaggacgacaacaacctgtacctggtgatggactactacgtgggcggcgacctgctgaccctgctgagcaagttcgaggacagactgcccgaggacatggccagattctacctggccgagatggtgatcgccatcgacagcgtgcaccagctgcactacgtgcacagagacatcaagcccgacaacatcctgatggacatgaacggccacatcagactggccgacttcggcagctgcctgaagctgatggaggacggcaccgtgcagagcagcgtggccgtgggcacccccgactacatcagccccgagatcctgcaggccatggaggacggcaagggcagatacggccccgagtgcgactggtggagcctgggcgtgtgcatgtacgagatgctgtacggcgagacccccttctacgccgagagcctggtggagacctacggcaagatcatgaaccacaaggagagattccagttccccgcccaggtgaccgacgtgagcgagaacgccaaggacctgatcagaagactgatctgcagcagagagcacagactgggccagaacggcatcgaggacttcaagaagcaccccttcttcagcggcatcgactgggacaacatcagaaactgcgaggccccctacatccccgaggtgagcagccccaccgacaccagcaacttcgacgtggacgacgactgcctgaagaacagcgagaccatgcccccccccacccacaccgccttcagcggccaccacctgcccttcgtgggcttcacctacaccagcagctgcgtgctgagcgacagaagctgcctgagagtgaccgccggccccaccagcctggacctggacgtgaacgtgcagagaaccctggacaacaacctggccaccgaggcctacgagagaagaatcaagagactggagcaggagaagctggagctgagcagaaagctgcaggagagcacccagaccgtgcaggccctgcagtacagcaccgtggacggccccctgaccgccagcaaggacctggagatcaagaacctgaaggaggagatcgagaagctgagaaagcaggtgaccgagagcagccacctggagcagcagctggaggaggccaacgccgtgagacaggagctggacgacgccttcagacagatcaaggcctacgagaagcagatcaagaccctgcagcaggagagagaggacctgaacaaggagctggtgcaggccagcgagagactgaagaaccagagcaaggagctgaaggacgcccactgccagagaaagctggccatgcaggagttcatggagatcaacgagagactgaccgagctgcacacccagaagcagaagctggccagacacgtgagagacaaggaggaggaggtggacctggtgatgcagaaggtggagagcctgagacaggagctgagaagaaccgagagagccaagaaggagctggaggtgcacaccgaggccctggccgccgaggccagcaaggacagaaagctgagagagcagagcgagcactacagcaagcagctggagaacgagctggagggcctgaagcagaagcagatcagctacagccccggcgtgtgcagcatcgagcaccagcaggagatcaccaagctgaagaccgacctggagaagaagagcatcttctacgaggaggagctgagcaagagagagggcatccacgccaacgagatcaagaacctgaagaaggagctgcacgacagcgagggccagcagctggccctgaacaaggagatcatgatcctgaaggacaagctggagaagaccagaagagagagccagagcgagagagaggagttcgagagcgagttcaagcagcagtacgagagagagaaggtgctgctgaccgaggagaacaagaagctgaccagcgagctggacaagctgaccaccctgtacgagaacctgagcatccacaaccagcagctggaggaggaggtgaaggacctggccgacaagaaggagagcgtggcccactgggaggcccagatcaccgagatcatccagtgggtgagcgacgagaaggacgccagaggctacctgcaggccctggccagcaagatgaccgaggagctggaggccctgagaaacagcagcctgggcaccagagccaccgacatgccctggaagatgagaagattcgccaagctggacatgagcgccagactggagctgcagagcgccctggacgccgagatcagagccaagcaggccatccaggaggagctgaacaaggtgaaggccagcaacatcatcaccgagtgcaagctgaaggacagcgagaagaagaacctggagctgctgagcgagatcgagcagctgatcaaggacaccgaggagctgagaagcgagaagggcatcgagcaccaggacagccagcacagcttcctggccttcctgaacacccccaccgacgccctggaccagttcgagaccgaccccgtggagaacacctacgtgtggaaccccagcgtgaagttccacatccagagcagaagcaccagccccagcaccagcagcgaggccgagcccgtgaagaccgtggacagcacccccctgagcgtgcacacccccaccctgagaaagaagggctgccccggcagcaccggcttcccccccaagagaaagacccaccagttcttcgtgaagagcttcaccacccccaccaagtgccaccagtgcaccagcctgatggtgggcctgatcagacagggctgcagctgcgaggtgtgcggcttcagctgccacatcacctgcgtgaacaaggcccccaccacctgccccgtgccccccgagcagaccaagggccccctgggcatcgacccccagaagggcatcggcaccgcctacgagggccacgtgagaatccccaagcccgccggcgtgaagaagggctggcagagagccctggccatcgtgtgcgacttcaagctgttcctgtacgacatcgccgagggcaaggccagccagcccagcgtggtgatcagccaggtgatcgacatgagagacgaggagttcagcgtgagcagcgtgctggccagcgacgtgatccacgccagcagaaaggacatcccctgcatcttcagagtgaccgccagccagctgagcgccagcaacaacaagtgcagcatcctgatgctggccgacaccgagaacgagaagaacaagtgggtgggcgtgctgagcgagctgcacaagatcctgaagaagaacaagttcagagacagaagcgtgtacgtgcccaaggaggcctacgacagcaccctgcccctgatcaagaccacccaggccgccgccatcatcgaccacgagagaatcgccctgggcaacgaggagggcctgttcgtggtgcacgtgaccaaggacgagatcatcagagtgggcgacaacaagaagatccaccagatcgagctgatccccaacgaccagctggtggccgtgatcagcggcagaaacagacacgtgagactgttccccatgagcgccctggacggcagagagaccgacttctacaagctgagcgagaccaagggctgccagaccgtgaccagcggcaaggtgagacacggcgccctgacctgcctgtgcgtggccatgaagagacaggtgctgtgctacgagctgttccagagcaagaccagacacagaaagttcaaggagatccaggtgccctacaacgtgcagtggatggccatcttcagcgagcagctgtgcgtgggcttccagagcggcttcctgagataccccctgaacggcgagggcaacccctacagcatgctgcacagcaacgaccacaccctgagcttcatcgcccaccagcccatggacgccatctgcgccgtggagatcagcagcaaggagtacctgctgtgcttcaacagcatcggcatctacaccgactgccagggcagaagaagcagacagcaggagctgatgtggcccgccaaccccagcagctgctgctacaacgccccctacctgagcgtgtacagcgagaacgccgtggacatcttcgacgtgaacagcatggagtggatccagaccctgcccctgaagaaggtgagacccctgaacaacgagggcagcctgaacctgctgggcctggagaccatcagactgatctacttcaagaacaagatggccgagggcgacgagctggtggtgcccgagaccagcgacaacagcagaaagcagatggtgagaaacatcaacaacaagagaagatacagcttcagagtgcccgaggaggagagaatgcagcagagaagagagatgctgagagaccccgagatgagaaacaagctgatcagcaaccccaccaacttcaaccacatcgcccacatgggccccggcgacggcatccagatcctgaaggacctgcccatgaaccccagaccccaggagagcagaaccgtgttcagcggcagcgtgagcatccccagcatcaccaagagcagacccgagcccggcagaagcatgagcgccagcagcggcctgagcgccagaagcagcgcccagaacggcagcgccctgaagagagagttcagcggcggcagctacagcgccaagagacagcccatgcccagccccagcgagggcagcctgagcagcggcggcatggaccagggcagcgacgcccccgccagagacttcgacggcgaggacagcgacagccccagacacagcaccgccagcaacagcagcaacctgagcagcccccccagccccgccagccccagaaagaccaagagcctgagcctggagagcaccgacagaggcagctgggacccctag

SEQ ID NO: 76092 - DNA, 4917 bp, Artificial Sequence
  Description of Artificial Sequence: Synthetic coding sequence
atgagcggcgaggtgagactgagacagctggagcagttcatcctggacggccccgcccagaccaacggccagtgcttcagcgtggagaccctgctggacatcctgatctgcctgtacgacgagtgcaacaacagccccctgagaagagagaagaacatcctggagtacctggagtgggccaagcccttcaccagcaaggtgaagcagatgagactgcacagagaggacttcgagatcctgaaggtgatcggcagaggcgccttcggcgaggtggccgtggtgaagctgaagaacgccgacaaggtgttcgccatgaagatcctgaacaagtgggagatgctgaagagagccgagaccgcctgcttcagagaggagagagacgtgctggtgaacggcgacaacaagtggatcaccaccctgcactacgccttccaggacgacaacaacctgtacctggtgatggactactacgtgggcggcgacctgctgaccctgctgagcaagttcgaggacagactgcccgaggacatggccagattctacctggccgagatggtgatcgccatcgacagcgtgcaccagctgcactacgtgcacagagacatcaagcccgacaacatcctgatggacatgaacggccacatcagactggccgacttcggcagctgcctgaagctgatggaggacggcaccgtgcagagcagcgtggccgtgggcacccccgactacatcagccccgagatcctgcaggccatggaggacggcaagggcagatacggccccgagtgcgactggtggagcctgggcgtgtgcatgtacgagatgctgtacggcgagacccccttctacgccgagagcctggtggagacctacggcaagatcatgaaccacaaggagagattccagttccccgcccaggtgaccgacgtgagcgagaacgccaaggacctgatcagaagactgatctgcagcagagagcacagactgggccagaacggcatcgaggacttcaagaagcaccccttcttcagcggcatcgactgggacaacatcagaaactgcgaggccccctacatccccgaggtgagcagccccaccgacaccagcaacttcgacgtggacgacgactgcctgaagaacagcgagaccatgcccccccccacccacaccgccttcagcggccaccacctgcccttcgtgggcttcacctacaccagcagctgcgtgctgagcgacagaagctgcctgagagtgaccgccggccccaccagcctggacctggacgtgaacgtgcagagaaccctggacaacaacctggccaccgaggcctacgagagaagaatcaagagactggagcaggagaagctggagctgagcagaaagctgcaggagagcacccagaccgtgcaggccctgcagtacagcaccgtggacggccccctgaccgccagcaaggacctggagatcaagaacctgaaggaggagatcgagaagctgagaaagcaggtgaccgagagcagccacctggagcagcagctggaggaggccaacgccgtgagacaggagctggacgacgccttcagacagatcaaggcctacgagaagcagatcaagaccctgcagcaggagagagaggacctgaacaagctggaggtgcacaccgaggccctggccgccgaggccagcaaggacagaaagctgagagagcagagcgagcactacagcaagcagctggagaacgagctggagggcctgaagcagaagcagatcagctacagccccggcgtgtgcagcatcgagcaccagcaggagatcaccaagctgaagaccgacctggagaagaagagcatcttctacgaggaggagctgagcaagagagagggcatccacgccaacgagatcaagaacctgaagaaggagctgcacgacagcgagggccagcagctggccctgaacaaggagatcatgatcctgaaggacaagctggagaagaccagaagagagagccagagcgagagagaggagttcgagagcgagttcaagcagcagtacgagagagagaaggtgctgctgaccgaggagaacaagaagctgaccagcgagctggacaagctgaccaccctgtacgagaacctgagcatccacaaccagcagctggaggaggaggtgaaggacctggccgacaagaaggagagcgtggcccactgggaggcccagatcaccgagatcatccagtgggtgagcgacgagaaggacgccagaggctacctgcaggccctggccagcaagatgaccgaggagctggaggccctgagaaacagcagcctgggcaccagagccaccgacatgccctggaagatgagaagattcgccaagctggacatgagcgccagactggagctgcagagcgccctggacgccgagatcagagccaagcaggccatccaggaggagctgaacaaggtgaaggccagcaacatcatcaccgagtgcaagctgaaggacagcgagaagaagaacctggagctgctgagcgagatcgagcagctgatcaaggacaccgaggagctgagaagcgagaagggcatcgagcaccaggacagccagcacagcttcctggccttcctgaacacccccaccgacgccctggaccagttcgagaccgtggacagcacccccctgagcgtgcacacccccaccctgagaaagaagggctgccccggcagcaccggcttcccccccaagagaaagacccaccagttcttcgtgaagagcttcaccacccccaccaagtgccaccagtgcaccagcctgatggtgggcctgatcagacagggctgcagctgcgaggtgtgcggcttcagctgccacatcacctgcgtgaacaaggcccccaccacctgccccgtgccccccgagcagaccaagggccccctgggcatcgacccccagaagggcatcggcaccgcctacgagggccacgtgagaatccccaagcccgccggcgtgaagaagggctggcagagagccctggccatcgtgtgcgacttcaagctgttcctgtacgacatcgccgagggcaaggccagccagcccagcgtggtgatcagccaggtgatcgacatgagagacgaggagttcagcgtgagcagcgtgctggccagcgacgtgatccacgccagcagaaaggacatcccctgcatcttcagagtgaccgccagccagctgagcgccagcaacaacaagtgcagcatcctgatgctggccgacaccgagaacgagaagaacaagtgggtgggcgtgctgagcgagctgcacaagatcctgaagaagaacaagttcagagacagaagcgtgtacgtgcccaaggaggcctacgacagcaccctgcccctgatcaagaccacccaggccgccgccatcatcgaccacgagagaatcgccctgggcaacgaggagggcctgttcgtggtgcacgtgaccaaggacgagatcatcagagtgggcgacaacaagaagatccaccagatcgagctgatccccaacgaccagctggtggccgtgatcagcggcagaaacagacacgtgagactgttccccatgagcgccctggacggcagagagaccgacttctacaagctgagcgagaccaagggctgccagaccgtgaccagcggcaaggtgagacacggcgccctgacctgcctgtgcgtggccatgaagagacaggtgctgtgctacgagctgttccagagcaagaccagacacagaaagttcaaggagatccaggtgccctacaacgtgcagtggatggccatcttcagcgagcagctgtgcgtgggcttccagagcggcttcctgagataccccctgaacggcgagggcaacccctacagcatgctgcacagcaacgaccacaccctgagcttcatcgcccaccagcccatggacgccatctgcgccgtggagatcagcagcaaggagtacctgctgtgcttcaacagcatcggcatctacaccgactgccagggcagaagaagcagacagcaggagctgatgtggcccgccaaccccagcagctgctgctacaacgccccctacctgagcgtgtacagcgagaacgccgtggacatcttcgacgtgaacagcatggagtggatccagaccctgcccctgaagaaggtgagacccctgaacaacgagggcagcctgaacctgctgggcctggagaccatcagactgatctacttcaagaacaagatggccgagggcgacgagctggtggtgcccgagaccagcgacaacagcagaaagcagatggtgagaaacatcaacaacaagagaagatacagcttcagagtgcccgaggaggagagaatgcagcagagaagagagatgctgagagaccccgagatgagaaacaagctgatcagcaaccccaccaacttcaaccacatcgcccacatgggccccggcgacggcatccagatcctgaaggacctgcccatgaaccccagaccccaggagagcagaaccgtgttcagcggcagcgtgagcatccccagcatcaccaagagcagacccgagcccggcagaagcatgagcgccagcagcggcctgagcgccagaagcagcgcccagaacggcagcgccctgaagagagagttcagcggcggcagctacagcgccaagagacagcccatgcccagccccagcgagggcagcctgagcagcggcggcatggaccagggcagcgacgcccccgccagagacttcgacggcgaggacagcgacagccccagacacagcaccgccagcaacagcagcaacctgagcagcccccccagccccgccagccccagaaagaccaagagcctgagcctggagagcaccgacagaggcagctgggacccctag

SEQ ID NO: 76093 - DNA, 5160 bp, Artificial Sequence
  Description of Artificial Sequence: Synthetic coding sequence
atgagcggcgaggtgagactgagacagctggagcagttcatcctggacggccccgcccagaccaacggccagtgcttcagcgtggagaccctgctggacatcctgatctgcctgtacgacgagtgcaacaacagccccctgagaagagagaagaacatcctggagtacctggagtgggccaagcccttcaccagcaaggtgaagcagatgagactgcacagagaggacttcgagatcctgaaggtgatcggcagaggcgccttcggcgaggtggccgtggtgaagctgaagaacgccgacaaggtgttcgccatgaagatcctgaacaagtgggagatgctgaagagagccgagaccgcctgcttcagagaggagagagacgtgctggtgaacggcgacaacaagtggatcaccaccctgcactacgccttccaggacgacaacaacctgtacctggtgatggactactacgtgggcggcgacctgctgaccctgctgagcaagttcgaggacagactgcccgaggacatggccagattctacctggccgagatggtgatcgccatcgacagcgtgcaccagctgcactacgtgcacagagacatcaagcccgacaacatcctgatggacatgaacggccacatcagactggccgacttcggcagctgcctgaagctgatggaggacggcaccgtgcagagcagcgtggccgtgggcacccccgactacatcagccccgagatcctgcaggccatggaggacggcaagggcagatacggccccgagtgcgactggtggagcctgggcgtgtgcatgtacgagatgctgtacggcgagacccccttctacgccgagagcctggtggagacctacggcaagatcatgaaccacaaggagagattccagttccccgcccaggtgaccgacgtgagcgagaacgccaaggacctgatcagaagactgatctgcagcagagagcacagactgggccagaacggcatcgaggacttcaagaagcaccccttcttcagcggcatcgactgggacaacatcagaaactgcgaggccccctacatccccgaggtgagcagccccaccgacaccagcaacttcgacgtggacgacgactgcctgaagaacagcgagaccatgcccccccccacccacaccgccttcagcggccaccacctgcccttcgtgggcttcacctacaccagcagctgcgtgctgagcgacagaagctgcctgagagtgaccgccggccccaccagcctggacctggacgtgaacgtgcagagaaccctggacaacaacctggccaccgaggcctacgagagaagaatcaagagactggagcaggagaagctggagctgagcagaaagctgcaggagagcacccagaccgtgcaggccctgcagtacagcaccgtggacggccccctgaccgccagcaaggacctggagatcaagaacctgaaggaggagatcgagaagctgagaaagcaggtgaccgagagcagccacctggagcagcagctggaggaggccaacgccgtgagacaggagctggacgacgccttcagacagatcaaggcctacgagaagcagatcaagaccctgcagcaggagagagaggacctgaacaaggagctggtgcaggccagcgagagactgaagaaccagagcaaggagctgaaggacgcccactgccagagaaagctggccatgcaggagttcatggagatcaacgagagactgaccgagctgcacacccagaagcagaagctggccagacacgtgagagacaaggaggaggaggtggacctggtgatgcagaaggtggagagcctgagacaggagctgagaagaaccgagagagccaagaaggagctggaggtgcacaccgaggccctggccgccgaggccagcaaggacagaaagctgagagagcagagcgagcactacagcaagcagctggagaacgagctggagggcctgaagcagaagcagatcagctacagccccggcgtgtgcagcatcgagcaccagcaggagatcaccaagctgaagaccgacctggagaagaagagcatcttctacgaggaggagctgagcaagagagagggcatccacgccaacgagatcaagaacctgaagaaggagctgcacgacagcgagggccagcagctggccctgaacaaggagatcatgatcctgaaggacaagctggagaagaccagaagagagagccagagcgagagagaggagttcgagagcgagttcaagcagcagtacgagagagagaaggtgctgctgaccgaggagaacaagaagctgaccagcgagctggacaagctgaccaccctgtacgagaacctgagcatccacaaccagcagctggaggaggaggtgaaggacctggccgacaagaaggagagcgtggcccactgggaggcccagatcaccgagatcatccagtgggtgagcgacgagaaggacgccagaggctacctgcaggccctggccagcaagatgaccgaggagctggaggccctgagaaacagcagcctgggcaccagagccaccgacatgccctggaagatgagaagattcgccaagctggacatgagcgccagactggagctgcagagcgccctggacgccgagatcagagccaagcaggccatccaggaggagctgaacaaggtgaaggccagcaacatcatcaccgagtgcaagctgaaggacagcgagaagaagaacctggagctgctgagcgagatcgagcagctgatcaaggacaccgaggagctgagaagcgagaagggcatcgagcaccaggacagccagcacagcttcctggccttcctgaacacccccaccgacgccctggaccagttcgagaccgtggacagcacccccctgagcgtgcacacccccaccctgagaaagaagggctgccccggcagcaccggcttcccccccaagagaaagacccaccagttcttcgtgaagagcttcaccacccccaccaagtgccaccagtgcaccagcctgatggtgggcctgatcagacagggctgcagctgcgaggtgtgcggcttcagctgccacatcacctgcgtgaacaaggcccccaccacctgccccgtgccccccgagcagaccaagggccccctgggcatcgacccccagaagggcatcggcaccgcctacgagggccacgtgagaatccccaagcccgccggcgtgaagaagggctggcagagagccctggccatcgtgtgcgacttcaagctgttcctgtacgacatcgccgagggcaaggccagccagcccagcgtggtgatcagccaggtgatcgacatgagagacgaggagttcagcgtgagcagcgtgctggccagcgacgtgatccacgccagcagaaaggacatcccctgcatcttcagagtgaccgccagccagctgagcgccagcaacaacaagtgcagcatcctgatgctggccgacaccgagaacgagaagaacaagtgggtgggcgtgctgagcgagctgcacaagatcctgaagaagaacaagttcagagacagaagcgtgtacgtgcccaaggaggcctacgacagcaccctgcccctgatcaagaccacccaggccgccgccatcatcgaccacgagagaatcgccctgggcaacgaggagggcctgttcgtggtgcacgtgaccaaggacgagatcatcagagtgggcgacaacaagaagatccaccagatcgagctgatccccaacgaccagctggtggccgtgatcagcggcagaaacagacacgtgagactgttccccatgagcgccctggacggcagagagaccgacttctacaagctgagcgagaccaagggctgccagaccgtgaccagcggcaaggtgagacacggcgccctgacctgcctgtgcgtggccatgaagagacaggtgctgtgctacgagctgttccagagcaagaccagacacagaaagttcaaggagatccaggtgccctacaacgtgcagtggatggccatcttcagcgagcagctgtgcgtgggcttccagagcggcttcctgagataccccctgaacggcgagggcaacccctacagcatgctgcacagcaacgaccacaccctgagcttcatcgcccaccagcccatggacgccatctgcgccgtggagatcagcagcaaggagtacctgctgtgcttcaacagcatcggcatctacaccgactgccagggcagaagaagcagacagcaggagctgatgtggcccgccaaccccagcagctgctgctacaacgccccctacctgagcgtgtacagcgagaacgccgtggacatcttcgacgtgaacagcatggagtggatccagaccctgcccctgaagaaggtgagacccctgaacaacgagggcagcctgaacctgctgggcctggagaccatcagactgatctacttcaagaacaagatggccgagggcgacgagctggtggtgcccgagaccagcgacaacagcagaaagcagatggtgagaaacatcaacaacaagagaagatacagcttcagagtgcccgaggaggagagaatgcagcagagaagagagatgctgagagaccccgagatgagaaacaagctgatcagcaaccccaccaacttcaaccacatcgcccacatgggccccggcgacggcatccagatcctgaaggacctgcccatgaaccccagaccccaggagagcagaaccgtgttcagcggcagcgtgagcatccccagcatcaccaagagcagacccgagcccggcagaagcatgagcgccagcagcggcctgagcgccagaagcagcgcccagaacggcagcgccctgaagagagagttcagcggcggcagctacagcgccaagagacagcccatgcccagccccagcgagggcagcctgagcagcggcggcatggaccagggcagcgacgcccccgccagagacttcgacggcgaggacagcgacagccccagacacagcaccgccagcaacagcagcaacctgagcagcccccccagccccgccagccccagaaagaccaagagcctgagcctggagagcaccgacagaggcagctgggacccctag

SEQ ID NO: 76094 - DNA, 1641 bp, Artificial Sequence
  Description of Artificial Sequence: Synthetic coding sequence
tgagacatcgccgagggcaaggccagccagcccagcgtggtgatcagccaggtgatcgacatgagagacgaggagttcagcgtgagcagcgtgctggccagcgacgtgatccacgccagcagaaaggacatcccctgcatcttcagagtgaccgccagccagctgagcgccagcaacaacaagtgcagcatcctgatgctggccgacaccgagaacgagaagaacaagtgggtgggcgtgctgagcgagctgcacaagatcctgaagaagaacaagttcagagacagaagcgtgtacgtgcccaaggaggcctacgacagcaccctgcccctgatcaagaccacccaggccgccgccatcatcgaccacgagagaatcgccctgggcaacgaggagggcctgttcgtggtgcacgtgaccaaggacgagatcatcagagtgggcgacaacaagaagatccaccagatcgagctgatccccaacgaccagctggtggccgtgatcagcggcagaaacagacacgtgagactgttccccatgagcgccctggacggcagagagaccgacttctacaagctgagcgagaccaagggctgccagaccgtgaccagcggcaaggtgagacacggcgccctgacctgcctgtgcgtggccatgaagagacaggtgctgtgctacgagctgttccagagcaagaccagacacagaaagttcaaggagatccaggtgccctacaacgtgcagtggatggccatcttcagcgagcagctgtgcgtgggcttccagagcggcttcctgagataccccctgaacggcgagggcaacccctacagcatgctgcacagcaacgaccacaccctgagcttcatcgcccaccagcccatggacgccatctgcgccgtggagatcagcagcaaggagtacctgctgtgcttcaacagcatcggcatctacaccgactgccagggcagaagaagcagacagcaggagctgatgtggcccgccaaccccagcagctgctgctacaacgccccctacctgagcgtgtacagcgagaacgccgtggacatcttcgacgtgaacagcatggagtggatccagaccctgcccctgaagaaggtgagacccctgaacaacgagggcagcctgaacctgctgggcctggagaccatcagactgatctacttcaagaacaagatggccgagggcgacgagctggtggtgcccgagaccagcgacaacagcagaaagcagatggtgagaaacatcaacaacaagagaagatacagcttcagagtgcccgaggaggagagaatgcagcagagaagagagatgctgagagaccccgagatgagaaacaagctgatcagcaaccccaccaacttcaaccacatcgcccacatgggccccggcgacggcatccagatcctgaaggacctgcccatgaaccccagaccccaggagagcagaaccgtgttcagcggcagcgtgagcatccccagcatcaccaagagcagacccgagcccggcagaagcatgagcgccagcagcggcctgagcgccagcaagtgcagaggctacagaaaggtgcccctgagacagggcgacccccagctgccccccctgctgagcagaggctag

SEQ ID NO: 76095 - DNA, 2187 bp, Artificial Sequence
  Description of Artificial Sequence: Synthetic coding sequence
tgagtgagcgacgagaaggacgccagaggctacctgcaggccctggccagcaagatgaccgaggagctggaggccctgagaaacagcagcctgggcaccagagccaccgacatgccctggaagatgagaagattcgccaagctggacatgagcgccagactggagctgcagagcgccctggacgccgagatcagagccaagcaggccatccaggaggagctgaacaaggtgaaggccagcaacatcatcaccgagtgcaagctgaaggacagcgagaagaagaacctggagctgctgagcgagatcgagcagctgatcaaggacaccgaggagctgagaagcgagaagggcatcgagcaccaggacagccagcacagcttcctggccttcctgaacacccccaccgacgccctggaccagttcgaggacagcttcagcagcagcagcagcagcctgatcgacttcctggacgacaccgaccccgtggagaacacctacgtgtggaaccccagcgtgaagttccacatccagagcagaagcaccagccccagcaccagcagcgaggccgagcccgtgaagaccgtggacagcacccccctgagcgtgcacacccccaccctgagaaagaagggctgccccggcagcaccggcttcccccccaagagaaagacccaccagttcttcgtgaagagcttcaccacccccaccaagtgccaccagtgcaccagcctgatggtgggcctgatcagacagggctgcagctgcgaggtgtgcggcttcagctgccacatcacctgcgtgaacaaggcccccaccacctgccccgtgccccccgagcagaccaagggccccctgggcatcgacccccagaagggcatcggcaccgcctacgagggccacgtgagaatccccaagcccgccggcgtgaagaagggctggcagagagccctggccatcgtgtgcgacttcaagctgttcctgtacgacatcgccgagggcaaggccagccagcccagcgtggtgatcagccaggtgatcgacatgagagacgaggagttcagcgtgagcagcgtgctggccagcgacgtgatccacgccagcagaaaggacatcccctgcatcttcagagtgaccgccagccagctgagcgccagcaacaacaagtgcagcatcctgatgctggccgacaccgagaacgagaagaacaagtgggtgggcgtgctgagcgagctgcacaagatcctgaagaagaacaagttcagagacagaagcgtgtacgtgcccaaggaggcctacgacagcaccctgcccctgatcaagaccacccaggccgccgccatcatcgaccacgagagaatcgccctgggcaacgaggagggcctgttcgtggtgcacgtgaccaaggacgagatcatcagagtgggcgacaacaagaagatccaccagatcgagctgatccccaacgaccagctggtggccgtgatcagcggcagaaacagacacgtgagactgttccccatgagcgccctggacggcagagagaccgacttctacaagctgagcgagaccaagggctgccagaccgtgaccagcggcaaggtgagacacggcgccctgacctgcctgtgcgtggccatgaagagacaggtgctgtgctacgagctgttccagagcaagaccagacacagaaagttcaaggagatccaggtgccctacaacgtgcagtggatggccatcttcagcgagcagctgtgcgtgggcttccagagcggcttcctgagataccccctgaacggcgagggcaacccctacagcatgctgcacagcaacgaccacaccctgagcttcatcgcccaccagcccatggacgccatctgcgccgtggagatcagcagcaaggagtacctgctgtgcttcaacagcatcggcatctacaccgactgccagggcagaagaagcagacagcaggagctgatgtggcccgccaaccccagcagctgctgctacaacgccccctacctgagcgtgtacagcgagaacgccgtggacatcttcgacgtgaacagcatggagtggatccagaccctgcccctgaagaaggtgagacccctgaacaacgagggcagcctgaacctgctgggcctggagaccatcagactgatctacttcaagaacaagatggcctag

SEQ ID NO: 76096 - DNA, 3147 bp, Artificial Sequence
  Description of Artificial Sequence: Synthetic coding sequence
tgagagggcatccacgccaacgagatcaagaacctgaagaaggagctgcacgacagcgagggccagcagctggccctgaacaaggagatcatgatcctgaaggacaagctggagaagaccagaagagagagccagagcgagagagaggagttcgagagcgagttcaagcagcagtacgagagagagaaggtgctgctgaccgaggagaacaagaagctgaccagcgagctggacaagctgaccaccctgtacgagaacctgagcatccacaaccagcagctggaggaggaggtgaaggacctggccgacaagaaggagagcgtggcccactgggaggcccagatcaccgagatcatccagtgggtgagcgacgagaaggacgccagaggctacctgcaggccctggccagcaagatgaccgaggagctggaggccctgagaaacagcagcctgggcaccagagccaccgacatgccctggaagatgagaagattcgccaagctggacatgagcgccagactggagctgcagagcgccctggacgccgagatcagagccaagcaggccatccaggaggagctgaacaaggtgaaggccagcaacatcatcaccgagtgcaagctgaaggacagcgagaagaagaacctggagctgctgagcgagatcgagcagctgatcaaggacaccgaggagctgagaagcgagaagggcatcgagcaccaggacagccagcacagcttcctggccttcctgaacacccccaccgacgccctggaccagttcgagaccgaccccgtggagaacacctacgtgtggaaccccagcgtgaagttccacatccagagcagaagcaccagccccagcaccagcagcgaggccgagcccgtgaagaccgtggacagcacccccctgagcgtgcacacccccaccctgagaaagaagggctgccccggcagcaccggcttcccccccaagagaaagacccaccagttcttcgtgaagagcttcaccacccccaccaagtgccaccagtgcaccagcctgatggtgggcctgatcagacagggctgcagctgcgaggtgtgcggcttcagctgccacatcacctgcgtgaacaaggcccccaccacctgccccgtgccccccgagcagaccaagggccccctgggcatcgacccccagaagggcatcggcaccgcctacgagggccacgtgagaatccccaagcccgccggcgtgaagaagggctggcagagagccctggccatcgtgtgcgacttcaagctgttcctgtacgacatcgccgagggcaaggccagccagcccagcgtggtgatcagccaggtgatcgacatgagagacgaggagttcagcgtgagcagcgtgctggccagcgacgtgatccacgccagcagaaaggacatcccctgcatcttcagagtgaccgccagccagctgagcgccagcaacaacaagtgcagcatcctgatgctggccgacaccgagaacgagaagaacaagtgggtgggcgtgctgagcgagctgcacaagatcctgaagaagaacaagttcagagacagaagcgtgtacgtgcccaaggaggcctacgacagcaccctgcccctgatcaagaccacccaggccgccgccatcatcgaccacgagagaatcgccctgggcaacgaggagggcctgttcgtggtgcacgtgaccaaggacgagatcatcagagtgggcgacaacaagaagatccaccagatcgagctgatccccaacgaccagctggtggccgtgatcagcggcagaaacagacacgtgagactgttccccatgagcgccctggacggcagagagaccgacttctacaagctgagcgagaccaagggctgccagaccgtgaccagcggcaaggtgagacacggcgccctgacctgcctgtgcgtggccatgaagagacaggtgctgtgctacgagctgttccagagcaagaccagacacagaaagttcaaggagatccaggtgccctacaacgtgcagtggatggccatcttcagcgagcagctgtgcgtgggcttccagagcggcttcctgagataccccctgaacggcgagggcaacccctacagcatgctgcacagcaacgaccacaccctgagcttcatcgcccaccagcccatggacgccatctgcgccgtggagatcagcagcaaggagtacctgctgtgcttcaacagcatcggcatctacaccgactgccagggcagaagaagcagacagcaggagctgatgtggcccgccaaccccagcagctgctgctacaacgccccctacctgagcgtgtacagcgagaacgccgtggacatcttcgacgtgaacagcatggagtggatccagaccctgcccctgaagaaggtgagacccctgaacaacgagggcagcctgaacctgctgggcctggagaccatcagactgatctacttcaagaacaagatggccgagggcgacgagctggtggtgcccgagaccagcgacaacagcagaaagcagatggtgagaaacatcaacaacaagagaagatacagcttcagagtgcccgaggaggagagaatgcagcagagaagagagatgctgagagaccccgagatgagaaacaagctgatcagcaaccccaccaacttcaaccacatcgcccacatgggccccggcgacggcatccagatcctgaaggacctgcccatgaaccccagaccccaggagagcagaaccgtgttcagcggcagcgtgagcatccccagcatcaccaagagcagacccgagcccggcagaagcatgagcgccagcagcggcctgagcgccagaagcagcgcccagaacggcagcgccctgaagagagagttcagcggcggcagctacagcgccaagagacagcccatgcccagccccagcgagggcagcctgagcagcggcggcatggaccagggcagcgacgcccccgccagagacttcgacggcgaggacagcgacagccccagacacagcaccgccagcaacagcagcaacctgagcagcccccccagccccgccagccccagaaagaccaagagcctgagcctggagagcaccgacagaggcagctgggacccctag

SEQ ID NO: 76097 - DNA, 2955 bp, Artificial Sequence
  Description of Artificial Sequence: Synthetic coding sequence
tgacagctggaggaggaggtgaaggacctggccgacaagaaggagagcgtggcccactgggaggcccagatcaccgagatcatccagtgggtgagcgacgagaaggacgccagaggctacctgcaggccctggccagcaagatgaccgaggagctggaggccctgagaaacagcagcctgggcaccagagccaccgacatgccctggaagatgagaagattcgccaagctggacatgagcgccagactggagctgcagagcgccctggacgccgagatcagagccaagcaggccatccaggaggagctgaacaaggtgaaggccagcaacatcatcaccgagtgcaagctgaaggacagcgagaagaagaacctggagctgctgagcgagatcgagcagctgatcaaggacaccgaggagctgagaagcgagaagggcatcgagcaccaggacagccagcacagcttcctggccttcctgaacacccccaccgacgccctggaccagttcgagaccgtggacagcacccccctgagcgtgcacacccccaccctgagaaagaagggctgccccggcagcaccggcttcccccccaagagaaagacccaccagttcttcgtgaagagcttcaccacccccaccaagtgccaccagtgcaccagcctgatggtgggcctgatcagacagggctgcagctgcgaggtgtgcggcttcagctgccacatcacctgcgtgaacaaggcccccaccacctgccccgtgccccccgagcagaccaagggccccctgggcatcgacccccagaagggcatcggcaccgcctacgagggccacgtgagaatccccaagcccgccggcgtgaagaagggctggcagagagccctggccatcgtgtgcgacttcaagctgttcctgtacgacatcgccgagggcaaggccagccagcccagcgtggtgatcagccaggtgatcgacatgagagacgaggagttcagcgtgagcagcgtgctggccagcgacgtgatccacgccagcagaaaggacatcccctgcatcttcagagtgaccgccagccagctgagcgccagcaacaacaagtgcagcatcctgatgctggccgacaccgagaacgagaagaacaagtgggtgggcgtgctgagcgagctgcacaagatcctgaagaagaacaagttcagagacagaagcgtgtacgtgcccaaggaggcctacgacagcaccctgcccctgatcaagaccacccaggccgccgccatcatcgaccacgagagaatcgccctgggcaacgaggagggcctgttcgtggtgcacgtgaccaaggacgagatcatcagagtgggcgacaacaagaagatccaccagatcgagctgatccccaacgaccagctggtggccgtgatcagcggcagaaacagacacgtgagactgttccccatgagcgccctggacggcagagagaccgacttctacaagctgagcgagaccaagggctgccagaccgtgaccagcggcaaggtgagacacggcgccctgacctgcctgtgcgtggccatgaagagacaggtgctgtgctacgagctgttccagagcaagaccagacacagaaagttcaaggagatccaggtgccctacaacgtgcagtggatggccatcttcagcgagcagctgtgcgtgggcttccagagcggcttcctgagataccccctgaacggcgagggcaacccctacagcatgctgcacagcaacgaccacaccctgagcttcatcgcccaccagcccatggacgccatctgcgccgtggagatcagcagcaaggagtacctgctgtgcttcaacagcatcggcatctacaccgactgccagggcagaagaagcagacagcaggagctgatgtggcccgccaaccccagcagctgctgctacaacgccccctacctgagcgtgtacagcgagaacgccgtggacatcttcgacgtgaacagcatggagtggatccagaccctgcccctgaagaaggtgagacccctgaacaacgagggcagcctgaacctgctgggcctggagaccatcagactgatctacttcaagaacaagatggccgagggcgacgagctggtggtgcccgagaccagcgacaacagcagaaagcagatggtgagaaacatcaacaacaagagaagatacagcttcagagtgcccgaggaggagagaatgcagcagagaagagagatgctgagagaccccgagatgagaaacaagctgatcagcaaccccaccaacttcaaccacatcgcccacatgggccccggcgacggcatccagatcctgaaggacctgcccatgcccggcttcccctaccccagcccccaccaccacagcggcctgatcagcagccccatcaacttcgagcacatctaccacatgaccgtgaacagcgccgagaagttcctgagccccgacagcatcaaccccgagtacagccccagcctgagaagcgtgcccggcacccccagcttcatgaccctgagaaaccccagaccccaggagagcagaaccgtgttcagcggcagcgtgagcatccccagcatcaccaagagcagacccgagcccggcagaagcatgagcgccagcagcggcctgagcgccagaagcagcgcccagaacggcagcgccctgaagagagagttcagcggcggcagctacagcgccaagagacagcccatgcccagccccagcgagggcagcctgagcagcggcggcatggaccagggcagcgacgcccccgccagagacttcgacggcgaggacagcgacagccccagacacagcaccgccagcaacagcagcaacctgagcagcccccccagccccgccagccccagaaagaccaagagcctgagcctggagagcaccgacagaggcagctgggacccctag

SEQ ID NO: 76098 - DNA, 5100 bp, Artificial Sequence
  Description of Artificial Sequence: Synthetic coding sequence
atgagcggcgaggtgagactgagacagctggagcagttcatcctggacggccccgcccagaccaacggccagtgcttcagcgtggagaccctgctggacatcctgatctgcctgtacgacgagtgcaacaacagccccctgagaagagagaagaacatcctggagtacctggagtgggccaagcccttcaccagcaaggtgaagcagatgagactgcacagagaggacttcgagatcctgaaggtgatcggcagaggcgccttcggcgaggtggccgtggtgaagctgaagaacgccgacaaggtgttcgccatgaagatcctgaacaagtgggagatgctgaagagagccgagaccgcctgcttcagagaggagagagacgtgctggtgaacggcgacaacaagtggatcaccaccctgcactacgccttccaggacgacaacaacctgtacctggtgatggactactacgtgggcggcgacctgctgaccctgctgagcaagttcgaggacagactgcccgaggacatggccagattctacctggccgagatggtgatcgccatcgacagcgtgcaccagctgcactacgtgcacagagacatcaagcccgacaacatcctgatggacatgaacggccacatcagactggccgacttcggcagctgcctgaagctgatggaggacggcaccgtgcagagcagcgtggccgtgggcacccccgactacatcagccccgagatcctgcaggccatggaggacggcaagggcagatacggccccgagtgcgactggtggagcctgggcgtgtgcatgtacgagatgctgtacggcgagacccccttctacgccgagagcctggtggagacctacggcaagatcatgaaccacaaggagagattccagttccccgcccaggtgaccgacgtgagcgagaacgccaaggacctgatcagaagactgatctgcagcagagagcacagactgggccagaacggcatcgaggacttcaagaagcaccccttcttcagcggcatcgactgggacaacatcagaaactgcgaggccccctacatccccgaggtgagcagccccaccgacaccagcaacttcgacgtggacgacgactgcctgaagaacagcgagaccatgcccccccccacccacaccgccttcagcggccaccacctgcccttcgtgggcttcacctacaccagcagctgcgtgctgagcgacagaagctgcctgagagtgaccgccggccccaccagcctggacctggacgtgaacgtgcagagaaccctggacaacaacctggccaccgaggcctacgagagaagaatcaagagactggagcaggagaagctggagctgagcagaaagctgcaggagagcacccagaccgtgcaggccctgcagtacagcaccgtggacggccccctgaccgccagcaaggacctggagatcaagaacctgaaggaggagatcgagaagctgagaaagcaggtgaccgagagcagccacctggagcagcagctggaggaggccaacgccgtgagacaggagctggacgacgccttcagacagatcaaggcctacgagaagcagatcaagaccctgcagcaggagagagaggacctgaacaaggagctggtgcaggccagcgagagactgaagaaccagagcaaggagctgaaggacgcccactgccagagaaagctggccatgcaggagttcatggagatcaacgagagactgaccgagctgcacacccagaagcagaagctggccagacacgtgagagacaaggaggaggaggtggacctggtgatgcagaaggtggagagcctgagacaggagctgagaagaaccgagagagccaagaaggagctggaggtgcacaccgaggccctggccgccgaggccagcaaggacagaaagctgagagagcagagcgagcactacagcaagcagctggagaacgagctggagggcctgaagcagaagcagatcagctacagccccggcgtgtgcagcatcgagcaccagcaggagatcaccaagctgaagaccgacctggagaagaagagcatcttctacgaggaggagctgagcaagagagagggcatccacgccaacgagatcaagaacctgaagaaggagctgcacgacagcgagggccagcagctggccctgaacaaggagatcatgatcctgaaggacaagctggagaagaccagaagagagagccagagcgagagagaggagttcgagagcgagttcaagcagcagtacgagagagagaaggtgctgctgaccgaggagaacaagaagctgaccagcgagctggacaagctgaccaccctgtacgagaacctgagcatccacaaccagcagctggaggaggaggtgaaggacctggccgacaagaaggagagcgtggcccactgggaggcccagatcaccgagatcatccagtgggtgagcgacgagaaggacgccagaggctacctgcaggccctggccagcaagatgaccgaggagctggaggccctgagaaacagcagcctgggcaccagagccaccgacatgccctggaagatgagaagattcgccaagctggacatgagcgccagactggagctgcagagcgccctggacgccgagatcagagccaagcaggccatccaggaggagctgaacaaggtgaaggccagcaacatcatcaccgagtgcaagctgaaggacagcgagaagaagaacctggagctgctgagcgagatcgagcagctgatcaaggacaccgaggagctgagaagcgagaaggccagcaagggcagaagaaccgtggacagcacccccctgagcgtgcacacccccaccctgagaaagaagggctgccccggcagcaccggcttcccccccaagagaaagacccaccagttcttcgtgaagagcttcaccacccccaccaagtgccaccagtgcaccagcctgatggtgggcctgatcagacagggctgcagctgcgaggtgtgcggcttcagctgccacatcacctgcgtgaacaaggcccccaccacctgccccgtgccccccgagcagaccaagggccccctgggcatcgacccccagaagggcatcggcaccgcctacgagggccacgtgagaatccccaagcccgccggcgtgaagaagggctggcagagagccctggccatcgtgtgcgacttcaagctgttcctgtacgacatcgccgagggcaaggccagccagcccagcgtggtgatcagccaggtgatcgacatgagagacgaggagttcagcgtgagcagcgtgctggccagcgacgtgatccacgccagcagaaaggacatcccctgcatcttcagagtgaccgccagccagctgagcgccagcaacaacaagtgcagcatcctgatgctggccgacaccgagaacgagaagaacaagtgggtgggcgtgctgagcgagctgcacaagatcctgaagaagaacaagttcagagacagaagcgtgtacgtgcccaaggaggcctacgacagcaccctgcccctgatcaagaccacccaggccgccgccatcatcgaccacgagagaatcgccctgggcaacgaggagggcctgttcgtggtgcacgtgaccaaggacgagatcatcagagtgggcgacaacaagaagatccaccagatcgagctgatccccaacgaccagctggtggccgtgatcagcggcagaaacagacacgtgagactgttccccatgagcgccctggacggcagagagaccgacttctacaagctgagcgagaccaagggctgccagaccgtgaccagcggcaaggtgagacacggcgccctgacctgcctgtgcgtggccatgaagagacaggtgctgtgctacgagctgttccagagcaagaccagacacagaaagttcaaggagatccaggtgccctacaacgtgcagtggatggccatcttcagcgagcagctgtgcgtgggcttccagagcggcttcctgagataccccctgaacggcgagggcaacccctacagcatgctgcacagcaacgaccacaccctgagcttcatcgcccaccagcccatggacgccatctgcgccgtggagatcagcagcaaggagtacctgctgtgcttcaacagcatcggcatctacaccgactgccagggcagaagaagcagacagcaggagctgatgtggcccgccaaccccagcagctgctgctacaacgccccctacctgagcgtgtacagcgagaacgccgtggacatcttcgacgtgaacagcatggagtggatccagaccctgcccctgaagaaggtgagacccctgaacaacgagggcagcctgaacctgctgggcctggagaccatcagactgatctacttcaagaacaagatggccgagggcgacgagctggtggtgcccgagaccagcgacaacagcagaaagcagatggtgagaaacatcaacaacaagagaagatacagcttcagagtgcccgaggaggagagaatgcagcagagaagagagatgctgagagaccccgagatgagaaacaagctgatcagcaaccccaccaacttcaaccacatcgcccacatgggccccggcgacggcatccagatcctgaaggacctgcccatgaaccccagaccccaggagagcagaaccgtgttcagcggcagcgtgagcatccccagcatcaccaagagcagacccgagcccggcagaagcatgagcgccagcagcggcctgagcgccagaagcagcgcccagaacggcagcgccctgaagagagagttcagcggcggcagctacagcgccaagagacagcccatgcccagccccagcgagggcagcctgagcagcggcggcatggaccagggcagcgacgcccccgccagagacttcgacggcgaggacagcgacagccccagacacagcaccgccagcaacagcagcaacctgagcagcccccccagccccgccagccccagaaagaccaagagcctgagcctggagagcaccgacagaggcagctgggacccctag

SEQ ID NO: 76099 - DNA, 5136 bp, Artificial Sequence
  Description of Artificial Sequence: Synthetic coding sequence
atgagcgccaaggtgagactgaagaagctggagcagctgctgctggacggcccctggagaaacgagagcgccctgagcgtggagaccctgctggacgtgctggtgtgcctgtacaccgagtgcagccacagcgccctgagaagagacaagtacgtggccgagttcctggagtgggccaagcccttcacccagctggtgaaggagatgcagctgcacagagaggacttcgagatcatcaaggtgatcggcagaggcgccttcggcgaggtggccgtggtgaagatgaagaacaccgagagaatctacgccatgaagatcctgaacaagtgggagatgctgaagagagccgagaccgcctgcttcagagaggagagagacgtgctggtgaacggcgactgccagtggatcaccgccctgcactacgccttccaggacgagaaccacctgtacctggtgatggactactacgtgggcggcgacctgctgaccctgctgagcaagttcgaggacaagctgcccgaggacatggccagattctacatcggcgagatggtgctggccatcgacagcatccaccagctgcactacgtgcacagagacatcaagcccgacaacgtgctgctggacgtgaacggccacatcagactggccgacttcggcagctgcctgaagatgaacgacgacggcaccgtgcagagcagcgtggccgtgggcacccccgactacatcagccccgagatcctgcaggccatggaggacggcatgggcaagtacggccccgagtgcgactggtggagcctgggcgtgtgcatgtacgagatgctgtacggcgagacccccttctacgccgagagcctggtggagacctacggcaagatcatgaaccacgaggagagattccagttccccagccacgtgaccgacgtgagcgaggaggccaaggacctgatccagagactgatctgcagcagagagagaagactgggccagaacggcatcgaggacttcaagaagcacgccttcttcgagggcctgaactgggagaacatcagaaacctggaggccccctacatccccgacgtgagcagccccagcgacaccagcaacttcgacgtggacgacgacgtgctgagaaacaccgagatcctgccccccggcagccacaccggcttcagcggcctgcacctgcccttcatcggcttcaccttcaccaccgagagctgcttcagcgacagaggcagcctgaagagcatcatgcagagcaacaccctgaccaaggacgaggacgtgcagagagacctggagcacagcctgcagatggaggcctacgagagaagaatcagaagactggagcaggagaagctggagctgagcagaaagctgcaggagagcacccagaccgtgcagagcctgcacggcagcagcagagccctgagcaacagcaacagagacaaggagatcaagaagctgaacgaggagatcgagagactgaagaacaagatcgccgacagcaacagactggagagacagctggaggacaccgtggccctgagacaggagagagaggacagcacccagagactgagaggcctggagaagcagcacagagtggtgagacaggagaaggaggagctgcacaagcagctggtggaggccagcgagagactgaagagccaggccaaggagctgaaggacgcccaccagcagagaaagctggccctgcaggagttcagcgagctgaacgagagaatggccgagctgagagcccagaagcagaaggtgagcagacagctgagagacaaggaggaggagatggaggtggccacccagaaggtggacgccatgagacaggagatgagaagagccgagaagctgagaaaggagctggaggcccagctggacgacgccgtggccgaggccagcaaggagagaaagctgagagagcacagcgagaacttctgcaagcagatggagagcgagctggaggccctgaaggtgaagcagggcggcagaggcgccggcgccaccctggagcaccagcaggagatcagcaagatcaagagcgagctggagaagaaggtgctgttctacgaggaggagctggtgagaagagaggccagccacgtgctggaggtgaagaacgtgaagaaggaggtgcacgacagcgagagccaccagctggccctgcagaaggagatcctgatgctgaaggacaagctggagaagagcaagagagagagacacaacgagatggaggaggccgtgggcaccatcaaggacaagtacgagagagagagagccatgctgttcgacgagaacaagaagctgaccgccgagaacgagaagctgtgcagcttcgtggacaagctgaccgcccagaacagacagctggaggacgagctgcaggacctggccgccaagaaggagagcgtggcccactgggaggcccagatcgccgagatcatccagtgggtgagcgacgagaaggacgccagaggctacctgcaggccctggccagcaagatgaccgaggagctggaggccctgagaagcagcagcctgggcagcagaaccctggaccccctgtggaaggtgagaagaagccagaagctggacatgagcgccagactggagctgcagagcgccctggaggccgagatcagagccaagcagctggtgcaggaggagctgagaaaggtgaaggacgccaacctgaccctggagagcaagctgaaggacagcgaggccaagaacagagagctgctggaggagatggagatcctgaagaagaagatggaggagaagttcagagccgacaccggcctgaagctgcccgacttccaggacagcatcttcgagtacttcaacaccgcccccctggcccacgacctgaccttcagaaccagcagcgccagcgagcaggagacccaggcccccaagcccgaggccagccccagcatgagcgtggccgccagcgagcagcaggaggacatggccagacccccccagagacccagcgccgtgcccctgcccaccacccaggccctggccctggccggccccaagcccaaggcccaccagttcagcatcaagagcttcagcagccccacccagtgcagccactgcaccagcctgatggtgggcctgatcagacagggctacgcctgcgaggtgtgcagcttcgcctgccacgtgagctgcaaggacggcgccccccaggtgtgccccatcccccccgagcagagcaagagacccctgggcgtggacgtgcagagaggcatcggcaccgcctacaagggccacgtgaaggtgcccaagcccaccggcgtgaagaagggctggcagagagcctacgccgtggtgtgcgactgcaagctgttcctgtacgacctgcccgagggcaagagcacccagcccggcgtgatcgccagccaggtgctggacctgagagacgacgagttcagcgtgagcagcgtgctggccagcgacgtgatccacgccaccagaagagacatcccctgcatcttcagagtgaccgccagcctgctgggcgcccccagcaagaccagcagcctgctgatcctgaccgagaacgagaacgagaagagaaagtgggtgggcatcctggagggcctgcagagcatcctgcacaagaacagactgagaaaccaggtggtgcacgtgcccctggaggcctacgacagcagcctgcccctgatcaaggccatcctgaccgccgccatcgtggacgccgacagaatcgccgtgggcctggaggagggcctgtacgtgatcgaggtgaccagagacgtgatcgtgagagccgccgactgcaagaaggtgcaccagatcgagctggcccccagagagaagatcgtgatcctgctgtgcggcagaaaccaccacgtgcacctgtacccctggagcagcctggacggcgccgagggcagcttcgacatcaagctgcccgagaccaagggctgccagctgatggccaccgccaccctgaagagaaacagcggcacctgcctgttcgtggccgtgaagagactgatcctgtgctacgagatccagagaaccaagcccttccacagaaagttcaacgagatcgtggcccccggcagcgtgcagtgcctggccgtgctgagagacagactgtgcgtgggctaccccagcggcttctgcctgctgagcatccagggcgacggccagcccctgaacctggtgaaccccaacgaccccagcctggccttcctgagccagcagagcttcgacgccctgtgcgccgtggagctggagagcgaggagtacctgctgtgcttcagccacatgggcctgtacgtggacccccagggcagaagagccagagcccaggagctgatgtggcccgccgcccccgtggcctgcagctgcagccccacccacgtgaccgtgtacagcgagtacggcgtggacgtgttcgacgtgagaaccatggagtgggtgcagaccatcggcctgagaagaatcagacccctgaacagcgagggcaccctgaacctgctgaactgcgagccccccagactgatctacttcaagagcaagttcagcggcgccgtgctgaacgtgcccgacaccagcgacaacagcaagaagcagatgctgagaaccagaagcaagagaagattcgtgttcaaggtgcccgaggaggagagactgcagcagagaagagagatgctgagagaccccgagctgagaagcaagatgatcagcaaccccaccaacttcaaccacgtggcccacatgggccccggcgacggcatgcaggtgctgatggacctgcccctgagcgccgtgccccccagccaggaggagagacccggccccgcccccaccaacctggccagacagccccccagcagaaacaagccctacatcagctggcccagcagcggcggcagcgagcccagcgtgaccgtgcccctgagaagcatgagcgaccccgaccaggacttcgacaaggagcccgacagcgacagcaccaagcacagcacccccagcaacagcagcaaccccagcggcccccccagccccaacagcccccacagaagccagctgcccctggagggcctggagcagcccgcctgcgacacctag

SEQ ID NO: 76100 - DNA, 1593 bp, Artificial Sequence
  Description of Artificial Sequence: Synthetic coding sequence
aaggtgagaagaagccagaagctggacatgagcgccagactggagctgcagagcgccctggaggccgagatcagagccaagcagctggtgcaggaggagctgagaaaggtgaaggacgccaacctgaccctggagagcaagctgaaggacagcgaggccaagaacagagagctgctggaggagatggagatcctgaagaagaagatggaggagaagttcagagccgacaccggcctgaagctgcccgacttccaggacagcatcttcgagtacttcaacaccgcccccctggcccacgacctgaccttcagaaccagcagcgccagcgagcaggagacccaggcccccaagcccgaggccagccccagcatgagcgtggccgccagcgagcagcaggagcccaaggcccaccagttcagcatcaagagcttcagcagccccacccagtgcagccactgcaccagcctgatggtgggcctgatcagacagggctacgcctgcgaggtgtgcagcttcgcctgccacgtgagctgcaaggacggcgccccccaggtgtgccccatcccccccgagcagagcaagagacccctgggcgtggacgtgcagagaggcatcggcaccgcctacaagggccacgtgaaggtgcccaagcccaccggcgtgaagaagggctggcagagagcctacgccgtggtgtgcgactgcaagctgttcctgtacgacctgcccgagggcaagagcacccagcccggcgtgatcgccagccaggtgctggacctgagagacgacgagttcagcgtgagcagcgtgctggccagcgacgtgatccacgccaccagaagagacatcccctgcatcttcagagtgaccgccagcctgctgggcgcccccagcaagaccagcagcctgctgatcctgaccgagaacgagaacgagaagagaaagtgggtgggcatcctggagggcctgcagagcatcctgcacaagaacagactgagaaaccaggtggtgcacgtgcccctggaggcctacgacagcagcctgcccctgatcaaggccatcctgaccgccgccatcgtggacgccgacagaatcgccgtgggcctggaggagggcctgtacgtgatcgaggtgaccagagacgtgatcgtgagagccgccgactgcaagaaggtgcaccagatcgagctggcccccagagagaagatcgtgatcctgctgtgcggcagaaaccaccacgtgcacctgtacccctggagcagcctggacggcgccgagggcagcttcgacatcaagctgcccgagaccaagggctgccagctgatggccaccgccaccctgaagagaaacagcggcacctgcctgttcgtggccgtgaagagactgatcctgtgctacgagatccagagaaccaagcccttccacagaaagttcaacgagatcgtggcccccggcagcgtgcagtgcctggccgtgctgagagacagactgtgcgtgggctaccccagcggcttctgcctgctgagcatccagggcgacggccagcccctgaacctggtgaaccccaacgaccccagcctggccttcctgtag

SEQ ID NO: 76101 - DNA, 4656 bp, Artificial Sequence
  Description of Artificial Sequence: Synthetic coding sequence
atggagagaagactgagagccctggagcagctggccagaggcgaggccggcggctgccccggcctggacggcctgctggacctgctgctggccctgcaccacgagctgagcagcggccccctgagaagagagagaagcgtggcccagttcctgagctgggccagccccttcgtgagcaaggtgaaggagctgagactgcagagagacgacttcgagatcctgaaggtgatcggcagaggcgccttcggcgaggtgaccgtggtgagacagagagacaccggccagatcttcgccatgaagatgctgcacaagtgggagatgctgaagagagccgagaccgcctgcttcagagaggagagagacgtgctggtgaagggcgacagcagatgggtgaccaccctgcactacgccttccaggacgaggagtacctgtacctggtgatggactactacgccggcggcgacctgctgaccctgctgagcagattcgaggacagactgccccccgagctggcccagttctacctggccgagatggtgctggccatccacagcctgcaccagctgggctacgtgcacagagacgtgaagcccgacaacgtgctgctggacgtgaacggccacatcagactggccgacttcggcagctgcctgagactgaacaccaacggcatggtggacagcagcgtggccgtgggcacccccgactacatcagccccgagatcctgcaggccatggaggagggcaagggccactacggcccccagtgcgactggtggagcctgggcgtgtgcgcctacgagctgctgttcggcgagacccccttctacgccgagagcctggtggagacctacggcaagatcatgaaccacgaggaccacctgcagttcccccccgacgtgcccgacgtgcccgccagcgcccaggacctgatcagacagctgctgtgcagacaggaggagagactgggcagaggcggcctggacgacttcagaaaccaccccttcttcgagggcgtggactgggagagactggccagcagcaccgccccctacatccccgagctgagaggccccatggacaccagcaacttcgacgtggacgacgacaccctgaaccaccccggcaccctgcccccccccagccacggcgccttcagcggccaccacctgcccttcgtgggcttcacctacaccagcggcagccacagccccgagagcagcagcgaggcctgggccgccctggagagaaagctgcagtgcctggagcaggagaaggtggagctgagcagaaagcaccaggaggccctgcacgcccccaccgaccacagagagctggagcagctgagaaaggaggtgcagaccctgagagacagactgcccgagatgctgagagacaaggccagcctgagccagaccgacggcccccccgccggcagccccggccaggacagcgacctgagacaggagctggacagactgcacagagagctggccgagggcagagccggcctgcaggcccaggagcaggagctgtgcagagcccagggccagcaggaggagctgctgcagagactgcaggaggcccaggagagagaggccgccaccgccagccagaccagagccctgagcagccagctggaggaggccagagccgcccagagagagctggaggcccaggtgagcagcctgagcagacaggtgacccagctgcagggccagtgggagcagagactggaggagagcagccaggccaagaccatccacaccgccagcgagaccaacggcatgggcccccccgagggcggcccccaggaggcccagctgagaaaggaggtggccgccctgagagagcagctggagcaggcccacagccacagacccagcggcaaggaggaggccctgtgccagctgcaggaggagaacagaagactgagcagagagcaggagagactggaggccgagctggcccaggagcaggagagcaagcagagactggagggcgagagaagagagaccgagagcaactgggaggcccagctggccgacatcctgagctgggtgaacgacgagaaggtgagcagaggctacctgcaggccctggccaccaagatggccgaggagctggagagcctgagaaacgtgggcacccagaccctgcccgccagacccctggaccaccagtggaaggccagaagactgcagaagatggaggccagcgccagactggagctgcagagcgccctggaggccgagatcagagccaagcagggcctgcaggagagactgacccaggtgcaggaggcccagctgcaggccgagagaagactgcaggaggccgagaagcagagccaggccctgcagcaggagctggccatgctgagagaggagctgagagccagaggccccgtggacaccaagcccagcaacagcctgatccccttcctgagcttcagaagcagcgagaaggacagcgccaaggaccccggcatcagcggcgaggccaccagacacggcggcgagcccgacctgagacccgagggcagaagaagcctgagaatgggcgccgtgttccccagagcccccaccgccaacaccgccagcaccgagggcctgcccgccaagcccggcagccacaccctgagacccagaagcttccccagccccaccaagtgcctgagatgcaccagcctgatgctgggcctgggcagacagggcctgggctgcgacgcctgcggctacttctgccacaccacctgcgccccccaggcccccccctgccccgtgccccccgacctgctgagaaccgccctgggcgtgcaccccgagaccggcaccggcaccgcctacgagggcttcctgagcgtgcccagacccagcggcgtgagaagaggctggcagagagtgttcgccgccctgagcgacagcagactgctgctgttcgacgcccccgacctgagactgagcccccccagcggcgccctgctgcaggtgctggacctgagagacccccagttcagcgccacccccgtgctggccagcgacgtgatccacgcccagagcagagacctgcccagaatcttcagagtgaccaccagccagctggccgtgccccccaccacctgcaccgtgctgctgctggccgagagcgagggcgagagagagagatggctgcaggtgctgggcgagctgcagagactgctgctggacgccagacccagacccagacccgtgtacaccctgaaggaggcctacgacaacggcctgcccctgctgccccacaccctgtgcgccgccatcctggaccaggacagactggccctgggcaccgaggagggcctgttcgtgatccacctgagaagcaacgacatcttccaggtgggcgagtgcagaagagtgcagcagctgaccctgagccccagcgccggcctgctggtggtgctgtgcggcagaggccccagcgtgagactgttcgccctggccgagctggagaacatcgaggtggccggcgccaagatccccgagagcagaggctgccaggtgctggccgccggcagcatcctgcaggccagaacccccgtgctgtgcgtggccgtgaagagacaggtgctgtgctaccagctgggccccggccccggcccctggcagagaagaatcagagagctgcaggcccccgccaccgtgcagagcctgggcctgctgggcgacagactgtgcgtgggcgccgccggcggcttcgccctgtaccccctgctgaacgaggccgcccccctggccctgggcgccggcctggtgcccgaggagctgccccccagcagaggcggcctgggcgaggccctgggcgccgtggagctgagcctgagcgagttcctgctgctgttcaccaccgccggcatctacgtggacggcgccggcagaaagagcagaggccacgagctgctgtggcccgccgcccccatgggctggggctacgccgccccctacctgaccgtgttcagcgagaacagcatcgacgtgttcgacgtgagaagagccgagtgggtgcagaccgtgcccctgaagaaggtgagacccctgaaccccgagggcagcctgttcctgtacggcaccgagaaggtgagactgacctacctgagaaaccagctggccgagaaggacgagttcgacatccccgacctgaccgacaacagcagaagacagctgttcagaaccaagagcaagagaagattcttcttcagagtgagcgaggagcagcagaagcagcagagaagagagatgctgaaggaccccttcgtgagaagcaagctgatcagcccccccaccaacttcaaccacctggtgcacgtgggccccgccaacggcagacccggcgccagagacaagagccccgcccccgaggagaagggcagagtggccagaggcagcggcccccagagaccccacagcttcagcgaggccctgagaagacccgccagcatgggcagcgagggcctgggcggcgacgccgaccccatgaagagaaagccctggaccagcctgagcagcgagagcgtgagctgcccccagggcagcctgagccccgccaccagcctgatgcaggtgagcgagagacccagaagcctgcccctgagccccgagctggagagcagcccctag

SEQ ID NO: 76102 - DNA, 1176 bp, Artificial Sequence
  Description of Artificial Sequence: Synthetic coding sequence
atgcccggcccccagggcggcagaggcgccgccaccatgagcctgggcaagctgagccccgtgggctgggtgagcagcagccagggcaagagaagactgaccgccgacatgatcagccaccccctgggcgacttcagacacaccatgcacgtgggcagaggcggcgacgtgttcggcgacaccagcttcctgagcaaccacggcggcagcagcggcagcacccacagaagccccagaagcttcctggccaagaagctgcagctggtgagaagagtgggcgccccccccagaagaatggccagcccccccgcccccagccccgccccccccgccatcagccccatcatcaagaacgccatcagcctgccccagctgaaccaggccgcctacgacagcctggtggtgggcaagctgagcttcgacagcagccccaccagcagcaccgacggccacagcagctacggcctggacagcggcttctgcaccatcagcagactgcccagaagcgagaagccccacgacagagacagagacggcagcttccccagcgagcccggcctgagaagaagcgacagcctgctgagcttcagactggacctggacctgggccccagcctgctgagcgagctgctgggcgtgatgagcctgcccgaggcccccgccgccgagacccccgcccccgccgccaacccccccgcccccaccgccaaccccaccggccccgccgccaacccccccgccaccaccgccaacccccccgcccccgccgccaaccccagcgcccccgccgccacccccaccggccccgccgccaacccccccgcccccgccgccagcagcaccccccacggccactgccccaacggcgtgaccgccggcctgggccccgtggccgaggtgaagagcagccccgtgggcggcggccccagaggccccgccggccccgccctgggcagacactggggcgccggctgggacggcggccaccactaccccgagatggacgccagacaggagagagtggaggtgctgccccaggccagagccagctgggagagcctggacgaggagtggagagccccccaggccggcagcagaacccccgtgcccagcaccgtgcaggccaacaccttcgagttcgccgacgccgaggaggacgacgaggtgaaggtgtag

SEQ ID NO: 76103 - DNA, 183 bp, Artificial Sequence
  Description of Artificial Sequence: Synthetic coding sequence
atgcccggcccccagggcggcagaggcgccgccaccatgagcctgggcaagctgagccccgtgggctgggtgagcagcagccagggcaagagaagactgaccgccgacatgatcagccaccccctgggcgacttcagacacaccatgcacgtgggcagaggcggcgacgtgttcggcgactag

SEQ ID NO: 76104 - DNA, 213 bp, Artificial Sequence
  Description of Artificial Sequence: Synthetic coding sequence
atgcccggcccccagggcggcagaggcgccgccaccatgagcctgggcaagctgagccccgtgggctgggtgagcagcagccagggcaagagaagactgaccgccgacatgatcagccaccccctgggcgacttcagacacaccatgcacgtgggcagaggcggcgacgtgttcggcgacaccagcttcctgagcaaccacggcggcagctag

SEQ ID NO: 76105 - DNA, 147 bp, Artificial Sequence
  Description of Artificial Sequence: Synthetic coding sequence
atgcccggcccccagggcggcagaggcgccgccaccatgagcctgggcaagctgagccccgtgggctgggtgagcagcagccagggcaagagaagactgaccgccgacatgatcagccaccccctgggcgacttcagacacacctag

SEQ ID NO: 76106 - DNA, 633 bp, Artificial Sequence
  Description of Artificial Sequence: Synthetic coding sequence
atgagcaccaaggtgcccatctacctgaagagaggcagcagaaagggcaagaaggagaagctgagagacctgctgagcagcgacatgatcagcccccccctgggcgacttcagacacaccatccacatcggcagcggcggcggcagcgacatgttcggcgacatcagcttcctgcagggcaagttccacctgctgcccggcaccatggtggagggccccgaggaggacggcaccttcgacctgcccttccagttcaccagaaccgccaccgtgtgcggcagagagctgcccgacggccccagccccctgctgaagaacgccatcagcctgcccgtgatcggcggcccccaggccctgaccctgcccaccgcccaggccccccccaagccccccagactgcacctggagaccccccagcccagcccccaggagggcggcagcgtggacatctggagaatccccgagaccggcagccccaacagcggcctgacccccgagagcggcgccgaggagcccttcctgagcaacgccagcagcctgctgagcctgcacgtggacctgggccccagcatcctggacgacgtgctgcagatcatggaccaggacctggacagcatgcagatccccacctag

SEQ ID NO: 76107 - DNA, 633 bp, Artificial Sequence; identical to SEQ ID NO: 76106
  Description of Artificial Sequence: Synthetic coding sequence

SEQ ID NO: 76108 - DNA, 633 bp, Artificial Sequence; identical to SEQ ID NO: 76106
  Description of Artificial Sequence: Synthetic coding sequence

SEQ ID NO: 76109 - DNA, 765 bp, Artificial Sequence
  Description of Artificial Sequence: Synthetic coding sequence
atgcccgccaagacccccatctacctgaaggccgccaacaacaagaagggcaagaagttcaagctgagagacatcctgagccccgacatgatcagcccccccctgggcgacttcagacacaccatccacatcggcaaggagggccagcacgacgtgttcggcgacatcagcttcctgcagggcaactacgagctgctgcccggcaaccaggagaaggcccacctgggccagttccccggccacaacgagttcttcagagccaacagcaccagcgacagcgtgttcaccgagacccccagccccgtgctgaagaacgccatcagcctgcccaccatcggcggcagccaggccctgatgctgcccctgctgagccccgtgaccttcaacagcaagcaggagagcttcggccccgccaagctgcccagactgagctgcgagcccgtgatggaggagaaggcccaggagaagagcagcctgctggagaacggcaccgtgcaccagggcgacaccagctggggcagcagcggcagcgccagccagagcagccagggcagagacagccacagcagcagcctgagcgagcagtaccccgactggcccgccgaggacatgttcgaccaccccaccccctgcgagctgatcaagggcaagaccaagagcgaggagagcctgagcgacctgaccggcagcctgctgagcctgcagctggacctgggccccagcctgctggacgaggtgctgaacgtgatggacaagaacaagtag

SEQ ID NO: 76110 - DNA, 45 bp, Artificial Sequence
  Description of Artificial Sequence: Synthetic coding sequence
atgcccgccaagacccccatctacctgaaggccgccaacaactag

SEQ ID NO: 76111 - DNA, 108 bp, Artificial Sequence
  Description of Artificial Sequence: Synthetic coding sequence
atgcccgccaagacccccatctacctgaaggccgccaacaacaagaagggcaagaagttcaagctgagagacatcctgagccccgacatgatcagcccccccctgtag

SEQ ID NO: 76112 - DNA, 651 bp, Artificial Sequence
  Description of Artificial Sequence: Synthetic coding sequence
atgcccgccaagacccccatctacctgaaggccgccaacaacaagaagggcaagaagttcaagctgagagacatcctgagccccgacatgatcagcccccccctgggcgacttcagacacaccatccacatcggcaaggagggccagcacgacgtgttcggcgacatcagcttcctgcagggcaactacgagctgctgcccggcaaccaggagaaggcccacctgggccagttccccggccacaacgagttcttcagagccaacagcaccagcgacagcgtgttcaccgagacccccagccccgtgctgaagaacgccatcagcctgcccaccatcggcggcagccaggccctgatgctgcccctgctgagccccgtgaccttcaacagcaagcaggagagcttcggccccgccaagctgcccagactgagctgcgagcccgtgatggaggagaaggcccaggagaagagcagcctgctggagaacggcaccgtgcaccagggcgacaccagctggggcagcagcggcagcgccagccagagcagccagggcagagacagccacagcagcagcctgagcgagcagtaccccgactggcccgccgaggacatgttcgaccaccccaccccctgcgagctgatcaagggctag

SEQ ID NO: 76113 - DNA, 1071 bp, Artificial Sequence
  Description of Artificial Sequence: Synthetic coding sequence
atgcccatcctgaagcagctggtgagcagcagcgtgcacagcaagagaagaagcagagccgacctgaccgccgagatgatcagcgcccccctgggcgacttcagacacaccatgcacgtgggcagagccggcgacgccttcggcgacaccagcttcctgaacagcaaggccggcgagcccgacggcgagagcctggacgagcagcccagcagcagcagcagcaagagaagcctgctgagcagaaagttcagaggcagcaagagaagccagagcgtgaccagaggcgagagagagcagagagacatgctgggcagcctgagagacagcgccctgttcgtgaagaacgccatgagcctgccccagctgaacgagaaggaggccgccgagaagggcaccagcaagctgcccaagagcctgagcagcagccccgtgaagaaggccaacgacggcgagggcggcgacgaggaggccggcaccgaggaggccgtgcccagaagaaacggcgccgccggcccccacagccccgaccccctgctggacgagcaggccttcggcgacctgaccgacctgcccgtggtgcccaaggccacctacggcctgaagcacgccgagagcatcatgagcttccacatcgacctgggccccagcatgctgggcgacgtgctgagcatcatggacaaggaggagtgggaccccgaggagggcgagggcggctaccacggcgacgagggcgccgccggcaccatcacccaggcccccccctacgccgtggccgccccccccctggccagacaggagggcaaggccggccccgacctgcccagcctgcccagccacgccctggaggacgagggctgggccgccgccgcccccagccccggcagcgccagaagcatgggcagccacaccaccagagacagcagcagcctgagcagctgcaccagcggcatcctggaggagagaagccccgccttcagaggccccgacagagccagagccgccgtgagcagacagcccgacaaggagttcagcttcatggacgaggaggaggaggacgagatcagagtgtag

SEQ ID NO: 76114 - DNA, 861 bp, Artificial Sequence
  Description of Artificial Sequence: Synthetic coding sequence
atgcccatcctgaagcagctggtgagcagcagcgtgcacagcaagagaagaagcagagccgacctgaccgccgagatgatcagcgcccccctgggcgacttcagacacaccatgcacgtgggcagagccggcgacgccttcggcgacaccagcttcctgaacagcaaggccgccgagaagggcaccagcaagctgcccaagagcctgagcagcagccccgtgaagaaggccaacgacggcgagggcggcgacgaggaggccggcaccgaggaggccgtgcccagaagaaacggcgccgccggcccccacagccccgaccccctgctggacgagcaggccttcggcgacctgaccgacctgcccgtggtgcccaaggccacctacggcctgaagcacgccgagagcatcatgagcttccacatcgacctgggccccagcatgctgggcgacgtgctgagcatcatggacaaggaggagtgggaccccgaggagggcgagggcggctaccacggcgacgagggcgccgccggcaccatcacccaggcccccccctacgccgtggccgccccccccctggccagacaggagggcaaggccggccccgacctgcccagcctgcccagccacgccctggaggacgagggctgggccgccgccgcccccagccccggcagcgccagaagcatgggcagccacaccaccagagacagcagcagcctgagcagctgcaccagcggcatcctggaggagagaagccccgccttcagaggccccgacagagccagagccgccgtgagcagacagcccgacaaggagttcagcttcatggacgaggaggaggaggacgagatcagagtgtag

SEQ ID NO: 76115 - DNA, 1551 bp, Artificial Sequence
  Description of Artificial Sequence: Synthetic coding sequence
atgaccctgctgatcaccggcgacagcatcgtgagcgccgaggccgtgtgggaccacgtgaccatggccaacagagagctggccttcaaggccggcgacgtgatcaaggtgctggacgccagcaacaaggactggtggtggggccagatcgacgacgaggagggctggttccccgccagcttcgtgagactgtgggtgaaccaggaggacgaggtggaggagggccccagcgacgtgcagaacggccacctggaccccaacagcgactgcctgtgcctgggcagacccctgcagaacagagaccagatgagagccaacgtgatcaacgagatcatgagcaccgagagacactacatcaagcacctgaaggacatctgcgagggctacctgaagcagtgcagaaagagaagagacatgttcagcgacgagcagctgaaggtgatcttcggcaacatcgaggacatctacagattccagatgggcttcgtgagagacctggagaagcagtacaacaacgacgacccccacctgagcgagatcggcccctgcttcctggagcaccaggacggcttctggatctacagcgagtactgcaacaaccacctggacgcctgcatggagctgagcaagctgatgaaggacagcagataccagcacttcttcgaggcctgcagactgctgcagcagatgatcgacatcgccatcgacggcttcctgctgacccccgtgcagaagatctgcaagtaccccctgcagctggccgagctgctgaagtacaccgcccaggaccacagcgactacagatacgtggccgccgccctggccgtgatgagaaacgtgacccagcagatcaacgagagaaagagaagactggagaacatcgacaagatcgcccagtggcaggccagcgtgctggactgggagggcgaggacatcctggacagaagcagcgagctgatctacaccggcgagatggcctggatctaccagccctacggcagaaaccagcagagagtgttcttcctgttcgaccaccagatggtgctgtgcaagaaggacctgatcagaagagacatcctgtactacaagggcagaatcgacatggacaagtacgaggtggtggacatcgaggacggcagagacgacgacttcaacgtgagcatgaagaacgccttcaagctgcacaacaaggagaccgaggagatccacctgttcttcgccaagaagctggaggagaagatcagatggctgagagccttcagagaggagagaaagatggtgcaggaggacgagaagatcggcttcgagatcagcgagaaccagaagagacaggccgccatgaccgtgagaaaggtgcccaagcagaagggcgtgaacagcgccagaagcgtgccccccagctacccccccccccaggaccccctgaaccacggccagtacctggtgcccgacggcatcgcccagagccaggtgttcgagttcaccgagcccaagagaagccagagccccttctggcagaacttcagcagactgacccccttcaagaagtag

SEQ ID NO: 76116 - DNA, 1245 bp, Artificial Sequence
  Description of Artificial Sequence: Synthetic coding sequence
atgagagccaacgtgatcaacgagatcatgagcaccgagagacactacatcaagcacctgaaggacatctgcgagggctacctgaagcagtgcagaaagagaagagacatgttcagcgacgagcagctgaaggtgatcttcggcaacatcgaggacatctacagattccagatgggcttcgtgagagacctggagaagcagtacaacaacgacgacccccacctgagcgagatcggcccctgcttcctggagcaccaggacggcttctggatctacagcgagtactgcaacaaccacctggacgcctgcatggagctgagcaagctgatgaaggacagcagataccagcacttcttcgaggcctgcagactgctgcagcagatgatcgacatcgccatcgacggcttcctgctgacccccgtgcagaagatctgcaagtaccccctgcagctggccgagctgctgaagtacaccgcccaggaccacagcgactacagatacgtggccgccgccctggccgtgatgagaaacgtgacccagcagatcaacgagagaaagagaagactggagaacatcgacaagatcgcccagtggcaggccagcgtgctggactgggagggcgaggacatcctggacagaagcagcgagctgatctacaccggcgagatggcctggatctaccagccctacggcagaaaccagcagagagtgttcttcctgttcgaccaccagatggtgctgtgcaagaaggacctgatcagaagagacatcctgtactacaagggcagaatcgacatggacaagtacgaggtggtggacatcgaggacggcagagacgacgacttcaacgtgagcatgaagaacgccttcaagctgcacaacaaggagaccgaggagatccacctgttcttcgccaagaagctggaggagaagatcagatggctgagagccttcagagaggagagaaagatggtgcaggaggacgagaagatcggcttcgagatcagcgagaaccagaagagacaggccgccatgaccgtgagaaaggtgcccaagcagaagggcgtgaacagcgccagaagcgtgccccccagctacccccccccccaggaccccctgaaccacggccagtacctggtgcccgacggcatcgcccagagccaggtgttcgagttcaccgagcccaagagaagccagagccccttctggcagaacttcagcagactgacccccttcaagaagtag

SEQ ID NO: 76117 - DNA, 1488 bp, Artificial Sequence
  Description of Artificial Sequence: Synthetic coding sequence
atggccaacagagagctggccttcaaggccggcgacgtgatcaaggtgctggacgccagcaacaaggactggtggtggggccagatcgacgacgaggagggctggttccccgccagcttcgtgagactgtgggtgaaccaggaggacgaggtggaggagggccccagcgacgtgcagaacggccacctggaccccaacagcgactgcctgtgcctgggcagacccctgcagaacagagaccagatgagagccaacgtgatcaacgagatcatgagcaccgagagacactacatcaagcacctgaaggacatctgcgagggctacctgaagcagtgcagaaagagaagagacatgttcagcgacgagcagctgaaggtgatcttcggcaacatcgaggacatctacagattccagatgggcttcgtgagagacctggagaagcagtacaacaacgacgacccccacctgagcgagatcggcccctgcttcctggagcaccaggacggcttctggatctacagcgagtactgcaacaaccacctggacgcctgcatggagctgagcaagctgatgaaggacagcagataccagcacttcttcgaggcctgcagactgctgcagcagatgatcgacatcgccatcgacggcttcctgctgacccccgtgcagaagatctgcaagtaccccctgcagctggccgagctgctgaagtacaccgcccaggaccacagcgactacagatacgtggccgccgccctggccgtgatgagaaacgtgacccagcagatcaacgagagaaagagaagactggagaacatcgacaagatcgcccagtggcaggccagcgtgctggactgggagggcgaggacatcctggacagaagcagcgagctgatctacaccggcgagatggcctggatctaccagccctacggcagaaaccagcagagagtgttcttcctgttcgaccaccagatggtgctgtgcaagaaggacctgatcagaagagacatcctgtactacaagggcagaatcgacatggacaagtacgaggtggtggacatcgaggacggcagagacgacgacttcaacgtgagcatgaagaacgccttcaagctgcacaacaaggagaccgaggagatccacctgttcttcgccaagaagctggaggagaagatcagatggctgagagccttcagagaggagagaaagatggtgcaggaggacgagaagatcggcttcgagatcagcgagaaccagaagagacaggccgccatgaccgtgagaaaggtgcccaagcagaagggcgtgaacagcgccagaagcgtgccccccagctacccccccccccaggaccccctgaaccacggccagtacctggtgcccgacggcatcgcccagagccaggtgttcgagttcaccgagcccaagagaagccagagccccttctggcagaacttcagcagactgacccccttcaagaagtag

SEQ ID NO: 76118 - DNA, 1437 bp, Artificial Sequence
  Description of Artificial Sequence: Synthetic coding sequence
atgctgatcaccggcgacagcatcgtgagcgccgaggccgtgtgggaccacgtgaccatggccaacagagagctggccttcaaggccggcgacgtgatcaaggtgctggacgccagcaacaaggactggtggtggggccagatcgacgacgaggagggctggttccccgccagcttcgtgagactgtgggtgaaccaggaggacgaggtggaggagggccccagcgacgtgcagaacggccacctggaccccaacagcgactgcctgtgcctgggcagacccctgcagaacagagaccagatgagagccaacgtgatcaacgagatcatgagcaccgagagacactacatcaagcacctgaaggacatctgcgagggctacctgaagcagtgcagaaagagaagagacatgttcagcgacgagcagctgaaggtgatcttcggcaacatcgaggacatctacagattccagatgggcttcgtgagagacctggagaagcagtacaacaacgacgacccccacctgagcgagatcggcccctgcttcctggagcaccaggacggcttctggatctacagcgagtactgcaacaaccacctggacgcctgcatggagctgagcaagctgatgaaggacagcagataccagcacttcttcgaggcctgcagactgctgcagcagatgatcgacatcgccatcgacggcttcctgctgacccccgtgcagaagatctgcaagtaccccctgcagctggccgagctgctgaagtacaccgcccaggaccacagcgactacagatacgtggccgccgccctggccgtgatgagaaacgtgacccagcagatcaacgagagaaagagaagactggagaacatcgacaagatcgcccagtggcaggccagcgtgctggactgggagggcgaggacatcctggacagaagcagcgagctgatctacaccggcgagatggcctggatctaccagccctacggcagaaaccagcagagagtgttcttcctgttcgaccaccagatggtgctgtgcaagaaggacctgatcagaagagacatcctgtactacaagggcagaatcgacatggacaagtacgaggtggtggacatcgaggacggcagagacgacgacttcaacgtgagcatgaagaacgccttcaagctgcacaacaaggagaccgaggagatccacctgttcttcgccaagaagctggaggagaagatcagatggctgagagccttcagagaggagagaaagatggtgcaggaggacgagaagatcggcttcgagatcagcgagaaccagaagagacaggccgccatgaccgtgagaaagctgcccttcccccagctgagcgaggccagaatctgcagccccaagggcttcgccagcgtgttcaacggcacctgctgcggcgagagctag

SEQ ID NO: 76119 - DNA, 732 bp, Artificial Sequence
  Description of Artificial Sequence: Synthetic coding sequence
atgatcgacatcgccatcgacggcttcctgctgacccccgtgcagaagatctgcaagtaccccctgcagctggccgagctgctgaagtacaccgcccaggaccacagcgactacagatacgtggccgccgccctggccgtgatgagaaacgtgacccagcagatcaacgagagaaagagaagactggagaacatcgacaagatcgcccagtggcaggccagcgtgctggactgggaggacctgatcagaagagacatcctgtactacaagggcagaatcgacatggacaagtacgaggtggtggacatcgaggacggcagagacgacgacttcaacgtgagcatgaagaacgccttcaagctgcacaacaaggagaccgaggagatccacctgttcttcgccaagaagctggaggagaagatcagatggctgagagccttcagagaggagagaaagatggtgcaggaggacgagaagatcggcttcgagatcagcgagaaccagaagagacaggccgccatgaccgtgagaaaggtgcccaagcagaagggcgtgaacagcgccagaagcgtgccccccagctacccccccccccaggaccccctgaaccacggccagtacctggtgcccgacggcatcgcccagagccaggtgttcgagttcaccgagcccaagagaagccagagccccttctggcagaacttcagcagactgacccccttcaagaagtag

SEQ ID NO: 76120 - DNA, 1392 bp, Artificial Sequence
  Description of Artificial Sequence: Synthetic coding sequence
atgcagtggatcagaggcggcagcggcatgctgtgggtgaaccaggaggacgaggtggaggagggccccagcgacgtgcagaacggccacctggaccccaacagcgactgcctgtgcctgggcagacccctgcagaacagagaccagatgagagccaacgtgatcaacgagatcatgagcaccgagagacactacatcaagcacctgaaggacatctgcgagggctacctgaagcagtgcagaaagagaagagacatgttcagcgacgagcagctgaaggtgatcttcggcaacatcgaggacatctacagattccagatgggcttcgtgagagacctggagaagcagtacaacaacgacgacccccacctgagcgagatcggcccctgcttcctggagcaccaggacggcttctggatctacagcgagtactgcaacaaccacctggacgcctgcatggagctgagcaagctgatgaaggacagcagataccagcacttcttcgaggcctgcagactgctgcagcagatgatcgacatcgccatcgacggcttcctgctgacccccgtgcagaagatctgcaagtaccccctgcagctggccgagctgctgaagtacaccgcccaggaccacagcgactacagatacgtggccgccgccctggccgtgatgagaaacgtgacccagcagatcaacgagagaaagagaagactggagaacatcgacaagatcgcccagtggcaggccagcgtgctggactgggagggcgaggacatcctggacagaagcagcgagctgatctacaccggcgagatggcctggatctaccagccctacggcagaaaccagcagagagtgttcttcctgttcgaccaccagatggtgctgtgcaagaaggacctgatcagaagagacatcctgtactacaagggcagaatcgacatggacaagtacgaggtggtggacatcgaggacggcagagacgacgacttcaacgtgagcatgaagaacgccttcaagctgcacaacaaggagaccgaggagatccacctgttcttcgccaagaagctggaggagaagatcagatggctgagagccttcagagaggagagaaagatggtgcaggaggacgagaagatcggcttcgagatcagcgagaaccagaagagacaggccgccatgaccgtgagaaaggtgcccaagcagaagggcgtgaacagcgccagaagcgtgccccccagctacccccccccccaggaccccctgaaccacggccagtacctggtgcccgacggcatcgcccagagccaggtgttcgagttcaccgagcccaagagaagccagagccccttctggcagaacttcagcagactgacccccttcaagaagtag

SEQ ID NO: 76121 - DNA, 2409 bp, Artificial Sequence
  Description of Artificial Sequence: Synthetic coding sequence
atgcccagaatcatgatcaagggcggcgtgtggagaaacaccgaggacgagatcctgaaggccgccgtgatgaagtacggcaagaaccagtggagcagaatcgccagcctgctgcacagaaagagcgccaagcagtgcaaggccagatggtacgagtggctggaccccagcatcaagaagaccgagtggagcagagaggaggaggagaagctgctgcacctggccaagctgatgcccacccagtggagaaccatcgcccccatcatcggcagaaccgccgcccagtgcctggagcactacgagttcctgctggacaaggccgcccagagagacaacgaggaggagaccaccgacgaccccagaaagctgaagcccggcgagatcgaccccaaccccgagaccaagcccgccagacccgaccccatcgacatggacgaggacgagctggagatgctgagcgaggccagagccagactggccaacacccagggcaagaaggccaagagaaaggccagagagaagcagctggaggaggccagaagactggccgccctgcagaagagaagagagctgagagccgccggcatcgagatccagaagaagagaaagagaaagagaggcgtggactacaacgccgagatccccttcgagaagaagcccgccctgggcttctacgacaccagcgaggagaactaccaggccctggacgccgacttcagaaagctgagacagcaggacctggacggcgagctgagaagcgagaaggagggcagagacagaaagaaggacaagcagcacctgaagagaaagaaggagagcgacctgcccagcgccatcctgcagaccagcggcgtgagcgagttcaccaagaagagaagcaagctggtgctgcccgccccccagatcagcgacgccgagctgcaggaggtggtgaaggtgggccaggccagcgagatcgccagacagaccgccgaggagagcggcatcaccaacagcgccagcagcaccctgctgagcgagtacaacgtgaccaacaacagcgtggccctgagaacccccagaacccccgccagccaggacagaatcctgcaggaggcccagaacctgatggccctgaccaacgtggacacccccctgaagggcggcctgaacacccccctgcacgagagcgacttcagcggcgtgaccccccagagacaggtggtgcagacccccaacaccgtgctgagcacccccttcagaacccccagcaacggcgccgagggcctgacccccagaagcggcaccacccccaagcccgtgatcaacagcacccccggcagaacccccctgagagacaagctgaacatcaaccccgaggacggcatggccgactacagcgaccccagctacgtgaagcagatggagagagagagcagagagcacctgagactgggcctgctgggcctgcccgcccccaagaacgacttcgagatcgtgctgcccgagaacgccgagaaggagctggaggagagagagatcgacgacacctacatcgaggacgccgccgacgtggacgccagaaagcaggccatcagagacgccgagagagtgaaggagatgaagagaatgcacaaggccgtgcagaaggacctgcccagacccagcgaggtgaacgagaccatcctgagacccctgaacgtggagccccccctgaccgacctgcagaagagcgaggagctgatcaagaaggagatgatcaccatgctgcactacgacctgctgcaccacccctacgagcccagcggcaacaagaagggcaagaccgtgggcttcggcaccaacaacagcgagcacatcacctacctggagcacaacccctacgagaagttcagcaaggaggagctgaagaaggcccaggacgtgctggtgcaggagatggaggtggtgaagcagggcatgagccacggcgagctgagcagcgaggcctacaaccaggtgtgggaggagtgctacagccaggtgctgtacctgcccggccagagcagatacaccagagccaacctggccagcaagaaggacagaatcgagagcctggagaagagactggagatcaacagaggccacatgaccaccgaggccaagagagccgccaagatggagaagaagatgaagatcctgctgggcggctaccagagcagagccatgggcctgatgaagcagctgaacgacctgtgggaccagatcgagcaggcccacctggagctgagaaccttcgaggagctgaagaagcacgaggacagcgccatccccagaagactggagtgcctgaaggaggacgtgcagagacagcaggagagagagaaggagctgcagcacagatacgccgacctgctgctggagaaggagaccctgaagagcaagttctag

SEQ ID NO: 76122 - DNA, 1455 bp, Artificial Sequence
  Description of Artificial Sequence: Synthetic coding sequence
atgagacacagcaagagaacctactgccccgactgggacgacaaggactgggactacggcaagtggagaagcagcagcagccacaagagaagaaagagaagccacagcagcgcccaggagaacaagagatgcaagtacaaccacagcaagatgtgcgacagccactacctggagagcagaagcatcaacgagaaggactaccacagcagaagatacatcgacgagtacagaaacgactacacccagggctgcgagcccggccacagacagagagaccacgagagcagataccagaaccacagcagcaagagcagcggcagaagcggcagaagcagctacaagagcaagcacagaatccaccacagcaccagccacagaagaagccacggcaagagccacagaagaaagagaaccagaagcgtggaggacgacgaggagggccacctgatctgccagagcggcgacgtgctgagcgccagatacgagatcgtggacaccctgggcgagggcgccttcggcaaggtggtggagtgcatcgaccacaaggccggcggcagacacgtggccgtgaagatcgtgaagaacgtggacagatactgcgaggccgccagaagcgagatccaggtgctggagcacctgaacaccaccgaccccaacagcaccttcagatgcgtgcagatgctggagtggttcgagcaccacggccacatctgcatcgtgttcgagctgctgggcctgagcacctacgacttcatcaaggagaacggcttcctgcccttcagactggaccacatcagaaagatggcctaccagatctgcaagagcgtgaacttcctgcacagcaacaagctgacccacaccgacctgaagcccgagaacatcctgttcgtgcagagcgactacaccgaggcctacaaccccaagatcaagagagacgagagaaccctgatcaaccccgacatcaaggtggtggacttcggcagcgccacctacgacgacgagcaccacagcaccctggtgagcaccagacactacagagcccccgaggtgatcctggccctgggctggagccagccctgcgacgtgtggagcatcggctgcatcctgatcgagtactacctgggcttcaccgtgttccccacccacgacagcaaggagcacctggccatgatggagagaatcctgggccccctgcccaagcacatgatccagaagaccagaaagagaaagtacttccaccacgacagactggactgggacgagcacagcagcgccggcagatacgtgagcagaagatgcaagcccctgaaggagttcatgctgagccaggacgtggagcacgagagactgttcgacctgatccagaagatgctggagtacgaccccgccaagagaatcaccctgagagaggccctgaagcaccccttcttcgacctgctgaagaagagcatctag

SEQ ID NO: 76123 - DNA, 1365 bp, Artificial Sequence
  Description of Artificial Sequence: Synthetic coding sequence
atgagacacagcaagagaacctactgccccgactgggacgacaaggactgggactacggcaagtggagaagcagcagcagccacaagagaagaaagagaagccacagcagcgcccaggagaacaagagatgcaagtacaaccacagcaagatgtgcgacagccactacctggagagcagaagcatcaacgagaaggactaccacagcagaagatacatcgacgagtacagaaacgactacacccagggctgcgagcccggccacagacagagagaccacgagagcagataccagaaccacagcagcaagagcagcggcagaagcggcagaagcagctacaagagcaagcacagaatccaccacagcaccagccacagaagaagccacggcgacgagatcgtggacaccctgggcgagggcgccttcggcaaggtggtggagtgcatcgaccacaaggccggcggcagacacgtggccgtgaagatcgtgaagaacgtggacagatactgcgaggccgccagaagcgagatccaggtgctggagcacctgaacaccaccgaccccaacagcaccttcagatgcgtgcagatgctggagtggttcgagcaccacggccacatctgcatcgtgttcgagctgctgggcctgagcacctacgacttcatcaaggagaacggcttcctgcccttcagactggaccacatcagaaagatggcctaccagatctgcaagagcgtgaacttcctgcacagcaacaagctgacccacaccgacctgaagcccgagaacatcctgttcgtgcagagcgactacaccgaggcctacaaccccaagatcaagagagacgagagaaccctgatcaaccccgacatcaaggtggtggacttcggcagcgccacctacgacgacgagcaccacagcaccctggtgagcaccagacactacagagcccccgaggtgatcctggccctgggctggagccagccctgcgacgtgtggagcatcggctgcatcctgatcgagtactacctgggcttcaccgtgttccccacccacgacagcaaggagcacctggccatgatggagagaatcctgggccccctgcccaagcacatgatccagaagaccagaaagagaaagtacttccaccacgacagactggactgggacgagcacagcagcgccggcagatacgtgagcagaagatgcaagcccctgaaggagttcatgctgagccaggacgtggagcacgagagactgttcgacctgatccagaagatgctggagtacgaccccgccaagagaatcaccctgagagaggccctgaagcaccccttcttcgacctgctgaagaagagcatctag

SEQ ID NO: 76124 - DNA, 1581 bp, Artificial Sequence
  Description of Artificial Sequence: Synthetic coding sequence
atggccgccggcagaagacccgccagcgccctgtggcccgagagaagaggcagccccctgagaggcgacctgctgggcttccagaacgtgagagagcccagcagctgcggcgagaccctgagcggcatgagacacagcaagagaacctactgccccgactgggacgacaaggactgggactacggcaagtggagaagcagcagcagccacaagagaagaaagagaagccacagcagcgcccaggagaacaagagatgcaagtacaaccacagcaagatgtgcgacagccactacctggagagcagaagcatcaacgagaaggactaccacagcagaagatacatcgacgagtacagaaacgactacacccagggctgcgagcccggccacagacagagagaccacgagagcagataccagaaccacagcagcaagagcagcggcagaagcggcagaagcagctacaagagcaagcacagaatccaccacagcaccagccacagaagaagccacggcaagagccacagaagaaagagaaccagaagcgtggaggacgacgaggagggccacctgatctgccagagcggcgacgtgctgagcgccagatacgagatcgtggacaccctgggcgagggcgccttcggcaaggtggtggagtgcatcgaccacaaggccggcggcagacacgtggccgtgaagatcgtgaagaacgtggacagatactgcgaggccgccagaagcgagatccaggtgctggagcacctgaacaccaccgaccccaacagcaccttcagatgcgtgcagatgctggagtggttcgagcaccacggccacatctgcatcgtgttcgagctgctgggcctgagcacctacgacttcatcaaggagaacggcttcctgcccttcagactggaccacatcagaaagatggcctaccagatctgcaagagcgtgaacttcctgcacagcaacaagctgacccacaccgacctgaagcccgagaacatcctgttcgtgcagagcgactacaccgaggcctacaaccccaagatcaagagagacgagagaaccctgatcaaccccgacatcaaggtggtggacttcggcagcgccacctacgacgacgagcaccacagcaccctggtgagcaccagacactacagagcccccgaggtgatcctggccctgggctggagccagccctgcgacgtgtggagcatcggctgcatcctgatcgagtactacctgggcttcaccgtgttccccacccacgacagcaaggagcacctggccatgatggagagaatcctgggccccctgcccaagcacatgatccagaagaccagaaagagaaagtacttccaccacgacagactggactgggacgagcacagcagcgccggcagatacgtgagcagaagatgcaagcccctgaaggagttcatgctgagccaggacgtggagcacgagagactgttcgacctgatccagaagatgctggagtacgaccccgccaagagaatcaccctgagagaggccctgaagcaccccttcttcgacctgctgaagaagagcatctag

SEQ ID NO: 76125 - DNA, 1494 bp, Artificial Sequence
  Description of Artificial Sequence: Synthetic coding sequence
atgccccaccccagaagataccacagcagcgagagaggcagcagaggcagctacagagagcactacagaagcagaaagcacaagagaagaagaagcagaagctggagcagcagcagcgacagaaccagaagaagaagaagagaggacagctaccacgtgagaagcagaagctacgacgacagaagcagcgacagaagagtgtacgacagaagatactgcggcagctacagaagaaacgactacagcagagacagaggcgacgcctactacgacaccgactacagacacagctacgagtaccagagagagaacagcagctacagaagccagagaagcagcagaagaaagcacagaagaagaagaagaagaagcagaaccttcagcagaagcagcagccacagcagcagaagagccaagagcgtggaggacgacgccgagggccacctgatctaccacgtgggcgactggctgcaggagagatacgagatcgtgagcaccctgggcgagggcaccttcggcagagtggtgcagtgcgtggaccacagaagaggcggcgccagagtggccctgaagatcatcaagaacgtggagaagtacaaggaggccgccagactggagatcaacgtgctggagaagatcaacgagaaggaccccgacaacaagaacctgtgcgtgcagatgttcgactggttcgactaccacggccacatgtgcatcagcttcgagctgctgggcctgagcaccttcgacttcctgaaggacaacaactacctgccctaccccatccaccaggtgagacacatggccttccagctgtgccaggccgtgaagttcctgcacgacaacaagctgacccacaccgacctgaagcccgagaacatcctgttcgtgaacagcgactacgagctgacctacaacctggagaagaagagagacgagagaagcgtgaagagcaccgccgtgagagtggtggacttcggcagcgccaccttcgaccacgagcaccacagcaccatcgtgagcaccagacactacagagcccccgaggtgatcctggagctgggctggagccagccctgcgacgtgtggagcatcggctgcatcatcttcgagtactacgtgggcttcaccctgttccagacccacgacaacagagagcacctggccatgatggagagaatcctgggccccatccccagcagaatgatcagaaagaccagaaagcagaagtacttctacagaggcagactggactgggacgagaacaccagcgccggcagatacgtgagagagaactgcaagcccctgagaagatacctgaccagcgaggccgaggagcaccaccagctgttcgacctgatcgagagcatgctggagtacgagcccgccaagagactgaccctgggcgaggccctgcagcaccccttcttcgccagactgagagccgagccccccaacaagctgtgggacagcagcagagacatcagcagatag

SEQ ID NO: 76126 - DNA, 1497 bp, Artificial Sequence
  Description of Artificial Sequence: Synthetic coding sequence
atgccccaccccagaagataccacagcagcgagagaggcagcagaggcagctacagagagcactacagaagcagaaagcacaagagaagaagaagcagaagctggagcagcagcagcgacagaaccagaagaagaagaagagaggacagctaccacgtgagaagcagaagcagctacgacgacagaagcagcgacagaagagtgtacgacagaagatactgcggcagctacagaagaaacgactacagcagagacagaggcgacgcctactacgacaccgactacagacacagctacgagtaccagagagagaacagcagctacagaagccagagaagcagcagaagaaagcacagaagaagaagaagaagaagcagaaccttcagcagaagcagcagccacagcagcagaagagccaagagcgtggaggacgacgccgagggccacctgatctaccacgtgggcgactggctgcaggagagatacgagatcgtgagcaccctgggcgagggcaccttcggcagagtggtgcagtgcgtggaccacagaagaggcggcgccagagtggccctgaagatcatcaagaacgtggagaagtacaaggaggccgccagactggagatcaacgtgctggagaagatcaacgagaaggaccccgacaacaagaacctgtgcgtgcagatgttcgactggttcgactaccacggccacatgtgcatcagcttcgagctgctgggcctgagcaccttcgacttcctgaaggacaacaactacctgccctaccccatccaccaggtgagacacatggccttccagctgtgccaggccgtgaagttcctgcacgacaacaagctgacccacaccgacctgaagcccgagaacatcctgttcgtgaacagcgactacgagctgacctacaacctggagaagaagagagacgagagaagcgtgaagagcaccgccgtgagagtggtggacttcggcagcgccaccttcgaccacgagcaccacagcaccatcgtgagcaccagacactacagagcccccgaggtgatcctggagctgggctggagccagccctgcgacgtgtggagcatcggctgcatcatcttcgagtactacgtgggcttcaccctgttccagacccacgacaacagagagcacctggccatgatggagagaatcctgggccccatccccagcagaatgatcagaaagaccagaaagcagaagtacttctacagaggcagactggactgggacgagaacaccagcgccggcagatacgtgagagagaactgcaagcccctgagaagatacctgaccagcgaggccgaggagcaccaccagctgttcgacctgatcgagagcatgctggagtacgagcccgccaagagactgaccctgggcgaggccctgcagcaccccttcttcgccagactgagagccgagccccccaacaagctgtgggacagcagcagagacatcagcagatag

SEQ ID NO: 76127 - DNA, 1500 bp, Artificial Sequence
  Description of Artificial Sequence: Synthetic coding sequence
atgccccaccccagaagataccacagcagcgagagaggcagcagaggcagctacagagagcactacagaagcagaaagcacaagagaagaagaagcagaagctggagcagcagcagcgacagaaccagaagaagaagaagagaggacagctaccacgtgagaagcagaagcagctacgacgacagaagcagcgacagaagagtgtacgacagaagatactgcggcagctacagaagaaacgactacagcagagacagaggcgacgcctactacgacaccgactacagacacagctacgagtaccagagagagaacagcagctacagaagccagagaagcagcagaagaaagcacagaagaagaagaagaagaagcagaaccttcagcagaagcagcagccagcacagcagcagaagagccaagagcgtggaggacgacgccgagggccacctgatctaccacgtgggcgactggctgcaggagagatacgagatcgtgagcaccctgggcgagggcaccttcggcagagtggtgcagtgcgtggaccacagaagaggcggcgccagagtggccctgaagatcatcaagaacgtggagaagtacaaggaggccgccagactggagatcaacgtgctggagaagatcaacgagaaggaccccgacaacaagaacctgtgcgtgcagatgttcgactggttcgactaccacggccacatgtgcatcagcttcgagctgctgggcctgagcaccttcgacttcctgaaggacaacaactacctgccctaccccatccaccaggtgagacacatggccttccagctgtgccaggccgtgaagttcctgcacgacaacaagctgacccacaccgacctgaagcccgagaacatcctgttcgtgaacagcgactacgagctgacctacaacctggagaagaagagagacgagagaagcgtgaagagcaccgccgtgagagtggtggacttcggcagcgccaccttcgaccacgagcaccacagcaccatcgtgagcaccagacactacagagcccccgaggtgatcctggagctgggctggagccagccctgcgacgtgtggagcatcggctgcatcatcttcgagtactacgtgggcttcaccctgttccagacccacgacaacagagagcacctggccatgatggagagaatcctgggccccatccccagcagaatgatcagaaagaccagaaagcagaagtacttctacagaggcagactggactgggacgagaacaccagcgccggcagatacgtgagagagaactgcaagcccctgagaagatacctgaccagcgaggccgaggagcaccaccagctgttcgacctgatcgagagcatgctggagtacgagcccgccaagagactgaccctgggcgaggccctgcagcaccccttcttcgccagactgagagccgagccccccaacaagctgtgggacagcagcagagacatcagcagatag

SEQ ID NO: 76128 - DNA, 816 bp, Artificial Sequence
  Description of Artificial Sequence: Synthetic coding sequence
atgttcgactggttcgactaccacggccacatgtgcatcagcttcgagctgctgggcctgagcaccttcgacttcctgaaggacaacaactacctgccctaccccatccaccaggtgagacacatggccttccagctgtgccaggccgtgaagttcctgcacgacaacaagctgacccacaccgacctgaagcccgagaacatcctgttcgtgaacagcgactacgagctgacctacaacctggagaagaagagagacgagagaagcgtgaagagcaccgccgtgagagtggtggacttcggcagcgccaccttcgaccacgagcaccacagcaccatcgtgagcaccagacactacagagcccccgaggtgatcctggagctgggctggagccagccctgcgacgtgtggagcatcggctgcatcatcttcgagtactacgtgggcttcaccctgttccagacccacgacaacagagagcacctggccatgatggagagaatcctgggccccatccccagcagaatgatcagaaagaccagaaagcagaagtacttctacagaggcagactggactgggacgagaacaccagcgccggcagatacgtgagagagaactgcaagcccctgagaagatacctgaccagcgaggccgaggagcaccaccagctgttcgacctgatcgagagcatgctggagtacgagcccgccaagagactgaccctgggcgaggccctgcagcaccccttcttcgccagactgagagccgagccccccaacaagctgtgggacagcagcagagacatcagcagatag

SEQ ID NO: 76129 - DNA, 1500 bp, Artificial Sequence; identical to SEQ ID NO: 76127
  Description of Artificial Sequence: Synthetic coding sequence

SEQ ID NO: 76130 - DNA, 1473 bp, Artificial Sequence
  Description of Artificial Sequence: Synthetic coding sequence
atgcaccactgcaagagatacagaagccccgagcccgacccctacctgagctacagatggaagagaagaagaagctacagcagagagcacgagggcagactgagataccccagcagaagagagcccccccccagaagaagcagaagcagaagccacgacagactgccctaccagagaagatacagagagagaagagacagcgacacctacagatgcgaggagagaagccccagcttcggcgaggactactacggccccagcagaagcagacacagaagaagaagcagagagagaggcccctacagaaccagaaagcacgcccaccactgccacaagagaagaaccagaagctgcagcagcgccagcagcagaagccagcagagcagcaagagaagcagcagaagcgtggaggacgacaaggagggccacctggtgtgcagaatcggcgactggctgcaggagagatacgagatcgtgggcaacctgggcgagggcaccttcggcaaggtggtggagtgcctggaccacgccagaggcaagagccaggtggccctgaagatcatcagaaacgtgggcaagtacagagaggccgccagactggagatcaacgtgctgaagaagatcaaggagaaggacaaggagaacaagttcctgtgcgtgctgatgagcgactggttcaacttccacggccacatgtgcatcgccttcgagctgctgggcaagaacaccttcgagttcctgaaggagaacaacttccagccctaccccctgccccacgtgagacacatggcctaccagctgtgccacgccctgagattcctgcacgagaaccagctgacccacaccgacctgaagcccgagaacatcctgttcgtgaacagcgagttcgagaccctgtacaacgagcacaagagctgcgaggagaagagcgtgaagaacaccagcatcagagtggccgacttcggcagcgccaccttcgaccacgagcaccacaccaccatcgtggccaccagacactacagaccccccgaggtgatcctggagctgggctgggcccagccctgcgacgtgtggagcatcggctgcatcctgttcgagtactacagaggcttcaccctgttccagacccacgagaacagagagcacctggtgatgatggagaagatcctgggccccatccccagccacatgatccacagaaccagaaagcagaagtacttctacaagggcggcctggtgtgggacgagaacagcagcgacggcagatacgtgaaggagaactgcaagcccctgaagagctacatgctgcaggacagcctggagcacgtgcagctgttcgacctgatgagaagaatgctggagttcgaccccgcccagagaatcaccctggccgaggccctgctgcaccccttcttcgccggcctgacccccgaggagagaagcttccacaccagcagaaaccccagcagatag

SEQ ID NO: 76131 - DNA, 459 bp, Artificial Sequence
  Description of Artificial Sequence: Synthetic coding sequence
atgcaccactgcaagagatacagaagccccgagcccgacccctacctgagctacagatggaagagaagaagaagctacagcagagagcacgagggcagactgagataccccagcagaagagagcccccccccagaagaagcagaagcagaagccacgacagactgccctaccagagaagatacagagagagaagagacagcgacacctacagatgcgaggagagaagccccagcttcggcgaggactactacggccccagcagaagcagacacagaagaagaagcagagagagaggcccctacagaaccagaaagcacgcccaccactgccacaagagaagaaccagaagctgcagcagcgccagcagcatgagactgtggggcacctgggtgaaggcccccctggccagatggtggagcgcctggaccatgcccgagggcagcctgagactgccctag

SEQ ID NO: 76132 - DNA, 1404 bp, Artificial Sequence
  Description of Artificial Sequence: Synthetic coding sequence
atgcaccactgcaagagatacagaagccccgagcccgacccctacctgagctacagatggaagagaagaagaagctacagcagagagcacgagggcagactgagataccccagcagaagagagcccccccccagaagaagcagaagcagaagccacgacagactgccctaccagagaagatacagagagagaagagacagcgacacctacagatgcgaggagagaagccccagcttcggcgaggactactacggccccagcagaagcagacacagaagaagaagcagagagagaggcccctacagaaccagaaagcacgcccaccactgccacaagagaagaaccagaagctgcagcagcgccagcagcagaagccagcagagcagcaagagaagcagcagaagcgtggaggacgacaaggagggccacctggtgtgcagaatcggcgactggctgcaggagagatggaagagccaggtggccctgaagatcatcagaaacgtgggcaagtacagagaggccgccagactggagatcaacgtgctgaagaagatcaaggagaaggacaaggagaacaagttcctgtgcgtgctgatgagcgactggttcaacttccacggccacatgtgcatcgccttcgagctgctgggcaagaacaccttcgagttcctgaaggagaacaacttccagccctaccccctgccccacgtgagacacatggcctaccagctgtgccacgccctgagattcctgcacgagaaccagctgacccacaccgacctgaagcccgagaacatcctgttcgtgaacagcgagttcgagaccctgtacaacgagcacaagagctgcgaggagaagagcgtgaagaacaccagcatcagagtggccgacttcggcagcgccaccttcgaccacgagcaccacaccaccatcgtggccaccagacactacagaccccccgaggtgatcctggagctgggctgggcccagccctgcgacgtgtggagcatcggctgcatcctgttcgagtactacagaggcttcaccctgttccagacccacgagaacagagagcacctggtgatgatggagaagatcctgggccccatccccagccacatgatccacagaaccagaaagcagaagtacttctacaagggcggcctggtgtgggacgagaacagcagcgacggcagatacgtgaaggagaactgcaagcccctgaagagctacatgctgcaggacagcctggagcacgtgcagctgttcgacctgatgagaagaatgctggagttcgaccccgcccagagaatcaccctggccgaggccctgctgcaccccttcttcgccggcctgacccccgaggagagaagcttccacaccagcagaaaccccagcagatag

SEQ ID NO: 76133 - DNA, 1473 bp, Artificial Sequence; identical to SEQ ID NO: 76130
  Description of Artificial Sequence: Synthetic coding sequence

SEQ ID NO: 76134 - DNA, 1917 bp, Artificial Sequence
  Description of Artificial Sequence: Synthetic coding sequence
atgcccgtgctgagcgccagaagaagagagctggccgaccacgccggcagcggcagaagaagcggccccagccccaccgccagaagcggcccccacctgagcgccctgagagcccagcccgccagagccgcccacctgagcggcagaggcacctacgtgagaagagacaccgccggcggcggccccggccaggccagacccctgggcccccccggcaccagcctgctgggcagaggcgccagaagaagcggcgagggctggtgccccggcgccttcgagagcggcgccagagccgccagaccccccagcagagtggagcccagactggccaccgccgccagcagagagggcgccggcctgcccagagccgaggtggccgccggcagcggcagaggcgccagaagcggcgagtggggcctggccgccgccggcgcctgggagaccatgcaccactgcaagagatacagaagccccgagcccgacccctacctgagctacagatggaagagaagaagaagctacagcagagagcacgagggcagactgagataccccagcagaagagagcccccccccagaagaagcagaagcagaagccacgacagactgccctaccagagaagatacagagagagaagagacagcgacacctacagatgcgaggagagaagccccagcttcggcgaggactactacggccccagcagaagcagacacagaagaagaagcagagagagaggcccctacagaaccagaaagcacgcccaccactgccacaagagaagaaccagaagctgcagcagcgccagcagcagaagccagcagagcagcaagagaagcagcagaagcgtggaggacgacaaggagggccacctggtgtgcagaatcggcgactggctgcaggagagatacgagatcgtgggcaacctgggcgagggcaccttcggcaaggtggtggagtgcctggaccacgccagaggcaagagccaggtggccctgaagatcatcagaaacgtgggcaagtacagagaggccgccagactggagatcaacgtgctgaagaagatcaaggagaaggacaaggagaacaagttcctgtgcgtgctgatgagcgactggttcaacttccacggccacatgtgcatcgccttcgagctgctgggcaagaacaccttcgagttcctgaaggagaacaacttccagccctaccccctgccccacgtgagacacatggcctaccagctgtgccacgccctgagattcctgcacgagaaccagctgacccacaccgacctgaagcccgagaacatcctgttcgtgaacagcgagttcgagaccctgtacaacgagcacaagagctgcgaggagaagagcgtgaagaacaccagcatcagagtggccgacttcggcagcgccaccttcgaccacgagcaccacaccaccatcgtggccaccagacactacagaccccccgaggtgatcctggagctgggctgggcccagccctgcgacgtgtggagcatcggctgcatcctgttcgagtactacagaggcttcaccctgttccagacccacgagaacagagagcacctggtgatgatggagaagatcctgggccccatccccagccacatgatccacagaaccagaaagcagaagtacttctacaagggcggcctggtgtgggacgagaacagcagcgacggcagatacgtgaaggagaactgcaagcccctgaagagctacatgctgcaggacagcctggagcacgtgcagctgttcgacctgatgagaagaatgctggagttcgaccccgcccagagaatcaccctggccgaggccctgctgcaccccttcttcgccggcctgacccccgaggagagaagcttccacaccagcagaaaccccagcagatag

SEQ ID NO: 76135 - DNA, 327 bp, Artificial Sequence
  Description of Artificial Sequence: Synthetic coding sequence
atgagcctgaccagcagcagcagcgtgagagtggagtggatcgccgccgtgaccatcgccgccggcaccgccgccatcggctacctggcctacaagagattctacgtgaaggaccacagaaacaaggccatgatcaacctgcacatccagaaggacaaccccaagatcgtgcacgccttcgacatggaggacctgggcgacaaggccgtgtactgcagatgctggagaagcaagaagttccccttctgcgacggcgcccacaccaagcacaacgaggagaccggcgacaacgtgggccccctgatcatcaagaagaaggagacctag

SEQ ID NO: 76136 - DNA, 408 bp, Artificial Sequence
  Description of Artificial Sequence: Synthetic coding sequence
atggtgctggagagcgtggccagaatcgtgaaggtgcagctgcccgcctacctgaagagactgcccgtgcccgagagcatcaccggcttcgccagactgaccgtgagcgagtggctgagactgctgcccttcctgggcgtgctggccctgctgggctacctggccgtgagacccttcctgcccaagaagaagcagcagaaggacagcctgatcaacctgaagatccagaaggagaaccccaaggtggtgaacgagatcaacatcgaggacctgtgcctgaccaaggccgcctactgcagatgctggagaagcaagaccttccccgcctgcgacggcagccacaacaagcacaacgagctgaccggcgacaacgtgggccccctgatcctgaagaagaaggaggtgtag

SEQ ID NO: 76137 - DNA, 384 bp, Artificial Sequence
  Description of Artificial Sequence: Synthetic coding sequence
atgagaggcgccggcgccatcctgagacccgccgccagaggcgccagagacctgaaccccagaagagacatcagcagctggctggcccagtggttccccagaacccccgccagaagcgtggtggccctgaagacccccatcaaggtggagctggtggccggcaagacctacagatggtgcgtgtgcggcagaagcaagaagcagcccttctgcgacggcagccacttcttccagagaaccggcctgagccccctgaagttcaaggcccaggagaccagaatggtggccctgtgcacctgcaaggccacccagagacccccctactgcgacggcacccacagaagcgagagagtgcagaaggccgaggtgggcagccccctgtag

SEQ ID NO: 76138 - DNA, 1740 bp, Artificial Sequence
  Description of Artificial Sequence: Synthetic coding sequence
atgcccagcgccagctgcgacaccctgctggacgacatcgaggacatcgtgagccaggaggacagcaagccccaggacagacacttcgtgagaaaggacgtggtgcccaaggtgagaagaagaaacacccagaagtacctgcaggaggaggagaacagcccccccagcgacagcaccatccccggcatccagaagatctggatcagaacctggggctgcagccacaacaacagcgacggcgagtacatggccggccagctggccgcctacggctacaagatcaccgagaacgccagcgacgccgacctgtggctgctgaacagctgcaccgtgaagaaccccgccgaggaccacttcagaaacagcatcaagaaggcccaggaggagaacaagaagatcgtgctggccggctgcgtgccccaggcccagcccagacaggactacctgaagggcctgagcatcatcggcgtgcagcagatcgacagagtggtggaggtggtggaggagaccatcaagggccacagcgtgagactgctgggccagaagaaggacaacggcagaagactgggcggcgccagactggacctgcccaagatcagaaagaaccccctgatcgagatcatcagcatcaacaccggctgcctgaacgcctgcacctactgcaagaccaagcacgccagaggcaacctggccagctaccccatcgacgagctggtggacagagccaagcagagcttccaggagggcgtgtgcgagatctggctgaccagcgaggacaccggcgcctacggcagagacatcggcaccaacctgcccaccctgctgtggaagctggtggaggtgatccccgagggcgccatgctgagactgggcatgaccaaccccccctacatcctggagcacctggaggagatggccaagatcctgaaccaccccagagtgtacgccttcctgcacatccccgtgcagagcgccagcgacagcgtgctgatggagatgaagagagagtactgcgtggccgacttcaagagagtggtggacttcctgaaggagaaggtgcccggcatcaccatcgccaccgacatcatctgcggcttccccggcgagaccgaccaggacttccaggagaccgtgaagctggtggaggagtacaagttccccagcctgttcatcaaccagttctaccccagacccggcacccccgccgccaagatggagcaggtgcccgcccaggtgaagaagcagagaaccaaggacctgagcagagtgttccacagctacagcccctacgaccacaagatcggcgagagacagcaggtgctggtgaccgaggagagcttcgacagcaagttctacgtggcccacaaccagttctacgagcaggtgctggtgcccaagaaccccgccttcatgggcaagatggtggaggtggacatctacgagagcggcaagcacttcatgaagggccagcccgtgagcgacgccaaggtgtacacccccagcatcagcaagcccctggccaagggcgaggtgagcggcctgaccaaggacttcagaaacggcctgggcaaccagctgagcagcggcagccacaccagcgccgccagccagtgcgacagcgccagcagcagaatggtgctgcccatgcccagactgcaccaggactgcgccctgagaatgagcgtgggcctggccctgctgggcctgctgttcgccttcttcgtgaaggtgtacaactag

SEQ ID NO: 76139 - DNA, 1740 bp, Artificial Sequence; identical to SEQ ID NO: 76138
  Description of Artificial Sequence: Synthetic coding sequence

SEQ ID NO: 76140 - DNA, 1467 bp, Artificial Sequence
  Description of Artificial Sequence: Synthetic coding sequence
atgctgagcagaagatacgagggcgagatccccaagaacatctgcaagagaaagaagaccgtgcaccaggtgaccgagaacgccagcgacgccgacctgtggctgctgaacagctgcaccgtgaagaaccccgccgaggaccacttcagaaacagcatcaagaaggcccaggaggagaacaagaagatcgtgctggccggctgcgtgccccaggcccagcccagacaggactacctgaagggcctgagcatcatcggcgtgcagcagatcgacagagtggtggaggtggtggaggagaccatcaagggccacagcgtgagactgctgggccagaagaaggacaacggcagaagactgggcggcgccagactggacctgcccaagatcagaaagaaccccctgatcgagatcatcagcatcaacaccggctgcctgaacgcctgcacctactgcaagaccaagcacgccagaggcaacctggccagctaccccatcgacgagctggtggacagagccaagcagagcttccaggagggcgtgtgcgagatctggctgaccagcgaggacaccggcgcctacggcagagacatcggcaccaacctgcccaccctgctgtggaagctggtggaggtgatccccgagggcgccatgctgagactgggcatgaccaaccccccctacatcctggagcacctggaggagatggccaagatcctgaaccaccccagagtgtacgccttcctgcacatccccgtgcagagcgccagcgacagcgtgctgatggagatgaagagagagtactgcgtggccgacttcaagagagtggtggacttcctgaaggagaaggtgcccggcatcaccatcgccaccgacatcatctgcggcttccccggcgagaccgaccaggacttccaggagaccgtgaagctggtggaggagtacaagttccccagcctgttcatcaaccagttctaccccagacccggcacccccgccgccaagatggagcaggtgcccgcccaggtgatcggcgagagacagcaggtgctggtgaccgaggagagcttcgacagcaagttctacgtggcccacaaccagttctacgagcaggtgctggtgcccaagaaccccgccttcatgggcaagatggtggaggtggacatctacgagagcggcaagcacttcatgaagggccagcccgtgagcgacgccaaggtgtacacccccagcatcagcaagcccctggccaagggcgaggtgagcggcctgaccaaggacttcagaaacggcctgggcaaccagctgagcagcggcagccacaccagcgccgccagccagtgcgacagcgccagcagcagaatggtgctgcccatgcccagactgcaccaggactgcgccctgagaatgagcgtgggcctggccctgctgggcctgctgttcgccttcttcgtgaaggtgtacaactag

SEQ ID NO: 76141 - DNA, 4824 bp, Artificial Sequence
  Description of Artificial Sequence: Synthetic coding sequence
atgatggacctggtgctggaggaggacgtgaccgtgcccggcaccctgagcggctgcagcggcctggtgcccagcgtgcccgacgacctggacggcatcaaccccaacgccggcctgggcaacggcctgctgcccaacgtgagcgaggagaccgtgagccccaccagagccagaaacatgaaggacttcgagaaccagatcaccgagctgaagaaggagaacttcaacctgaagctgagaatctacttcctggaggagagaatgcagcaggagttccacggccccaccgagcacatctacaagaccaacatcgagctgaaggtggaggtggagagcctgaagagagagctgcaggagagagagcagctgctgatcaaggccagcaaggccgtggagagcctggccgaggccggcggcagcgagatccagagagtgaaggaggacgccagaaagaaggtgcagcaggtggaggacctgctgaccaagagaatcctgctgctggagaaggccaaggacgtgaccgccgcccaggccgagctggagaaggccttcgccggcaccgagaccgagaaggccctgagactgagactggagagcaagctgagcgagatgaagaagatgcacgagggcgacctggccatggccctggtgctggacgagaaggacagactgatcgaggagctgaagctgagcctgaagagcaaggaggccctgatccagtgcctgaaggaggagaagagccagatggcctgccccgacgagaacgtgagcagcggcgagctgagaggcctgtgcgccgcccccagagaggagaaggagagagagaccgaggccgcccagatggagcaccagaaggagagaaacagcttcgaggagagaatccaggccctggaggaggacctgagagagaaggagagagagatcgccaccgagaagaagaacagcctgaagagagacaaggccatccagggcctgaccatggccctgaagagcaaggagaagaaggtggaggagctgaacagcgagatcgagaagctgagcgccgccttcgccaaggccagagaggccctgcagaaggcccagacccaggagttccagggcagcgaggactacgagaccgccctgagcggcaaggaggccctgagcgccgccctgagaagccagaacctgaccaagagcaccgagaaccacagactgagaagaagcatcaagaagatcacccaggagctgagcgacctgcagcaggagagagagagactggagaaggacctggaggaggcccacagagagaagagcaagggcgactgcaccatcagagacctgagaaacgaggtggagaagctgagaaacgaggtgaacgagagagagaaggccatggagaacagatacaagagcctgctgagcgagagcaacaagaagctgcacaaccaggagcaggtgatcaagcacctgaccgagagcaccaaccagaaggacgtgctgctgcagaagttcaacgagaaggacctggaggtgatccagcagaactgctacctgatggccgccgaggacctggagctgagaagcgagggcctgatcaccgagaagtgcagcagccagcagccccccggcagcaagaccatcttcagcaaggagaagaagcagagcagcgactacgaggagctgatccaggtgctgaagaaggagcaggacatctacacccacctggtgaagagcctgcaggagagcgacagcatcaacaacctgcaggccgagctgaacaagatcttcgccctgagaaagcagctggagcaggacgtgctgagctaccagaacctgagaaagaccctggaggagcagatcagcgagatcagaagaagagaggagagcttcagcctgtacagcgaccagaccagctacctgagcatctgcctggaggagaacaacagattccaggtggagcacttcagccaggaggagctgaagaagaaggtgagcgacctgatccagctggtgaaggagctgtacaccgacaaccagcacctgaagaagaccatcttcgacctgagctgcatgggcttccagggcaacggcttccccgacagactggccagcaccgagcagaccgaggaggccaagaagagcagactgcccatcctgatcaagcccagcagaagcctgggcaacatgtacagactgcccgccacccaggaggtggtgacccagctgcagagccagatcctggagctgcagggcgagctgaaggagttcaagacctgcaacaagcagctgcaccagaagctgatcctggccgaggccgtgatggagggcagacccacccccgacaagaccctgctgaacgcccagccccccgtgggcgccgcctaccaggacagccccggcgagcagaagggcatcaagaccaccagcagcgtgtggagagacaaggagatggacagcgaccagcagagaagctacgagatcgacagcgagatctgcccccccgacgacctggccagcctgcccagctgcaaggagaaccccgaggacgtgctgagccccaccagcgtggccacctacctgagcagcaagagccagcccagcgccaaggtgagcgtgatgggcaccgaccagagcgagagcatcaacaccagcaacgagaccgagtacctgaagcagaagatccacgacctggagaccgagctggagggctaccagaacttcatcttccagctgcagaagcacagccagtgcagcgaggccatcatcaccgtgctgtgcggcaccgagggcgcccaggacggcctgagcaagcccaagaacggcagcgacggcgaggagatgaccttcagcagcctgcaccaggtgagatacgtgaagcacgtgaagatcctgggccccctggcccccgagatgatcgacagcagagtgctggagaacctgaagcagcagctggaggagcaggagtacaagctgcagaaggagcagaacctgaacatgcagctgttcagcgagatccacaacctgcagaacaagttcagagacctgagcccccccagatacgacagcctggtgcagagccaggccagagagctgagcctgcagagacagcagatcaaggacggccacggcatctgcgtgatcagcagacagcacatgaacaccatgatcaaggccttcgaggagctgctgcaggccagcgacgtggactactgcgtggccgagggcttccaggagcagctgaaccagtgcgccgagctgctggagaagctggagaagctgttcctgaacggcaagagcgtgggcgtggagatgaacacccagaacgagctgatggagagaatcgaggaggacaacctgacctaccagcacctgctgcccgagagccccgagcccagcgccagccacgccctgagcgactacgagaccagcgagaagagcttcttcagcagagaccagaagcaggacaacgagaccgagaagaccagcgtgatggtgaacagcttcagccaggacctgctgatggagcacatccaggagatcagaaccctgagaaagagactggaggagagcatcaagaccaacgagaagctgagaaagcagctggagagacagggcagcgagttcgtgcagggcagcaccagcatcttcgccagcggcagcgagctgcacagcagcctgaccagcgagatccacttcctgagaaagcagaaccaggccctgaacgccatgctgatcaagggcagcagagacaagcagaaggagaacgacaagctgagagagagcctgagcagaaagaccgtgagcctggagcacctgcagagagagtacgccagcgtgaaggaggagaacgagagactgcagaaggagggcagcgagaaggagagacacaaccagcagctgatccaggaggtgagatgcagcggccaggagctgagcagagtgcaggaggaggtgaagctgagacagcagctgctgagccagaacgacaagctgctgcagagcctgagagtggagctgaaggcctacgagaagctggacgaggagcacagaagactgagagaggccagcggcgagggctggaagggccaggaccccttcagagacctgcacagcctgctgatggagatccaggccctgagactgcagctggagagaagcatcgagaccagcagcaccctgcagagcagactgaaggagcagctggccagaggcgccgagaaggcccaggagggcgccctgaccctggccgtgcaggccgtgagcatccccgaggtgcccctgcagcccgacaagcacgacggcgacaagtaccccatggagagcgacaacagcttcgacctgttcgacagcagccaggccgtgacccccaagagcgtgagcgagaccccccccctgagcggcaacgacaccgacagcctgagctgcgacagcggcagcagcgccaccagcaccccctgcgtgagcagactggtgaccggccaccacctgtgggccagcaagaacggcagacacgtgctgggcctgatcgaggactacgaggccctgctgaagcagatcagccagggccagagactgctggccgagatggacatccagacccaggaggcccccagcagcaccagccaggagctgggcaccaagggcccccaccccgcccccctgagcaagttcgtgagcagcgtgagcaccgccaagctgaccctggaggaggcctacagaagactgaagctgctgtggagagtgagcctgcccgaggacggccagtgccccctgcactgcgagcagatcggcgagatgaaggccgaggtgaccaagctgcacaagaagctgaagaagagctag

SEQ ID NO: 76142 - DNA, 5682 bp, Artificial Sequence
  Description of Artificial Sequence: Synthetic coding sequence
atgatggacctggtgctggaggaggacgtgaccgtgcccggcaccctgagcggctgcagcggcctggtgcccagcgtgcccgacgacctggacggcatcaaccccaacgccggcctgggcaacggcctgctgcccaacgtgagcgaggagaccgtgagccccaccagagccagaaacatgaaggacttcgagaaccagatcaccgagctgaagaaggagaacttcaacctgaagctgagaatctacttcctggaggagagaatgcagcaggagttccacggccccaccgagcacatctacaagaccaacatcgagctgaaggtggaggtggagagcctgaagagagagctgcaggagagagagcagctgctgatcaaggccagcaaggccgtggagagcctggccgaggccggcggcagcgagatccagagagtgaaggaggacgccagaaagaaggtgcagcaggtggaggacctgctgaccaagagaatcctgctgctggagaaggacgtgaccgccgcccaggccgagctggagaaggccttcgccggcaccgagaccgagaaggccctgagactgagactggagagcaagctgagcgagatgaagaagatgcacgagggcgacctggccatggccctggtgctggacgagaaggacagactgatcgaggagctgaagctgagcctgaagagcaaggaggccctgatccagtgcctgaaggaggagaagagccagatggcctgccccgacgagaacgtgagcagcggcgagctgagaggcctgtgcgccgcccccagagaggagaaggagagagagaccgaggccgcccagatggagcaccagaaggagagaaacagcttcgaggagagaatccaggccctggaggaggacctgagagagaaggagagagagatcgccaccgagaagaagaacagcctgaagagagacaaggccatccagggcctgaccatggccctgaagagcaaggagaagaaggtggaggagctgaacagcgagatcgagaagctgagcgccgccttcgccaaggccagagaggccctgcagaaggcccagacccaggagttccagggcagcgaggactacgagaccgccctgagcggcaaggaggccctgagcgccgccctgagaagccagaacctgaccaagagcaccgagaaccacagactgagaagaagcatcaagaagatcacccaggagctgagcgacctgcagcaggagagagagagactggagaaggacctggaggaggcccacagagagaagagcaagggcgactgcaccatcagagacctgagaaacgaggtggagaagctgagaaacgaggtgaacgagagagagaaggccatggagaacagatacaagagcctgctgagcgagagcaacaagaagctgcacaaccaggagcaggtgatcaagcacctgaccgagagcaccaaccagaaggacgtgctgctgcagaagttcaacgagaaggacctggaggtgatccagcagaactgctacctgatggccgccgaggacctggagctgagaagcgagggcctgatcaccgagaagtgcagcagccagcagccccccggcagcaagaccatcttcagcaaggagaagaagcagagcagcgactacgaggagctgatccaggtgctgaagaaggagcaggacatctacacccacctggtgaagagcctgcaggagagcgacagcatcaacaacctgcaggccgagctgaacaagatcttcgccctgagaaagcagctggagcaggacgtgctgagctaccagaacctgagaaagaccctggaggagcagatcagcgagatcagaagaagagaggaggagagcttcagcctgtacagcgaccagaccagctacctgagcatctgcctggaggagaacaacagattccaggtggagcacttcagccaggaggagctgaagaagaaggtgagcgacctgatccagctggtgaaggagctgtacaccgacaaccagcacctgaagaagaccatcttcgacctgagctgcatgggcttccagggcaacggcttccccgacagactggccagcaccgagcagaccgagctgctggccagcaaggaggacgaggacaccatcaagatcggcgaggacgacgagatcaacttcctgagcgaccagcacctgcagcagagcaacgagatcatgaaggacctgagcaagggcggctgcaagaacggctacctgagacacaccgagagcaagatcagcgactgcgacggcgcccacgcccccggctgcctggaggagggcgccttcatcaacctgctggcccccctgttcaacgagaaggccaccctgctgctggagagcagacccgacctgctgaaggtggtgagagagctgctgctgggccagctgttcctgaccgagcaggaggtgagcggcgagcacctggacggcaagaccgagaagacccccaagcagaagggcgagctggtgcacttcgtgcagaccaacagcttcagcaagccccacgacgagctgaagctgagctgcgaggcccagctggtgaaggccggcgaggtgcccaaggtgggcctgaaggacgccagcgtgcagaccgtggccaccgagggcgacctgctgagattcaagcacgaggccaccagagaggcctgggaggagaagcccatcaacaccgccctgagcgccgagcacagacccgagaacctgcacggcgtgcccggctggcaggccgccctgctgagcctgcccggcatcaccaacagagaggccaagaagagcagactgcccatcctgatcaagcccagcagaagcctgggcaacatgtacagactgcccgccacccaggaggtggtgacccagctgcagagccagatcctggagctgcagggcgagctgaaggagttcaagacctgcaacaagcagctgcaccagaagctgatcctggccgaggccgtgatggagggcagacccacccccgacaagaccctgctgaacgcccagccccccgtgggcgccgcctaccaggacagccccggcgagcagaagggcatcaagaccaccagcagcgtgtggagagacaaggagatggacagcgaccagcagagaagctacgagatcgacagcgagatctgcccccccgacgacctggccagcctgcccagctgcaaggagaaccccgaggacgtgctgagccccaccagcgtggccacctacctgagcagcaagagccagcccagcgccaaggtgagcgtgatgggcaccgaccagagcgagagcatcaacaccagcaacgagaccgagtacctgaagcagaagatccacgacctggagaccgagctggagggctaccagaacttcatcttccagctgcagaagcacagccagtgcagcgaggccatcatcaccgtgctgtgcggcaccgagggcgcccaggacggcctgagcaagcccaagaacggcagcgacggcgaggagatgaccttcagcagcctgcaccaggtgagatacgtgaagcacgtgaagatcctgggccccctggcccccgagatgatcgacagcagagtgctggagaacctgaagcagcagctggaggagcaggagtacaagctgcagaaggagcagaacctgaacatgcagctgttcagcgagatccacaacctgcagaacaagttcagagacctgagcccccccagatacgacagcctggtgcagagccaggccagagagctgagcctgcagagacagcagatcaaggacggccacggcatctgcgtgatcagcagacagcacatgaacaccatgatcaaggccttcgaggagctgctgcaggccagcgacgtggactactgcgtggccgagggcttccaggagcagctgaaccagtgcgccgagctgctggagaagctggagaagctgttcctgaacggcaagagcgtgggcgtggagatgaacacccagaacgagctgatggagagaatcgaggaggacaacctgacctaccagcacctgctgcccgagagccccgagcccagcgccagccacgccctgagcgactacgagaccagcgagaagagcttcttcagcagagaccagaagcaggacaacgagaccgagaagaccagcgtgatggtgaacagcttcagccaggacctgctgatggagcacatccaggagatcagaaccctgagaaagagactggaggagagcatcaagaccaacgagaagctgagaaagcagctggagagacagggcagcgagttcgtgcagggcagcaccagcatcttcgccagcggcagcgagctgcacagcagcctgaccagcgagatccacttcctgagaaagcagaaccaggccctgaacgccatgctgatcaagggcagcagagacaagcagaaggagaacgacaagctgagagagagcctgagcagaaagaccgtgagcctggagcacctgcagagagagtacgccagcgtgaaggaggagaacgagagactgcagaaggagggcagcgagaaggagagacacaaccagcagctgatccaggaggtgagatgcagcggccaggagctgagcagagtgcaggaggaggtgaagctgagacagcagctgctgagccagaacgacaagctgctgcagagcctgagagtggagctgaaggcctacgagaagctggacgaggagcacagaagactgagagaggccagcggcgagggctggaagggccaggaccccttcagagacctgcacagcctgctgatggagatccaggccctgagactgcagctggagagaagcatcgagaccagcagcaccctgcagagcagactgaaggagcagctggccagaggcgccgagaaggcccaggagggcgccctgaccctggccgtgcaggccgtgagcatccccgaggtgcccctgcagcccgacaagcacgacggcgacaagtaccccatggagagcgacaacagcttcgacctgttcgacagcagccaggccgtgacccccaagagcgtgagcgagaccccccccctgagcggcaacgacaccgacagcctgagctgcgacagcggcagcagcgccaccagcaccccctgcgtgagcagactggtgaccggccaccacctgtgggccagcaagaacggcagacacgtgctgggcctgatcgaggactacgaggccctgctgaagcagatcagccagggccagagactgctggccgagatggacatccagacccaggaggcccccagcagcaccagccaggagctgggcaccaagggcccccaccccgcccccctgagcaagttcgtgagcagcgtgagcaccgccaagctgaccctggaggaggcctacagaagactgaagctgctgtggagagtgagcctgcccgaggacggccagtgccccctgcactgcgagcagatcggcgagatgaaggccgaggtgaccaagctgcacaagaagctgttcgagcaggagaagaagctgcagaacaccatgaagctgctgcagctgagcaagagacaggagaaggtgatcttcgaccagctggtggtgacccacaagatcctgagaaaggccagaggcaacctggagctgagacccggcggcgcccaccccggcacctgcagccccagcagacccggcagctag

SEQ ID NO: 76143 - DNA, 5559 bp, Artificial Sequence
  Description of Artificial Sequence: Synthetic coding sequence
atgatggacctggtgctggaggaggacgtgaccgtgcccggcaccctgagcggctgcagcggcctggtgcccagcgtgcccgacgacctggacggcatcaaccccaacgccggcctgggcaacggcctgctgcccaacgtgagcgaggagaccgtgagccccaccagagccagaaacatgaaggacttcgagaaccagatcaccgagctgaagaaggagaacttcaacctgaagctgagaatctacttcctggaggagagaatgcagcaggagttccacggccccaccgagcacatctacaagaccaacatcgagctgaaggtggaggtggagagcctgaagagagagctgcaggagagagagcagctgctgatcaaggccagcaaggccgtggagagcctggccgaggccggcggcagcgagatccagagagtgaaggaggacgccagaaagaaggtgcagcaggtggaggacctgctgaccaagagaatcctgctgctggagaaggacgtgaccgccgcccaggccgagctggagaaggccttcgccggcaccgagaccgagaaggccctgagactgagactggagagcaagctgagcgagatgaagaagatgcacgagggcgacctggccatggccctggtgctggacgagaaggacagactgatcgaggagctgaagctgagcctgaagagcaaggaggccctgatccagtgcctgaaggaggagaagagccagatggcctgccccgacgagaacgtgagcagcggcgagctgagaggcctgtgcgccgcccccagagaggagaaggagagagagaccgaggccgcccagatggagcaccagaaggagagaaacagcttcgaggagagaatccaggccctggaggaggacctgagagagaaggagagagagatcgccaccgagaagaagaacagcctgaagagagacaaggccatccagggcctgaccatggccctgaagagcaaggagaagaaggtggaggagctgaacagcgagatcgagaagctgagcgccgccttcgccaaggccagagaggccctgcagaaggcccagacccaggagttccagggcagcgaggactacgagaccgccctgagcggcaaggaggccctgagcgccgccctgagaagccagaacctgaccaagagcaccgagaaccacagactgagaagaagcatcaagaagatcacccaggagctgagcgacctgcagcaggagagagagagactggagaaggacctggaggaggcccacagagagaagagcaagggcgactgcaccatcagagacctgagaaacgaggtggagaagctgagaaacgaggtgaacgagagagagaaggccatggagaacagatacaagagcctgctgagcgagagcaacaagaagctgcacaaccaggagcaggtgatcaagcacctgaccgagagcaccaaccagaaggacgtgctgctgcagaagttcaacgagaaggacctggaggtgatccagcagaactgctacctgatggccgccgaggacctggagctgagaagcgagggcctgatcaccgagaagtgcagcagccagcagccccccggcagcaagaccatcttcagcaaggagaagaagcagagcagcgactacgaggagctgatccaggtgctgaagaaggagcaggacatctacacccacctggtgaagagcctgcaggagagcgacagcatcaacaacctgcaggccgagctgaacaagatcttcgccctgagaaagcagctggagcaggacgtgctgagctaccagaacctgagaaagaccctggaggagcagatcagcgagatcagaagaagagaggaggagagcttcagcctgtacagcgaccagaccagctacctgagcatctgcctggaggagaacaacagattccaggtggagcacttcagccaggaggagctgaagaagaaggtgagcgacctgatccagctggtgaaggagctgtacaccgacaaccagcacctgaagaagaccatcttcgacctgagctgcatgggcttccagggcaacggcttccccgacagactggccagcaccgagcagaccgagctgctggccagcaaggaggacgaggacaccatcaagatcggcgaggacgacgagatcaacttcctgagcgaccagcacctgcagcagagcaacgagatcatgaaggacctgagcaagggcggctgcaagaacggctacctgagacacaccgagagcaagatcagcgactgcgacggcgcccacgcccccggctgcctggaggagggcgccttcatcaacctgctggcccccctgttcaacgagaaggccaccctgctgctggagagcagacccgacctgctgaaggtggtgagagagctgctgctgggccagctgttcctgaccgagcaggaggtgagcggcgagcacctggacggcaagaccgagaagacccccaagcagaagggcgagctggtgcacttcgtgcagaccaacagcttcagcaagccccacgacgagctgaagctgagctgcgaggcccagctggtgaaggccggcgaggtgcccaaggtgggcctgaaggacgccagcgtgcagaccgtggccaccgagggcgacctgctgagattcaagcacgaggccaccagagaggcctgggaggagaagcccatcaacaccgccctgagcgccgagcacagacccgagaacctgcacggcgtgcccggctggcaggccgccctgctgagcctgcccggcatcaccaacagagaggccaagaagagcagactgcccatcctgatcaagcccagcagaagcctgggcaacatgtacagactgcccgccacccaggaggtggtgacccagctgcagagccagatcctggagctgcagggcgagctgaaggagttcaagacctgcaacaagcagctgcaccagaagctgatcctggccgaggccgtgatggagggcagacccacccccgacaagaccctgctgaacgacagcgagatctgcccccccgacgacctggccagcctgcccagctgcaaggagaaccccgaggacgtgctgagccccaccagcgtggccacctacctgagcagcaagagccagcccagcgccaaggtgagcgtgatgggcaccgaccagagcgagagcatcaacaccagcaacgagaccgagtacctgaagcagaagatccacgacctggagaccgagctggagggctaccagaacttcatcttccagctgcagaagcacagccagtgcagcgaggccatcatcaccgtgctgtgcggcaccgagggcgcccaggacggcctgagcaagcccaagaacggcagcgacggcgaggagatgaccttcagcagcctgcaccaggtgagatacgtgaagcacgtgaagatcctgggccccctggcccccgagatgatcgacagcagagtgctggagaacctgaagcagcagctggaggagcaggagtacaagctgcagaaggagcagaacctgaacatgcagctgttcagcgagatccacaacctgcagaacaagttcagagacctgagcccccccagatacgacagcctggtgcagagccaggccagagagctgagcctgcagagacagcagatcaaggacggccacggcatctgcgtgatcagcagacagcacatgaacaccatgatcaaggccttcgaggagctgctgcaggccagcgacgtggactactgcgtggccgagggcttccaggagcagctgaaccagtgcgccgagctgctggagaagctggagaagctgttcctgaacggcaagagcgtgggcgtggagatgaacacccagaacgagctgatggagagaatcgaggaggacaacctgacctaccagcacctgctgcccgagagccccgagcccagcgccagccacgccctgagcgactacgagaccagcgagaagagcttcttcagcagagaccagaagcaggacaacgagaccgagaagaccagcgtgatggtgaacagcttcagccaggacctgctgatggagcacatccaggagatcagaaccctgagaaagagactggaggagagcatcaagaccaacgagaagctgagaaagcagctggagagacagggcagcgagttcgtgcagggcagcaccagcatcttcgccagcggcagcgagctgcacagcagcctgaccagcgagatccacttcctgagaaagcagaaccaggccctgaacgccatgctgatcaagggcagcagagacaagcagaaggagaacgacaagctgagagagagcctgagcagaaagaccgtgagcctggagcacctgcagagagagtacgccagcgtgaaggaggagaacgagagactgcagaaggagggcagcgagaaggagagacacaaccagcagctgatccaggaggtgagatgcagcggccaggagctgagcagagtgcaggaggaggtgaagctgagacagcagctgctgagccagaacgacaagctgctgcagagcctgagagtggagctgaaggcctacgagaagctggacgaggagcacagaagactgagagaggccagcggcgagggctggaagggccaggaccccttcagagacctgcacagcctgctgatggagatccaggccctgagactgcagctggagagaagcatcgagaccagcagcaccctgcagagcagactgaaggagcagctggccagaggcgccgagaaggcccaggagggcgccctgaccctggccgtgcaggccgtgagcatccccgaggtgcccctgcagcccgacaagcacgacggcgacaagtaccccatggagagcgacaacagcttcgacctgttcgacagcagccaggccgtgacccccaagagcgtgagcgagaccccccccctgagcggcaacgacaccgacagcctgagctgcgacagcggcagcagcgccaccagcaccccctgcgtgagcagactggtgaccggccaccacctgtgggccagcaagaacggcagacacgtgctgggcctgatcgaggactacgaggccctgctgaagcagatcagccagggccagagactgctggccgagatggacatccagacccaggaggcccccagcagcaccagccaggagctgggcaccaagggcccccaccccgcccccctgagcaagttcgtgagcagcgtgagcaccgccaagctgaccctggaggaggcctacagaagactgaagctgctgtggagagtgagcctgcccgaggacggccagtgccccctgcactgcgagcagatcggcgagatgaaggccgaggtgaccaagctgcacaagaagctgttcgagcaggagaagaagctgcagaacaccatgaagctgctgcagctgagcaagagacaggagaaggtgatcttcgaccagctggtggtgacccacaagatcctgagaaaggccagaggcaacctggagctgagacccggcggcgcccaccccggcacctgcagccccagcagacccggcagctag

SEQ ID NO: 76144 - DNA, 5445 bp, Artificial Sequence
  Description of Artificial Sequence: Synthetic coding sequence
atgatggacctggtgctggaggaggacgtgaccgtgcccggcaccctgagcggctgcagcggcctggtgcccagcgtgcccgacgacctggacggcatcaaccccaacgccggcctgggcaacggcctgctgcccaacgtgagcgaggagaccgtgagccccaccagagccagaaacatgaaggacttcgagaaccagatcaccgagctgaagaaggagaacttcaacctgaagctgagaatctacttcctggaggagagaatgcagcaggagttccacggccccaccgagcacatctacaagaccaacatcgagctgaaggtggaggtggagagcctgaagagagagctgcaggagagagagcagctgctgatcaaggccagcaaggccgtggagagcctggccgaggccggcggcagcgagatccagagagtgaaggaggacgccagaaagaaggtgcagcaggtggaggacctgctgaccaagagaatcctgctgctggagaaggacgtgaccgccgcccaggccgagctggagaaggccttcgccggcaccgagaccgagaaggccctgagactgagactggagagcaagctgagcgagatgaagaagatgcacgagggcgacctggccatggccctggtgctggacgagaaggacagactgatcgaggagctgaagctgagcctgaagagcaaggaggccctgatccagtgcctgaaggaggagaagagccagatggcctgccccgacgagaacgtgagcagcggcgagctgagaggcctgtgcgccgcccccagagaggagaaggagagagagaccgaggccgcccagatggagcaccagaaggagagaaacagcttcgaggagagaatccaggccctggaggaggacctgagagagaaggagagagagatcgccaccgagaagaagaacagcctgaagagagacaaggccatccagggcctgaccatggccctgaagagcaaggagaagaaggtggaggagctgaacagcgagatcgagaagctgagcgccgccttcgccaaggccagagaggccctgcagaaggcccagacccaggagttccagggcagcgaggactacgagaccgccctgagcggcaaggaggccctgagcgccgccctgagaagccagaacctgaccaagagcaccgagaaccacagactgagaagaagcatcaagaagatcacccaggagctgagcgacctgcagcaggagagagagagactggagaaggacctggaggaggcccacagagagaagagcaagggcgactgcaccatcagagacctgagaaacgaggtggagaagctgagaaacgaggtgaacgagagagagaaggccatggagaacagatacaagagcctgctgagcgagagcaacaagaagctgcacaaccaggagcaggtgatcaagcacctgaccgagagcaccaaccagaaggacgtgctgctgcagaagttcaacgagaaggacctggaggtgatccagcagaactgctacctgatggccgccgaggacctggagctgagaagcgagggcctgatcaccgagaagtgcagcagccagcagccccccggcagcaagaccatcttcagcaaggagaagaagcagagcagcgactacgaggagctgatccaggtgctgaagaaggagcaggacatctacacccacctggtgaagagcctgcaggagagcgacagcatcaacaacctgcaggccgagctgaacaagatcttcgccctgagaaagcagctggagcaggacgtgctgagctaccagaacctgagaaagaccctggaggagcagatcagcgagatcagaagaagagaggaggagagcttcagcctgtacagcgaccagaccagctacctgagcatctgcctggaggagaacaacagattccaggtggagcacttcagccaggaggagctgaagaagaaggtgagcgacctgatccagctggtgaaggagctgtacaccgacaaccagcacctgaagaagaccatcttcgacctgagctgcatgggcttccagggcaacggcttccccgacagactggccagcaccgagcagaccgagctgctggccagcaaggaggacgaggacaccatcaagatcggcgaggacgacgagatcaacttcctgagcgaccagcacctgcagcagagcaacgagatcatgaaggacctgagcaagggcggctgcaagaacggctacctgagacacaccgagagcaagatcagcgactgcgacggcgcccacgcccccggctgcctggaggagggcgccttcatcaacctgctggcccccctgttcaacgagaaggccaccctgctgctggagagcagacccgacctgctgaaggtggtgagagagctgctgctgggccagctgttcctgaccgagcaggaggtgagcggcgagcacctggacggcaagaccgagaagacccccaagcagaagggcgagctggtgcacttcgtgcagaccaacagcttcagcaagccccacgacgagctgaagctgagctgcgaggcccagctggtgaaggccggcgaggtgcccaaggtgggcctgaaggacgccagcgtgcagaccgtggccaccgagggcgacctgctgagattcaagcacgaggccaccagagaggcctgggaggagaagcccatcaacaccgccctgagcgccgagcacagacccgagaacctgcacggcgtgcccggctggcaggccgccctgctgagcctgcccggcatcaccaacagagaggccaagaagagcagactgcccatcctgatcaagcccagcagaagcctgggcaacatgtacagactgcccgccacccaggaggtggtgacccagctgcagagccagatcctggagctgcagggcgagctgaaggagttcaagacctgcaacaagcagctgcaccagaagctgatcctggccgaggccgtgatggagggcagacccacccccgacaagaccctgctgaacgcccagccccccgtgggcgccgcctaccaggacagccccggcgagcagaagggcatcaagaccaccagcagcgtgtggagagacaaggagatggacagcgaccagcagagaagctacgagatcgacagcgagatctgcccccccgacgacctggccagcctgcccagctgcaaggagaaccccgaggacgtgctgagccccaccagcgtggccacctacctgagcagcaagagccagcccagcgccaaggtgagcgtgatgggcaccgaccagagcgagagcatcaacaccagcaacgagaccgagtacctgaagcagaagatccacgacctggagaccgagctggagggctaccagaacttcatcttccagctgcagaagcacagccagtgcagcgaggccatcatcaccgtgctgtgcggcaccgagggcgcccaggacggcctgagcaagcccaagaacggcagcgacggcgaggagatgaccttcagcagcctgcaccaggtgagatacgtgaagcacgtgaagatcctgggccccctggcccccgagatgatcgacagcagagtgctggagaacctgaagcagcagctggaggagcaggagtacaagctgcagaaggagcagaacctgaacatgcagctgttcagcgagatccacaacctgcagaacaagttcagagacctgagcccccccagatacgacagcctggtgcagagccaggccagagagctgagcctgcagagacagcagatcaaggacggccacggcatctgcgtgatcagcagacagcacatgaacaccatgatcaaggccttcgaggagctgctgcaggccagcgacgtggactactgcgtggccgagggcttccaggagcagctgaaccagtgcgccgagctgctggagaagctggagaagctgttcctgaacggcaagagcgtgggcgtggagatgaacacccagaacgagctgatggagagaatcgaggaggacaacctgacctaccagcacctgctgcccgagagccccgagcccagcgccagccacgccctgagcgactacgagaccagcgagaagagcttcttcagcagagaccagaagcaggacaacgagaccgagaagaccagcgtgatggtgaacagcttcagccaggacctgctgatggagcacatccaggagatcagaaccctgagaaagagactggaggagagcatcaagaccaacgagaagctgagaaagcagctggagagacagggcagcgagttcgtgcagggcagcaccagcatcttcgccagcggcagcgagctgcacagcagcctgaccagcgagatccacttcctgagaaagcagaaccaggccctgaacgccatgctgatcaagggcagcagagacaagcagaaggagaacgacaagctgagagagagcctgagcagaaagaccgtgagcctggagcacctgcagagagagtacgccagcgtgaaggaggagaacgagagactgcagaaggagggcagcgagaaggagagacacaaccagcagctgatccaggaggtgagatgcagcggccaggagctgagcagagtgcaggaggaggtgaagctgagacagcagctgctgagccagaacgacaagctgctgcagagcctgagagtggagctgaaggcctacgagaagctggacgaggagcacagaagactgagagacggcgacaagtaccccatggagagcgacaacagcttcgacctgttcgacagcagccaggccgtgacccccaagagcgtgagcgagaccccccccctgagcggcaacgacaccgacagcctgagctgcgacagcggcagcagcgccaccagcaccccctgcgtgagcagactggtgaccggccaccacctgtgggccagcaagaacggcagacacgtgctgggcctgatcgaggactacgaggccctgctgaagcagatcagccagggccagagactgctggccgagatggacatccagacccaggaggcccccagcagcaccagccaggagctgggcaccaagggcccccaccccgcccccctgagcaagttcgtgagcagcgtgagcaccgccaagctgaccctggaggaggcctacagaagactgaagctgctgtggagagtgagcctgcccgaggacggccagtgccccctgcactgcgagcagatcggcgagatgaaggccgaggtgaccaagctgcacaagaagctgttcgagcaggagaagaagctgcagaacaccatgaagctgctgcagctgagcaagagacaggagaaggtgatcttcgaccagctggtggtgacccacaagatcctgagaaaggccagaggcaacctggagctgagacccggcggcgcccaccccggcacctgcagccccagcagacccggcagctag

SEQ ID NO: 76145 - DNA, 5586 bp, Artificial Sequence
  Description of Artificial Sequence: Synthetic coding sequence
atgatggacctggtgctggaggaggacgtgaccgtgcccggcaccctgagcggctgcagcggcctggtgcccagcgtgcccgacgacctggacggcatcaaccccaacgccggcctgggcaacggcctgctgcccaacgtgagcgaggagaccgtgagccccaccagagccagaaacatgaaggacttcgagaaccagatcaccgagctgaagaaggagaacttcaacctgaagctgagaatctacttcctggaggagagaatgcagcaggagttccacggccccaccgagcacatctacaagaccaacatcgagctgaaggtggaggtggagagcctgaagagagagctgcaggagagagagcagctgctgatcaaggccagcaaggccgtggagagcctggccgaggccggcggcagcgagatccagagagtgaaggaggacgccagaaagaaggtgcagcaggtggaggacctgctgaccaagagaatcctgctgctggagaaggacgtgaccgccgcccaggccgagctggagaaggccttcgccggcaccgagaccgagaaggccctgagactgagactggagagcaagctgagcgagatgaagaagatgcacgagggcgacctggccatggccctggtgctggacgagaaggacagactgatcgaggagctgaagctgagcctgaagagcaaggaggccctgatccagtgcctgaaggaggagaagagccagatggcctgccccgacgagaacgtgagcagcggcgagctgagaggcctgtgcgccgcccccagagaggagaaggagagagagaccgaggccgcccagatggagcaccagaaggagagaaacagcttcgaggagagaatccaggccctggaggaggacctgagagagaaggagagagagatcgccaccgagaagaagaacagcctgaagagagacaaggccatccagggcctgaccatggccctgaagagcaaggagaagaaggtggaggagctgaacagcgagatcgagaagctgagcgccgccttcgccaaggccagagaggccctgcagaaggcccagacccaggagttccagggcagcgaggactacgagaccgccctgagcggcaaggaggccctgagcgccgccctgagaagccagaacctgaccaagagcaccgagaaccacagactgagaagaagcatcaagaagatcacccaggagctgagcgacctgcagcaggagagagagagactggagaaggacctggaggaggcccacagagagaagagcaagggcgactgcaccatcagagacctgagaaacgaggtggagaagctgagaaacgaggtgaacgagagagagaaggccatggagaacagatacaagagcctgctgagcgagagcaacaagaagctgcacaaccaggagcaggtgatcaagcacctgaccgagagcaccaaccagaaggacgtgctgctgcagaagttcaacgagaaggacctggaggtgatccagcagaactgctacctgatggccgccgaggacctggagctgagaagcgagggcctgatcaccgagaagtgcagcagccagcagccccccggcagcaagaccatcttcagcaaggagaagaagcagagcagcgactacgaggagctgatccaggtgctgaagaaggagcaggacatctacacccacctggtgaagagcctgcaggagagcgacagcatcaacaacctgcaggccgagctgaacaagatcttcgccctgagaaagcagctggagcaggacgtgctgagctaccagaacctgagaaagaccctggaggagcagatcagcgagatcagaagaagagaggaggagagcttcagcctgtacagcgaccagaccagctacctgagcatctgcctggaggagaacaacagattccaggtggagcacttcagccaggaggagctgaagaagaaggtgagcgacctgatccagctggtgaaggagctgtacaccgacaaccagcacctgaagaagaccatcttcgacctgagctgcatgggcttccagggcaacggcttccccgacagactggccagcaccgagcagaccgagatcatgaaggacctgagcaagggcggctgcaagaacggctacctgagacacaccgagagcaagatcagcgactgcgacggcgcccacgcccccggctgcctggaggagggcgccttcatcaacctgctggcccccctgttcaacgagaaggccaccctgctgctggagagcagacccgacctgctgaaggtggtgagagagctgctgctgggccagctgttcctgaccgagcaggaggtgagcggcgagcacctggacggcaagaccgagaagacccccaagcagaagggcgagctggtgcacttcgtgcagaccaacagcttcagcaagccccacgacgagctgaagctgagctgcgaggcccagctggtgaaggccggcgaggtgcccaaggtgggcctgaaggacgccagcgtgcagaccgtggccaccgagggcgacctgctgagattcaagcacgaggccaccagagaggcctgggaggagaagcccatcaacaccgccctgagcgccgagcacagacccgagaacctgcacggcgtgcccggctggcaggccgccctgctgagcctgcccggcatcaccaacagagaggccaagaagagcagactgcccatcctgatcaagcccagcagaagcctgggcaacatgtacagactgcccgccacccaggaggtggtgacccagctgcagagccagatcctggagctgcagggcgagctgaaggagttcaagacctgcaacaagcagctgcaccagaagctgatcctggccgaggccgtgatggagggcagacccacccccgacaagaccctgctgaacgcccagccccccgtgggcgccgcctaccaggacagccccggcgagcagaagggcatcaagaccaccagcagcgtgtggagagacaaggagatggacagcgaccagcagagaagctacgagatcgacagcgagatctgcccccccgacgacctggccagcctgcccagctgcaaggagaaccccgaggacgtgctgagccccaccagcgtggccacctacctgagcagcaagagccagcccagcgccaaggtgagcgtgatgggcaccgaccagagcgagagcatcaacaccagcaacgagaccgagtacctgaagcagaagatccacgacctggagaccgagctggagggctaccagaacttcatcttccagctgcagaagcacagccagtgcagcgaggccatcatcaccgtgctgtgcggcaccgagggcgcccaggacggcctgagcaagcccaagaacggcagcgacggcgaggagatgaccttcagcagcctgcaccaggtgagatacgtgaagcacgtgaagatcctgggccccctggcccccgagatgatcgacagcagagtgctggagaacctgaagcagcagctggaggagcaggagtacaagctgcagaaggagcagaacctgaacatgcagctgttcagcgagatccacaacctgcagaacaagttcagagacctgagcccccccagatacgacagcctggtgcagagccaggccagagagctgagcctgcagagacagcagatcaaggacggccacggcatctgcgtgatcagcagacagcacatgaacaccatgatcaaggccttcgaggagctgctgcaggccagcgacgtggactactgcgtggccgagggcttccaggagcagctgaaccagtgcgccgagctgctggagaagctggagaagctgttcctgaacggcaagagcgtgggcgtggagatgaacacccagaacgagctgatggagagaatcgaggaggacaacctgacctaccagcacctgctgcccgagagccccgagcccagcgccagccacgccctgagcgactacgagaccagcgagaagagcttcttcagcagagaccagaagcaggacaacgagaccgagaagaccagcgtgatggtgaacagcttcagccaggacctgctgatggagcacatccaggagatcagaaccctgagaaagagactggaggagagcatcaagaccaacgagaagctgagaaagcagctggagagacagggcagcgagttcgtgcagggcagcaccagcatcttcgccagcggcagcgagctgcacagcagcctgaccagcgagatccacttcctgagaaagcagaaccaggccctgaacgccatgctgatcaagggcagcagagacaagcagaaggagaacgacaagctgagagagagcctgagcagaaagaccgtgagcctggagcacctgcagagagagtacgccagcgtgaaggaggagaacgagagactgcagaaggagggcagcgagaaggagagacacaaccagcagctgatccaggaggtgagatgcagcggccaggagctgagcagagtgcaggaggaggtgaagctgagacagcagctgctgagccagaacgacaagctgctgcagagcctgagagtggagctgaaggcctacgagaagctggacgaggagcacagaagactgagagaggccagcggcgagggctggaagggccaggaccccttcagagacctgcacagcctgctgatggagatccaggccctgagactgcagctggagagaagcatcgagaccagcagcaccctgcagagcagactgaaggagcagctggccagaggcgccgagaaggcccaggagggcgccctgaccctggccgtgcaggccgtgagcatccccgaggtgcccctgcagcccgacaagcacgacggcgacaagtaccccatggagagcgacaacagcttcgacctgttcgacagcagccaggccgtgacccccaagagcgtgagcgagaccccccccctgagcggcaacgacaccgacagcctgagctgcgacagcggcagcagcgccaccagcaccccctgcgtgagcagactggtgaccggccaccacctgtgggccagcaagaacggcagacacgtgctgggcctgatcgaggactacgaggccctgctgaagcagatcagccagggccagagactgctggccgagatggacatccagacccaggaggcccccagcagcaccagccaggagctgggcaccaagggcccccaccccgcccccctgagcaagttcgtgagcagcgtgagcaccgccaagctgaccctggaggaggcctacagaagactgaagctgctgtggagagtgagcctgcccgaggacggccagtgccccctgcactgcgagcagatcggcgagatgaaggccgaggtgaccaagctgcacaagaagctgttcgagcaggagaagaagctgcagaacaccatgaagctgctgcagctgagcaagagacaggagaaggtgatcttcgaccagctggtggtgacccacaagatcctgagaaaggccagaggcaacctggagctgagacccggcggcgcccaccccggcacctgcagccccagcagacccggcagctag

SEQ ID NO: 76146 - DNA, 1521 bp, Artificial Sequence
  Description of Artificial Sequence: Synthetic coding sequence
atggaggaccaccagcacgtgcccatcgacatccagaccagcaagctgctggactggctggtggacagaagacactgcagcctgaagtggcagagcctggtgctgaccatcagagagaagatcaacgccgccatccaggacatgcccgagagcgaggagatcgcccagctgctgagcggcagctacatccactacttccactgcctgagaatcctggacctgctgaagggcaccgaggccagcaccaagaacatcttcggcagatacagcagccagagaatgaaggactggcaggagatcatcgccctgtacgagaaggacaacacctacctggtggagctgagcagcctgctggtgagaaacgtgaactacgagatccccagcctgaagaagcagatcgccaagtgccagcagctgcagcaggagtacagcagaaaggaggaggagtgccaggccggcgccgccgagatgagagagcagttctaccacagctgcaagcagtacggcatcaccggcgagaacgtgagaggcgagctgctggccctggtgaaggacctgcccagccagctggccgagatcggcgccgccgcccagcagagcctgggcgaggccatcgacgtgtaccaggccagcgtgggcttcgtgtgcgagagccccaccgagcaggtgctgcccatgctgagattcgtgcagaagagaggcaacagcaccgtgtacgagtggagaaccggcaccgagcccagcgtggtggagagaccccacctggaggagctgcccgagcaggtggccgaggacgccatcgactggggcgacttcggcgtggaggccgtgagcgagggcaccgacagcggcatcagcgccgaggccgccggcatcgactggggcatcttccccgagagcgacagcaaggaccccggcggcgacggcatcgactggggcgacgacgccgtggccctgcagatcaccgtgctggaggccggcacccaggcccccgagggcgtggccagaggccccgacgccctgaccctgctggagtacaccgagaccagaaaccagttcctggacgagctgatggagctggagatcttcctggcccagagagccgtggagctgagcgaggaggccgacgtgctgagcgtgagccagttccagctggcccccgccatcctgcagggccagaccaaggagaagatggtgaccatggtgagcgtgctggaggacctgatcggcaagctgaccagcctgcagctgcagcacctgttcatgatcctggccagccccagatacgtggacagagtgaccgagttcctgcagcagaagctgaagcagagccagctgctggccctgaagaaggagctgatggtgcagaagcagcaggaggccctggaggagcaggccgccctggagcccaagctggacctgctgctggagaagaccaaggagctgcagaagctgatcgaggccgacatcagcaagagatacagcggcagacccgtgaacctgatgggcaccagcctgtag

SEQ ID NO: 76147 - DNA, 1596 bp, Artificial Sequence
  Description of Artificial Sequence: Synthetic coding sequence
atgagaagacagagcatgaccagcgccaccagagacctgcacaccgccctggacggcaaggccacccagggcggcaagaaggaccaccagcacgtgcccatcgacatccagaccagcaagctgctggactggctggtggacagaagacactgcagcctgaagtggcagagcctggtgctgaccatcagagagaagatcaacgccgccatccaggacatgcccgagagcgaggagatcgcccagctgctgagcggcagctacatccactacttccactgcctgagaatcctggacctgctgaagggcaccgaggccagcaccaagaacatcttcggcagatacagcagccagagaatgaaggactggcaggagatcatcgccctgtacgagaaggacaacacctacctggtggagctgagcagcctgctggtgagaaacgtgaactacgagatccccagcctgaagaagcagatcgccaagtgccagcagctgcagcaggagtacagcagaaaggaggaggagtgccaggccggcgccgccgagatgagagagcagttctaccacagctgcaagcagtacggcatcaccggcgagaacgtgagaggcgagctgctggccctggtgaaggacctgcccagccagctggccgagatcggcgccgccgcccagcagagcctgggcgaggccatcgacgtgtaccaggccagcgtgggcttcgtgtgcgagagccccaccgagcaggtgctgcccatgctgagattcgtgcagaagagaggcaacagcaccgtgtacgagtggagaaccggcaccgagcccagcgtggtggagagaccccacctggaggagctgcccgagcaggtggccgaggacgccatcgactggggcgacttcggcgtggaggccgtgagcgagggcaccgacagcggcatcagcgccgaggccgccggcatcgactggggcatcttccccgagagcgacagcaaggaccccggcggcgacggcatcgactggggcgacgacgccgtggccctgcagatcaccgtgctggaggccggcacccaggcccccgagggcgtggccagaggccccgacgccctgaccctgctggagtacaccgagaccagaaaccagttcctggacgagctgatggagctggagatcttcctggcccagagagccgtggagctgagcgaggaggccgacgtgctgagcgtgagccagttccagctggcccccgccatcctgcagggccagaccaaggagaagatggtgaccatggtgagcgtgctggaggacctgatcggcaagctgaccagcctgcagctgcagcacctgttcatgatcctggccagccccagatacgtggacagagtgaccgagttcctgcagcagaagctgaagcagagccagctgctggccctgaagaaggagctgatggtgcagaagcagcaggaggccctggaggagcaggccgccctggagcccaagctggacctgctgctggagaagaccaaggagctgcagaagctgatcgaggccgacatcagcaagagatacagcggcagacccgtgaacctgatgggcaccagcctgtag

SEQ ID NO: 76148 - DNA, 3864 bp, Artificial Sequence
  Description of Artificial Sequence: Synthetic coding sequence
atgcaccccgacctgggccccctgtgcaccctgctgtacgtgaccctgaccatcctgtgcagcagcgtgagcagcgacctggccccctacttcaccagcgagcccctgagcgccgtgcagaagctgggcggccccgtggtgctgcactgcagcgcccagcccgtgaccaccagaatcagctggctgcacaacggcaagaccctggacggcaacctggagcacgtgaagatccaccagggcaccctgaccatcctgagcctgaacagcagcctgctgggctactaccagtgcctggccaacaacagcatcggcgccatcgtgagcggccccgccaccgtgagcgtggccgtgctgggcgacttcggcagcagcaccaagcacgtgatcaccgccgaggagaagagcgccggcttcatcggctgcagagtgcccgagagcaaccccaaggccgaggtgagatacaagatcagaggcaagtggctggagcacagcaccgagaactacctgatcctgcccagcggcaacctgcagatcctgaacgtgagcctggaggacaagggcagctacaagtgcgccgcctacaaccccgtgacccaccagctgaaggtggagcccatcggcagaaagctgctggtgagcagacccagcagcgacgacgtgcacatcctgcaccccacccacagccaggccctggccgtgctgagcagaagccccgtgaccctggagtgcgtggtgagcggcgtgcccgccccccaggtgtactggctgaaggacggccaggacatcgcccccggcagcaactggagaagactgtacagccacctggccaccgacagcgtggaccccgccgacagcggcaactacagctgcatggccggcaacaagagcggcgacgtgaagtacgtgacctacatggtgaacgtgctggagcacgccagcatcagcaagggcctgcaggaccagatcgtgagcctgggcgccaccgtgcacttcacctgcgacgtgcacggcaaccccgcccccaactgcacctggttccacaacgcccagcccatccaccccagcgccagacacctgaccgccggcaacggcctgaagatcagcggcgtgaccgtggaggacgtgggcatgtaccagtgcgtggccgacaacggcatcggcttcatgcacagcaccggcagactggagatcgagaacgacggcggcttcaagcccgtgatcatcaccgcccccgtgagcgccaaggtggccgacggcgacttcgtgaccctgagctgcaacgccagcggcctgcccgtgcccgtgatcagatggtacgacagccacggcctgatcaccagccaccccagccaggtgctgagaagcaagagcagaaagagccagctgagcagacccgagggcctgaacctggagcccgtgtacttcgtgctgagccaggccggcgccagcagcctgcacatccaggccgtgacccaggagcacgccggcaagtacatctgcgaggccgccaacgagcacggcaccacccaggccgaggccagcctgatggtggtgcccttcgagaccaacaccaaggccgagaccgtgaccctgcccgacgccgcccagaacgacgacagaagcaagagagacggcagcgagaccggcctgctgagcagcttccccgtgaaggtgcaccccagcgccgtggagagcgcccccgagaagaacgccagcggcatcagcgtgcccgacgcccccatcatcctgagccccccccagacccacacccccgacacctacaacctggtgtggagagccggcaaggacggcggcctgcccatcaacgcctacttcgtgaagtacagaaagctggacgacggcgtgggcatgctgggcagctggcacaccgtgagagtgcccggcagcgagaacgagctgcacctggccgagctggagcccagcagcctgtacgaggtgctgatggtggccagaagcgccgccggcgagggccagcccgccatgctgaccttcagaaccagcaaggagaagaccgccagcagcaagaacacccaggccagcagcccccccgtgggcatccccaagtaccccgtggtgagcgaggccgccaacaacaacttcggcgtggtgctgaccgacagcagcagacacagcggcgtgcccgaggcccccgacagacccaccatcagcaccgccagcgagaccagcgtgtacgtgacctggatccccagagccaacggcggcagccccatcaccgccttcaaggtggagtacaagagaatgagaaccagcaactggctggtggccgccgaggacatcccccccagcaagctgagcgtggaggtgagaagcctggagcccggcagcacctacaagttcagagtgatcgccatcaaccactacggcgagagcttcagaagcagcgccagcagaccctaccaggtggtgggcttccccaacagattcagcagcagacccatcaccggcccccacatcgcctacaccgaggccgtgagcgacacccagatcatgctgaagtggacctacatccccagcagcaacaacaacacccccatccagggcttctacatctactacagacccaccgacagcgacaacgacagcgactacaagagagacgtggtggagggcagcaagcagtggcacatgatcggccacctgcagcccgagaccagctacgacatcaagatgcagtgcttcaacgagggcggcgagagcgagttcagcaacgtgatgatctgcgagaccaaggtgaagagagtgcccggcgccagcgagtaccccgtgaaggacctgagcaccccccccaacagcctgggcagcggcggcaacgtgggccccgccaccagccccgccagaagcagcgacatgctgtacctgatcgtgggctgcgtgctgggcgtgatggtgctgatcctgatggtgttcatcgccatgtgcctgtggaagaacagacagcagaacaccatccagaagtacgacccccccggctacctgtaccagggcagcgacatgaacggccagatggtggactacaccaccctgagcggcgccagccagatcaacggcaacgtgcacggcggcttcctgaccaacggcggcctgagcagcggctacagccacctgcaccacaaggtgcccaacgccgtgaacggcatcgtgaacggcagcctgaacggcggcctgtacagcggccacagcaacagcctgaccagaacccacgtggacttcgagcacccccaccacctggtgaacggcggcggcatgtacaccgccgtgccccagatcgaccccctggagtgcgtgaactgcagaaactgcagaaacaacaacagatgcttcaccaagaccaacagcaccttcagcagcagccccccccccgtggtgcccgtggtggccccctacccccaggacggcctggagatgaagcccctgagccacgtgaaggtgcccgtgtgcctgaccagcgccgtgcccgactgcggccagctgcccgaggagagcgtgaaggacaacgtggagcccgtgcccacccagagaacctgctgccaggacatcgtgaacgacgtgagcagcgacggcagcgaggaccccgccgagttcagcagaggccaggagggcatgatcaacctgagaatccccgaccacctgcagctggccaagagctgcgtgtgggagggcgacagctgcgcccacagcgagaccgagatcaacatcgtgagctggaacgccctgatcctgccccccgtgcccgagggctgcgccgagaagaccatgtggagcccccccggcatccccctggacagccccaccgaggtgctgcagcagcccagagagacctag

SEQ ID NO: 76149 - DNA, 3795 bp, Artificial Sequence
  Description of Artificial Sequence: Synthetic coding sequence
atgcaccccgacctgggccccctgtgcaccctgctgtacgtgaccctgaccatcctgtgcagcagcgtgagcagcgacctggccccctacttcaccagcgagcccctgagcgccgtgcagaagctgggcggccccgtggtgctgcactgcagcgcccagcccgtgaccaccagaatcagctggctgcacaacggcaagaccctggacggcaacctggagcacgtgaagatccaccagggcaccctgaccatcctgagcctgaacagcagcctgctgggctactaccagtgcctggccaacaacagcatcggcgccatcgtgagcggccccgccaccgtgagcgtggccgtgctgggcgacttcggcagcagcaccaagcacgtgatcaccgccgaggagaagagcgccggcttcatcggctgcagagtgcccgagagcaaccccaaggccgaggtgagatacaagatcagaggcaagtggctggagcacagcaccgagaactacctgatcctgcccagcggcaacctgcagatcctgaacgtgagcctggaggacaagggcagctacaagtgcgccgcctacaaccccgtgacccaccagctgaaggtggagcccatcggcagaaagctgctggtgagcagacccagcagcgacgacgtgcacatcctgcaccccacccacagccaggccctggccgtgctgagcagaagccccgtgaccctggagtgcgtggtgagcggcgtgcccgccccccaggtgtactggctgaaggacggccaggacatcgcccccggcagcaactggagaagactgtacagccacctggccaccgacagcgtggaccccgccgacagcggcaactacagctgcatggccggcaacaagagcggcgacgtgaagtacgtgacctacatggtgaacgtgctggagcacgccagcatcagcaagggcctgcaggaccagatcgtgagcctgggcgccaccgtgcacttcacctgcgacgtgcacggcaaccccgcccccaactgcacctggttccacaacgcccagcccatccaccccagcgccagacacctgaccgccggcaacggcctgaagatcagcggcgtgaccgtggaggacgtgggcatgtaccagtgcgtggccgacaacggcatcggcttcatgcacagcaccggcagactggagatcgagaacgacggcggcttcaagcccgtgatcatcaccgcccccgtgagcgccaaggtggccgacggcgacttcgtgaccctgagctgcaacgccagcggcctgcccgtgcccgtgatcagatggtacgacagccacggcctgatcaccagccaccccagccaggtgctgagaagcaagagcagaaagagccagctgagcagacccgagggcctgaacctggagcccgtgtacttcgtgctgagccaggccggcgccagcagcctgcacatccaggccgtgacccaggagcacgccggcaagtacatctgcgaggccgccaacgagcacggcaccacccaggccgaggccagcctgatggtggtgcccttcgagaccaacaccaaggccgagaccgtgaccctgcccgacgccgcccagaacgacgacagaagcaagagagacggcagcgagaccggcctgctgagcagcttccccgtgaaggtgcaccccagcgccgtggagagcgcccccgagaagaacgccagcggcatcagcgtgcccgacgcccccatcatcctgagccccccccagacccacacccccgacacctacaacctggtgtggagagccggcaaggacggcggcctgcccatcaacgcctacttcgtgaagtacagaaagctggacgacggcgtgggcatgctgggcagctggcacaccgtgagagtgcccggcagcgagaacgagctgcacctggccgagctggagcccagcagcctgtacgaggtgctgatggtggccagaagcgccgccggcgagggccagcccgccatgctgaccttcagaaccagcaaggagaagaccgccagcagcaagaacacccaggccagcagcccccccgtgggcatccccaagtaccccgtggtgagcgaggccgccaacaacaacttcggcgtggtgctgaccgacagcagcagacacagcggcgtgcccgaggcccccgacagacccaccatcagcaccgccagcgagaccagcgtgtacgtgacctggatccccagagccaacggcggcagccccatcaccgccttcaaggtggagtacaagagaatgagaaccagcaactggctggtggccgccgaggacatcccccccagcaagctgagcgtggaggtgagaagcctggagcccggcagcacctacaagttcagagtgatcgccatcaaccactacggcgagagcttcagaagcagcgccagcagaccctaccaggtggtgggcttccccaacagattcagcagcagacccatcaccggcccccacatcgcctacaccgaggccgtgagcgacacccagatcatgctgaagtggacctacatccccagcagcaacaacaacacccccatccagggcttctacatctactacagacccaccgacagcgacaacgacagcgactacaagagagacgtggtggagggcagcaagcagtggcacatgatcggccacctgcagcccgagaccagctacgacatcaagatgcagtgcttcaacgagggcggcgagagcgagttcagcaacgtgatgatctgcgagaccaaggtgaagagagtgcccggcgccagcgagtaccccgtgaaggacctgagcaccccccccaacagcctgggcagcggcggcaacgtgggccccgccaccagccccgccagaagcagcgacatgctgtacctgatcgtgggctgcgtgctgggcgtgatggtgctgatcctgatggtgttcatcgccatgtgcctgtggaagaacagacagcagaacaccatccagaagtacgacccccccggctacctgtaccagggcagcgacatgaacggccagatggtggactacaccaccctgagcggcgccagccagatcaacggcaacgtgcacggcggcttcctgaccaacggcggcctgagcagcggctacagccacctgcaccacaaggtgcccaacgccgtgaacggcatcgtgaacggcagcctgaacggcggcctgtacagcggccacagcaacagcctgaccagaacccacgtggacttcgagcacccccaccacctggtgaacggcggcggcatgtacaccgccgtgccccagatcgaccccctggagtgcgtgaactgcagaaactgcagaaacaacaacagatgcttcaccaagaccaacagcaccttcagcagcagccccccccccgtggtgcccgtggtggccccctacccccaggacggcctggagatgaagcccctgagccacgtgaaggtgcccgtgtgcctgaccagcgccgtgcccgactgcggccagctgcccgaggagagcgtgaaggacaacgtggagcccgtgcccacccagagaacctgctgccaggacatcgtgaacgacgtgagcagcgacggcagcgaggaccccgccgagttcagcagaggcgacagctgcgcccacagcgagaccgagatcaacatcgtgagctggaacgccctgatcctgccccccgtgcccgagggctgcgccgagaagaccatgtggagcccccccggcatccccctggacagccccaccgaggtgctgcagcagcccagagagacctag

SEQ ID NO: 76150 - DNA, 1386 bp, Artificial Sequence
  Description of Artificial Sequence: Synthetic coding sequence
atgctggagctgagacacagaggcagctgccccggccccagagaggccgtgagccccccccacagagagggcgaggccgccggcggcgaccacgagaccgagagcaccagcgacaaggagaccgacatcgacgacagatacggcgacctggacagcagaaccgacagcgacatccccgagatcccccccagcagcgacagaacccccgagatcctgaagaaggccctgagcggcctgagcagcagatggaagaactggtggatcagaggcatcctgaccctgaccatgatcagcctgttcttcctgatcatctacatgggcagcttcatgctgatgctgctggtgctgggcatccaggtgaagtgcttccacgagatcatcaccatcggctacagagtgtaccacagctacgacctgccctggttcagaaccctgagctggtacttcctgctgtgcgtgaactacttcttctacggcgagaccgtggccgactacttcgccaccttcgtgcagagagaggagcagctgcagttcctgatcagataccacagattcatcagcttcgccctgtacctggccggcttctgcatgttcgtgctgagcctggtgaagaagcactacagactgcagttctacatgttcgcctggacccacgtgaccctgctgatcaccgtgacccagagccacctggtgatccagaacctgttcgagggcatgatctggttcctggtgcccatcagcagcgtgatctgcaacgacatcaccgcctacctgttcggcttcttcttcggcagaacccccctgatcaagctgagccccaagaagacctgggagggcttcatcggcggcttcttcagcaccgtggtgttcggcttcatcgccgcctacgtgctgagcaagtaccagtacttcgtgtgccccgtggagtacagaagcgacgtgaacagcttcgtgaccgagtgcgagcccagcgagctgttccagctgcagacctacagcctgccccccttcctgaaggccgtgctgagacaggagagagtgagcctgtaccccttccagatccacagcatcgccctgagcaccttcgccagcctgatcggccccttcggcggcttcttcgccagcggcttcaagagagccttcaagatcaaggacttcgccaacaccatccccggccacggcggcatcatggacagattcgactgccagtacctgatggccaccttcgtgcacgtgtacatcaccagcttcatcagaggccccaaccccagcaaggtgctgcagcagctgctggtgctgcagcccgagcagcagctgaacatctacaagaccctgaagacccacctgatcgagaagggcatcctgcagcccaccctgaaggtgtag

SEQ ID NO: 76151 - DNA, 978 bp, Artificial Sequence
  Description of Artificial Sequence: Synthetic coding sequence
atgagcagactgagacaccccagaaccagatacttcctgctgtgcgtgaactacttcttctacggcgagaccgtgaccgactacttcttcaccctggtgcagagagaggagcccctgagaatcctgagcaagtaccacagattcatcagcttcaccctgtacctgatcggcttctgcatgttcgtgctgagcctggtgaagaagcactacagactgcagttctacatgttcggctggacccacgtgaccctgctgatcgtggtgacccagagccacctggtgatccacaacctgttcgagggcatgatctggttcatcgtgcccatcagctgcgtgatctgcaacgacatcatggcctacatgttcggcttcttcttcggcagaacccccctgatcaagctgagccccaagaagacctgggagggcttcatcggcggcttcttcgccaccgtggtgttcggcctgctgctgagctacgtgatgagcggctacagatgcttcgtgtgccccgtggagtacaacaacgacaccaacagcttcaccgtggactgcgagcccagcgacctgttcagactgcaggagtacaacatccccggcgtgatccagagcgtgatcggctggaagaccgtgagaatgtaccccttccagatccacagcatcgccctgagcaccttcgccagcctgatcggccccttcggcggcttcttcgccagcggcttcaagagagccttcaagatcaaggacttcgccaacaccatccccggccacggcggcatcatggacagattcgactgccagtacctgatggccaccttcgtgaacgtgtacatcgccagcttcatcagaggccccaaccccagcaagctgatccagcagttcctgaccctgagacccgaccagcagctgcacatcttcaacaccctgagaagccacctgatcgacaagggcatgctgaccagcaccaccgaggacgagtag

SEQ ID NO: 76152 - DNA, 753 bp, Artificial Sequence
  Description of Artificial Sequence: Synthetic coding sequence
atgagcagactgagacaccccagaaccagatggaagaactggtgggtgagaggcatcctgaccctggccatgatcgccttcttcttcatcatcatctacctgggccccatggtgctgatgatcatcgtgatgtgcgtgcagatcaagtgcttccacgagatcatcaccatcggctacaacgtgtaccacagctacgacctgccctggttcagaaccctgagctggtacttcctgctgtgcgtgaactacttcttctacggcgagaccgtgaccgactacttcttcaccctggtgcagagagaggagcccctgagaatcctgagcaagtaccacagattcatcagcttcaccctgtacctgatcggcttctgcatgttcgtgctgagcctggtgaagaagcactacagactgcagttctacatgttcggctggacccacgtgaccctgctgatcgtggtgacccagagccacctggtgatccacaacctgttcgagggcatgatctggttcatcgtgcccatcagctgcgtgatctgcaacgacatcatggcctacatgttcggcttcttcttcggcagaacccccctgatcaagctgagccccaagaagacctgggagggcttcatcggcggcttcttcgccaccgtggtgttcggcctgctgctgagctacgtgatgagcggctacagatgcttcgtgtgccccgtggagtacaacaacgacaccaacagcttcaccgtggactgcgagtag

SEQ ID NO: 76153 - DNA, 1338 bp, Artificial Sequence
  Description of Artificial Sequence: Synthetic coding sequence
atgaccgagctgagacagagagtggcccacgagcccgtggccccccccgaggacaaggagagcgagagcgaggccaaggtggacggcgagaccgccagcgacagcgagagcagagccgagagcgcccccctgcccgtgagcgccgacgacacccccgaggtgctgaacagagccctgagcaacctgagcagcagatggaagaactggtgggtgagaggcatcctgaccctggccatgatcgccttcttcttcatcatcatctacctgggccccatggtgctgatgatcatcgtgatgtgcgtgcagatcaagtgcttccacgagatcatcaccatcggctacaacgtgtaccacagctacgacctgccctggttcagaaccctgagctggtacttcctgctgtgcgtgaactacttcttctacggcgagaccgtgaccgactacttcttcaccctggtgcagagagaggagcccctgagaatcctgagcaagtaccacagattcatcagcttcaccctgtacctgatcggcttctgcatgttcgtgctgagcctggtgaagaagcactacagactgcagttctacatgttcggctggacccacgtgaccctgctgatcgtggtgacccagagccacctggtgatccacaacctgttcgagggcatgatctggttcatcgtgcccatcagctgcgtgatctgcaacgacatcatggcctacatgttcggcttcttcttcggcagaacccccctgatcaagctgagccccaagaagacctgggagggcttcatcggcggcttcttcgccaccgtggtgttcggcctgctgctgagctacgtgatgagcggctacagatgcttcgtgtgccccgtggagtacaacaacgacaccaacagcttcaccgtggactgcgagcccagcgacctgttcagactgcaggagtacaacatccccggcgtgatccagagcgtgatcggctggaagaccgtgagaatgtaccccttccagatccacagcatcgccctgagcaccttcgccagcctgatcggccccttcggcggcttcttcgccagcggcttcaagagagccttcaagatcaaggacttcgccaacaccatccccggccacggcggcatcatggacagattcgactgccagtacctgatggccaccttcgtgaacgtgtacatcgccagcttcatcagaggccccaaccccagcaagctgatccagcagttcctgaccctgagacccgaccagcagctgcacatcttcaacaccctgagaagccacctgatcgacaagggcatgctgaccagcaccaccgaggacgagtag

SEQ ID NO: 76154 - DNA, 648 bp, Artificial Sequence
  Description of Artificial Sequence: Synthetic coding sequence
atgttcgtgctgagcctggtgaagaagcactacagactgcagttctacatgttcggctggacccacgtgaccctgctgatcgtggtgacccagagccacctggtgatccacaacctgttcgagggcatgatctggttcatcgtgcccatcagctgcgtgatctgcaacgacatcatggcctacatgttcggcttcttcttcggcagaacccccctgatcaagctgagccccaagaagacctgggagggcttcatcggcggcttcttcgccaccgtggtgttcggcctgctgaagaccgtgagaatgtaccccttccagatccacagcatcgccctgagcaccttcgccagcctgatcggccccttcggcggcttcttcgccagcggcttcaagagagccttcaagatcaaggacttcgccaacaccatccccggccacggcggcatcatggacagattcgactgccagtacctgatggccaccttcgtgaacgtgtacatcgccagcttcatcagaggccccaaccccagcaagctgatccagcagttcctgaccctgagacccgaccagcagctgcacatcttcaacaccctgagaagccacctgatcgacaagggcatgctgaccagcaccaccgaggacgagtag

SEQ ID NO: 76155 - DNA, 3675 bp, Artificial Sequence
  Description of Artificial Sequence: Synthetic coding sequence
atggagcccctgctgctgggcagaggcctgatcgtgtacctgatgttcctgctgctgaagttcagcaaggccatcgagatccccagcagcgtgcagcaggtgcccaccatcatcaagcagagcaaggtgcaggtggccttccccttcgacgagtacttccagatcgagtgcgaggccaagggcaaccccgagcccaccttcagctggaccaaggacggcaaccccttctacttcaccgaccacagaatcatccccagcaacaacagcggcaccttcagaatccccaacgagggccacatcagccacttccagggcaagtacagatgcttcgccagcaacaagctgggcatcgccatgagcgaggagatcgagttcatcgtgcccagcgtgcccaagttccccaaggagaagatcgaccccctggaggtggaggagggcgaccccatcgtgctgccctgcaacccccccaagggcctgccccccctgcacatctactggatgaacatcgagctggagcacatcgagcaggacgagagagtgtacatgagccagaagggcgacctgtacttcgccaacgtggaggagaaggacagcagaaacgactactgctgcttcgccgccttccccagactgagaaccatcgtgcagaagatgcccatgaagctgaccgtgaacagcctgaagcacgccaacgacagcagcagcagcaccgagatcggcagcaaggccaacagcatcaagcagagaaagcccaagctgctgctgccccccaccgagagcggcagcgagagcagcatcaccatcctgaagggcgagatcctgctgctggagtgcttcgccgagggcctgcccaccccccaggtggactggaacaagatcggcggcgacctgcccaagggcagagagaccaaggagaactacggcaagaccctgaagatcgagaacgtgagctaccaggacaagggcaactacagatgcaccgccagcaacttcctgggcaccgccacccacgacttccacgtgatcgtggaggagccccccagatggaccaagaagccccagagcgccgtgtacagcaccggcagcaacggcatcctgctgtgcgaggccgagggcgagccccagcccaccatcaagtggagagtgaacggcagccccgtggacaaccaccccttcgccggcgacgtggtgttccccagagagatcagcttcaccaacctgcagcccaaccacaccgccgtgtaccagtgcgaggccagcaacgtgcacggcaccatcctggccaacgccaacatcgacgtggtggacgtgagacccctgatccagaccaaggacggcgagaactacgccaccgtggtgggctacagcgccttcctgcactgcgagttcttcgccagccccgaggccgtggtgagctggcagaaggtggaggaggtgaagcccctggagggcagaagataccacatctacgagaacggcaccctgcagatcaacagaaccaccgaggaggacgccggcagctacagctgctgggtggagaacgccatcggcaagaccgccgtgaccgccaacctggacatcagaaacgccaccaagctgagagtgagccccaagaaccccagaatccccaagctgcacatgctggagctgcactgcgagagcaagtgcgacagccacctgaagcacagcctgaagctgagctggagcaaggacggcgaggccttcgagatcaacggcaccgaggacggcagaatcatcatcgacggcgccaacctgaccatcagcaacgtgaccctggaggaccagggcatctactgctgcagcgcccacaccgccctggacagcgccgccgacatcacccaggtgaccgtgctggacgtgcccgacccccccgagaacctgcacctgagcgagagacagaacagaagcgtgagactgacctgggaggccggcgccgaccacaacagcaacatcagcgagtacatcgtggagttcgagggcaacaaggaggagcccggcagatgggaggagctgaccagagtgcagggcaagaagaccaccgtgatcctgcccctggcccccttcgtgagataccagttcagagtgatcgccgtgaacgaggtgggcagaagccagcccagccagcccagcgaccaccacgagaccccccccgccgcccccgacagaaacccccagaacatcagagtgcaggccagccagcccaaggagatgatcatcaagtgggagcccctgaagagcatggagcagaacggccccggcctggagtacagagtgacctggaagccccagggcgcccccgtggagtgggaggaggagaccgtgaccaaccacaccctgagagtgatgacccccgccgtgtacgccccctacgacgtgaaggtgcaggccatcaaccagctgggcagcggccccgacccccagagcgtgaccctgtacagcggcgaggactaccccgacaccgcccccgtgatccacggcgtggacgtgatcaacagcaccctggtgaaggtgacctggagcaccgtgcccaaggacagagtgcacggcagactgaagggctaccagatcaactggtggaagaccaagagcctgctggacggcagaacccaccccaaggaggtgaacatcctgagattcagcggccagagaaacagcggcatggtgcccagcctggacgccttcagcgagttccacctgaccgtgctggcctacaacagcaagggcgccggccccgagagcgagccctacatcttccagacccccgagggcgtgcccgagcagcccaccttcctgaaggtgatcaaggtggacaaggacaccgccaccctgagctggggcctgcccaagaagctgaacggcaacctgaccggctacctgctgcagtaccagatcatcaacgacacctacgagatcggcgagctgaacgacatcaacatcaccacccccagcaagcccagctggcacctgagcaacctgaacgccaccaccaagtacaagttctacctgagagcctgcaccagccagggctgcggcaagcccatcaccgaggagagcagcaccctgggcgagggcagcaagggcatcggcaagatcagcggcgtgaacctgacccagaagacccaccccatcgaggtgttcgagcccggcgccgagcacatcgtgagactgatgaccaagaactggggcgacaacgacagcatcttccaggacgtgatcgagaccagaggcagagagtacgccggcctgtacgacgacatcagcacccagggctggttcatcggcctgatgtgcgccatcgccctgctgaccctgctgctgctgaccgtgtgcttcgtgaagagaaacagaggcggcaagtacagcgtgaaggagaaggaggacctgcaccccgaccccgagatccagagcgtgaaggacgagaccttcggcgagtacagcgacagcgacgagaagcccctgaagggcagcctgagaagcctgaacagagacatgcagcccaccgagagcgccgacagcctggtggagtacggcgagggcgaccacggcctgttcagcgaggacggcagcttcatcggcgcctacgccggcagcaaggagaagggcagcgtggagagcaacggcagcagcaccgccaccttccccctgagagcctag

SEQ ID NO: 76156 - DNA, 3627 bp, Artificial Sequence
  Description of Artificial Sequence: Synthetic coding sequence
atggagcccctgctgctgggcagaggcctgatcgtgtacctgatgttcctgctgctgaagttcagcaaggccatcgagatccccagcagcgtgcagcaggtgcccaccatcatcaagcagagcaaggtgcaggtggccttccccttcgacgagtacttccagatcgagtgcgaggccaagggcaaccccgagcccaccttcagctggaccaaggacggcaaccccttctacttcaccgaccacagaatcatccccagcaacaacagcggcaccttcagaatccccaacgagggccacatcagccacttccagggcaagtacagatgcttcgccagcaacaagctgggcatcgccatgagcgaggagatcgagttcatcgtgcccagcgtgcccaagttccccaaggagaagatcgaccccctggaggtggaggagggcgaccccatcgtgctgccctgcaacccccccaagggcctgccccccctgcacatctactggatgaacatcgagctggagcacatcgagcaggacgagagagtgtacatgagccagaagggcgacctgtacttcgccaacgtggaggagaaggacagcagaaacgactactgctgcttcgccgccttccccagactgagaaccatcgtgcagaagatgcccatgaagctgaccgtgaacagcagcaacagcatcaagcagagaaagcccaagctgctgctgccccccaccgagagcggcagcgagagcagcatcaccatcctgaagggcgagatcctgctgctggagtgcttcgccgagggcctgcccaccccccaggtggactggaacaagatcggcggcgacctgcccaagggcagagagaccaaggagaactacggcaagaccctgaagatcgagaacgtgagctaccaggacaagggcaactacagatgcaccgccagcaacttcctgggcaccgccacccacgacttccacgtgatcgtggaggagccccccagatggaccaagaagccccagagcgccgtgtacagcaccggcagcaacggcatcctgctgtgcgaggccgagggcgagccccagcccaccatcaagtggagagtgaacggcagccccgtggacaaccaccccttcgccggcgacgtggtgttccccagagagatcagcttcaccaacctgcagcccaaccacaccgccgtgtaccagtgcgaggccagcaacgtgcacggcaccatcctggccaacgccaacatcgacgtggtggacgtgagacccctgatccagaccaaggacggcgagaactacgccaccgtggtgggctacagcgccttcctgcactgcgagttcttcgccagccccgaggccgtggtgagctggcagaaggtggaggaggtgaagcccctggagggcagaagataccacatctacgagaacggcaccctgcagatcaacagaaccaccgaggaggacgccggcagctacagctgctgggtggagaacgccatcggcaagaccgccgtgaccgccaacctggacatcagaaacgccaccaagctgagagtgagccccaagaaccccagaatccccaagctgcacatgctggagctgcactgcgagagcaagtgcgacagccacctgaagcacagcctgaagctgagctggagcaaggacggcgaggccttcgagatcaacggcaccgaggacggcagaatcatcatcgacggcgccaacctgaccatcagcaacgtgaccctggaggaccagggcatctactgctgcagcgcccacaccgccctggacagcgccgccgacatcacccaggtgaccgtgctggacgtgcccgacccccccgagaacctgcacctgagcgagagacagaacagaagcgtgagactgacctgggaggccggcgccgaccacaacagcaacatcagcgagtacatcgtggagttcgagggcaacaaggaggagcccggcagatgggaggagctgaccagagtgcagggcaagaagaccaccgtgatcctgcccctggcccccttcgtgagataccagttcagagtgatcgccgtgaacgaggtgggcagaagccagcccagccagcccagcgaccaccacgagaccccccccgccgcccccgacagaaacccccagaacatcagagtgcaggccagccagcccaaggagatgatcatcaagtgggagcccctgaagagcatggagcagaacggccccggcctggagtacagagtgacctggaagccccagggcgcccccgtggagtgggaggaggagaccgtgaccaaccacaccctgagagtgatgacccccgccgtgtacgccccctacgacgtgaaggtgcaggccatcaaccagctgggcagcggccccgacccccagagcgtgaccctgtacagcggcgaggactaccccgacaccgcccccgtgatccacggcgtggacgtgatcaacagcaccctggtgaaggtgacctggagcaccgtgcccaaggacagagtgcacggcagactgaagggctaccagatcaactggtggaagaccaagagcctgctggacggcagaacccaccccaaggaggtgaacatcctgagattcagcggccagagaaacagcggcatggtgcccagcctggacgccttcagcgagttccacctgaccgtgctggcctacaacagcaagggcgccggccccgagagcgagccctacatcttccagacccccgagggcgtgcccgagcagcccaccttcctgaaggtgatcaaggtggacaaggacaccgccaccctgagctggggcctgcccaagaagctgaacggcaacctgaccggctacctgctgcagtaccagatcatcaacgacacctacgagatcggcgagctgaacgacatcaacatcaccacccccagcaagcccagctggcacctgagcaacctgaacgccaccaccaagtacaagttctacctgagagcctgcaccagccagggctgcggcaagcccatcaccgaggagagcagcaccctgggcgagggcagcaagggcatcggcaagatcagcggcgtgaacctgacccagaagacccaccccatcgaggtgttcgagcccggcgccgagcacatcgtgagactgatgaccaagaactggggcgacaacgacagcatcttccaggacgtgatcgagaccagaggcagagagtacgccggcctgtacgacgacatcagcacccagggctggttcatcggcctgatgtgcgccatcgccctgctgaccctgctgctgctgaccgtgtgcttcgtgaagagaaacagaggcggcaagtacagcgtgaaggagaaggaggacctgcaccccgaccccgagatccagagcgtgaaggacgagaccttcggcgagtacagcgacagcgacgagaagcccctgaagggcagcctgagaagcctgaacagagacatgcagcccaccgagagcgccgacagcctggtggagtacggcgagggcgaccacggcctgttcagcgaggacggcagcttcatcggcgcctacgccggcagcaaggagaagggcagcgtggagagcaacggcagcagcaccgccaccttccccctgagagcctag

SEQ ID NO: 76157 - DNA, 291 bp, Artificial Sequence
  Description of Artificial Sequence: Synthetic coding sequence
atggagcccctgctgctgggcagaggcctgatcgtgtacctgatgttcctgctgctgaagttcagcaaggccatcgagatccccagcagcgtgcagcaggtgcccaccatcatcaagcagagcaaggtgcaggtggccttccccttcgacgagtacttccagatcgagtgcgaggccaagggcaaccccgagcccaccttcagctggaccaaggacggcaaccccttctacttcaccgaccacagaatcatccccagcaacaacagcggcaccttcagaatccccaactag

SEQ ID NO: 76158 - DNA, 201 bp, Artificial Sequence
  Description of Artificial Sequence: Synthetic coding sequence
atggagcccctgctgctgggcagaggcctgatcgtgtacctgatgttcctgctgctgaagttcagcaaggccatcgagatccccagcagcgtgcagcaggtgcccaccatcatcaagcagagcaaggtgcaggtggccttccccttcgacgagtacttccagatcgagtgcgaggccaagggcaaccccgagcccacctag

SEQ ID NO: 76159 - DNA, 546 bp, Artificial Sequence
  Description of Artificial Sequence: Synthetic coding sequence
atggagcccctgctgctgggcagaggcctgatcgtgtacctgatgttcctgctgctgaagttcagcaaggccatcgagatccccagcagcgtgcagcaggtgcccaccatcatcaagcagagcaaggtgcaggtggccttccccttcgacgagtacttccagatcgagtgcgaggccaagggcaaccccgagcccaccttcagctggaccaaggacggcaaccccttctacttcaccgaccacagaatcatccccagcaacaacagcggcaccttcagaatccccaacgagggccacatcagccacttccagggcaagtacagatgcttcgccagcaacaagctgggcatcgccatgagcgaggagatcgagttcatcgtgcccagcgtgcccaagttccccaaggagaagatcgaccccctggaggtggaggagggcgaccccatcgtgctgccctgcaacccccccaagggcctgccccccctgcacatctactggatgaacatcgagctggagcacatcgagcaggacgagagagtgtactag

SEQ ID NO: 76160 - DNA, 954 bp, Artificial Sequence
  Description of Artificial Sequence: Synthetic coding sequence
tgaagcgtgaccctgtacagcggcgaggactaccccgacaccgcccccgtgatccacggcgtggacgtgatcaacagcaccctggtgaaggtgacctggagcaccgtgcccaaggacagagtgcacggcagactgaagggctaccagatcaactggtggaagaccaagagcctgctggacggcagaacccaccccaaggaggtgaacatcctgagattcagcggccagagaaacagcggcatggtgcccagcctggacgccttcagcgagttccacctgaccgtgctggcctacaacagcaagggcgccggccccgagagcgagccctacatcttccagacccccgagggcgtgcccgagcagcccaccttcctgaaggtgatcaaggtggacaaggacaccgccaccctgagctggggcctgcccaagaagctgaacggcaacctgaccggctacctgctgcagtaccagatcatcaacgacacctacgagatcggcgagctgaacgacatcaacatcaccacccccagcaagcccagctggcacctgagcaacctgaacgccaccaccaagtacaagttctacctgagagcctgcaccagccagggctgcggcaagcccatcaccgaggagagcagcaccctgggcgagggcaagtacgccggcctgtacgacgacatcagcacccagggctggttcatcggcctgatgtgcgccatcgccctgctgaccctgctgctgctgaccgtgtgcttcgtgaagagaaacagaggcggcaagtacagcgtgaaggagaaggaggacctgcaccccgaccccgagatccagagcgtgaaggacgagaccttcggcgagtacagcgacagcgacgagaagcccctgaagggcagcctgagaagcctgaacagagacatgcagcccaccgagagcgccgacagcctggtggagtactag

SEQ ID NO: 76161 - DNA, 258 bp, Artificial Sequence
  Description of Artificial Sequence: Synthetic coding sequence
atggagcccctgctgctgggcagaggcctgatcgtgtacctgatgttcctgctgctgaagttcagcaaggccatcgagatccccagcagcgtgcagcaggtgcccaccatcatcaagcagagcaaggtgcaggtggccttccccttcgacgagtacttccagatcgagtgcgaggccaagggcaaccccgagcccaccttcagctggaccaaggacggcaaccccttctacttcaccgaccacagaatcatcccctag

SEQ ID NO: 76162 - DNA, 450 bp, Artificial Sequence
  Description of Artificial Sequence: Synthetic coding sequence
atggagagcagaggcaagagcgccagcagccccaagcccgacaccaaggtgccccaggtgaccaccgaggccaaggtgccccccgccgccgacggcaaggcccccctgaccaagcccagcaagaaggaggcccccgccgagaagcagcagccccccgccgcccccaccaccgcccccgccaagaagaccagcgccaaggccgaccccgccctgctgaacaaccacagcaacctgaagcccgcccccaccgtgcccagcagccccgacgccacccccgagcccaagggccccggcgacggcgccgaggaggacgaggccgccagcggcggccccggcggcagaggcccctggagctgcgagaacttcaaccccctgctggtggccggcggcgtggccgtggccgccatcgccctgatcctgggcgtggccttcctggtgagaaagaagtag

SEQ ID NO: 76163 - DNA, 627 bp, Artificial Sequence
  Description of Artificial Sequence: Synthetic coding sequence
atgagcagcgagcccccccccccctaccccggcggccccaccgcccccctgctggaggagaagagcggcgccccccccacccccggcagaagcagccccgccgtgatgcagcccccccccggcatgcccctgccccccgccgacatcggcccccccccctacgagccccccggccaccccatgccccagcccggcttcatccccccccacatgagcgccgacggcacctacatgccccccggcttctaccccccccccggcccccacccccccatgggctactacccccccggcccctacacccccggcccctaccccggccccggcggccacaccgccaccgtgctggtgcccagcggcgccgccaccaccgtgaccgtgctgcagggcgagatcttcgagggcgcccccgtgcagaccgtgtgcccccactgccagcaggccatcaccaccaagatcagctacgagatcggcctgatgaacttcgtgctgggcttcttctgctgcttcatgggctgcgacctgggctgctgcctgatcccctgcctgatcaacgacttcaaggacgtgacccacacctgccccagctgcaaggcctacatctacacctacaagagactgtgctag

SEQ ID NO: 76164 - DNA, 456 bp, Artificial Sequence
  Description of Artificial Sequence: Synthetic coding sequence
atggccgccagcaccagcatggtgcccgtggccgtgaccgccgccgtggcccccgtgctgagcatcaacagcgacttcagcgacctgagagagatcaagaagcagctgctgctgatcgccggcctgaccagagagagaggcctgctgcacagcagcaagtggagcgccgagctggccttcagcctgcccgccctgcccctggccgagctgcagccccccccccccatcaccgaggaggacgcccaggacatggacgcctacaccctggccaaggcctacttcgacgtgaaggagtacgacagagccgcccacttcctgcacggctgcaacagcaagaaggcctacttcctgtacatgtacagcagatacctggtgagagccatcctgaagtgccacagcgccttcagcgagaccagcatcttcagaaccaacggcaaggtgaagagcttcaagtag

SEQ ID NO: 76165 - DNA, 1794 bp, Artificial Sequence
  Description of Artificial Sequence: Synthetic coding sequence
atggccgccagcaccagcatggtgcccgtggccgtgaccgccgccgtggcccccgtgctgagcatcaacagcgacttcagcgacctgagagagatcaagaagcagctgctgctgatcgccggcctgaccagagagagaggcctgctgcacagcagcaagtggagcgccgagctggccttcagcctgcccgccctgcccctggccgagctgcagccccccccccccatcaccgaggaggacgcccaggacatggacgcctacaccctggccaaggcctacttcgacgtgaaggagtacgacagagccgcccacttcctgcacggctgcaacagcaagaaggcctacttcctgtacatgtacagcagatacctgagcggcgagaagaagaaggacgacgagaccgtggacagcctgggccccctggagaagggccaggtgaagaacgaggccctgagagagctgagagtggagctgagcaagaagcaccaggccagagagctggacggcttcggcctgtacctgtacggcgtggtgctgagaaagctggacctggtgaaggaggccatcgacgtgttcgtggaggccacccacgtgctgcccctgcactggggcgcctggctggagctgtgcaacctgatcaccgacaaggagatgctgaagttcctgagcctgcccgacacctggatgaaggagttcttcctggcccacatctacaccgagctgcagctgatcgaggaggccctgcagaagtaccagaacctgatcgacgtgggcttcagcaagagcagctacatcgtgagccagatcgccgtggcctaccacaacatcagagacatcgacaaggccctgagcatcttcaacgagctgagaaagcaggacccctacagaatcgagaacatggacaccttcagcaacctgctgtacgtgagaagcatgaagagcgagctgagctacctggcccacaacctgtgcgagatcgacaagtacagagtggagacctgctgcgtgatcggcaactactacagcctgagaagccagcacgagaaggccgccctgtacttccagagagccctgaagctgaaccccagatacctgggcgcctggaccctgatgggccacgagtacatggagatgaagaacaccagcgccgccatccaggcctacagacacgccatcgaggtgaacaagagagactacagagcctggtacggcctgggccagacctacgagatcctgaagatgcccttctactgcctgtactactacagaagagcccaccagctgagacccaacgacagcagaatgctggtggccctgggcgagtgctacgagaagctgaaccagctggtggaggccaagaagtgctactggagagcctacgccgtgggcgacgtggagaagatggccctggtgaagctggccaagctgcacgagcagctgaccgagagcgagcaggccgcccagtgctacatcaagtacatccaggacatctacagctgcggcgagatcgtggagcacctggaggagagcaccgccttcagatacctggcccagtactacttcaagtgcaagctgtgggacgaggccagcacctgcgcccagaagtgctgcgccttcaacgacaccagagaggagggcaaggccctgctgagacagatcctgcagctgagaaaccagggcgagacccccaccaccgaggtgcccgcccccttcttcctgcccgccagcctgagcgccaacaacacccccaccagaagagtgagccccctgaacctgagcagcgtgaccccctag

SEQ ID NO: 76166 - DNA, 1575 bp, Artificial Sequence
  Description of Artificial Sequence: Synthetic coding sequence
atggagctgggccccgagcccccccacagaagaagactgctgttcgcctgcagccccccccccgccagccagcccgtggtgaaggccctgttcggcgccagcgccgccggcggcctgagccccgtgaccaacctgaccgtgaccatggaccagctgcagggcctgggcagcgactacgagcagcccctggaggtgaagaacaacagcaacctgcagagaatgggcagcagcgagagcaccgacagcggcttctgcctggacagccccggccccctggacagcaaggagaacctggagaaccccatgagaagaatccacagcctgccccagaagctgctgggctgcagccccgccctgaagagaagccacagcgacagcctggaccacgacatcttccagctgatcgaccccgacgagaacaaggagaacgaggccttcgagttcaagaagcccgtgagacccgtgagcagaggctgcctgcacagccacggcctgcaggagggcaaggacctgttcacccagagacagaacagcgcccccgccagaatgctgagcagcaacgagagagacagcagcgagcccggcaacttcatccccctgttcaccccccagagccccgtgaccgccaccctgagcgacgaggacgacggcttcgtggacctgctggacggcgagaacctgaagaacgaggaggagacccccagctgcatggccagcctgtggaccgcccccctggtgatgagaaccaccaacctggacaacagatgcaagctgttcgacagccccagcctgtgcagcagcagcaccagaagcgtgctgaagagacccgagagaagccaggaggagagcccccccggcagcaccaagagaagaaagagcatgagcggcgccagccccaaggagagcaccaaccccgagaaggcccacgagaccctgcaccagagcctgagcctggccagcagccccaagggcaccatcgagaacatcctggacaacgaccccagagacctgatcggcgacttcagcaagggctacctgttccacaccgtggccggcaagcaccaggacctgaagtacatcagccccgagatcatggccagcgtgctgaacggcaagttcgccaacctgatcaaggagttcgtgatcatcgactgcagatacccctacgagtacgagggcggccacatcaagggcgccgtgaacctgcacatggaggaggaggtggaggacttcctgctgaagaagcccatcgtgcccaccgacggcaagagagtgatcgtggtgttccactgcgagttcagcagcgagagaggccccagaatgtgcagatacgtgagagagagagacagactgggcaacgagtaccccaagctgcactaccccgagctgtacgtgctgaagggcggctacaaggagttcttcatgaagtgccagagctactgcgagccccccagctacagacccatgcaccacgaggacttcaaggaggacctgaagaagttcagaaccaagagcagaacctgggccggcgagaagagcaagagagagatgtacagcagactgaagaagctgtag

SEQ ID NO: 76167 - DNA, 1455 bp, Artificial Sequence
  Description of Artificial Sequence: Synthetic coding sequence
atggagctgggccccgagcccccccacagaagaagactgctgttcgcctgcagccccccccccgccagccagcccgtggtgaaggccctgttcggcgccagcgccgccggcggcctgagccccgtgaccaacctgaccgtgaccatggaccagctgcagggcctgggcagcgactacgagcagcccctggaggtgaagaacaacagcaacctgcagagaatgggcagcagcgagagcaccgacagcggcttctgcctggacagccccggccccctggacagcaaggagaacctggagaaccccatgagaagaatccacagcctgccccagaagctgctgggctgcagccccgccctgaagagaagccacagcgacagcctggaccacgacatcttccagctgatcgaccccgacgagaacaaggagaacctgagcagcaacgagagagacagcagcgagcccggcaacttcatccccctgttcaccccccagagccccgtgaccgccaccctgagcgacgaggacgacggcttcgtggacctgctggacggcgagaacctgaagaacgaggaggagacccccagctgcatggccagcctgtggaccgcccccctggtgatgagaaccaccaacctggacaacagatgcaagctgttcgacagccccagcctgtgcagcagcagcaccagaagcgtgctgaagagacccgagagaagccaggaggagagcccccccggcagcaccaagagaagaaagagcatgagcggcgccagccccaaggagagcaccaaccccgagaaggcccacgagaccctgcaccagagcctgagcctggccagcagccccaagggcaccatcgagaacatcctggacaacgaccccagagacctgatcggcgacttcagcaagggctacctgttccacaccgtggccggcaagcaccaggacctgaagtacatcagccccgagatcatggccagcgtgctgaacggcaagttcgccaacctgatcaaggagttcgtgatcatcgactgcagatacccctacgagtacgagggcggccacatcaagggcgccgtgaacctgcacatggaggaggaggtggaggacttcctgctgaagaagcccatcgtgcccaccgacggcaagagagtgatcgtggtgttccactgcgagttcagcagcgagagaggccccagaatgtgcagatacgtgagagagagagacagactgggcaacgagtaccccaagctgcactaccccgagctgtacgtgctgaagggcggctacaaggagttcttcatgaagtgccagagctactgcgagccccccagctacagacccatgcaccacgaggacttcaaggaggacctgaagaagttcagaaccaagagcagaacctgggccggcgagaagagcaagagagagatgtacagcagactgaagaagctgtag

SEQ ID NO: 76168 - DNA, 432 bp, Artificial Sequence
  Description of Artificial Sequence: Synthetic coding sequence
atggagctgggccccgagcccccccacagaagaagactgctgttcgcctgcagccccccccccgccagccagcccgtggtgaaggccctgttcggcgccagcgccgccggcggcctgagccccgtgaccaacctgaccgtgaccatggaccagctgcagggcctgggcagcgactacgagcagcccctggaggtgaagaacaacagcaacctgcagagaatgggcagcagcgagagcaccgacagcggcttctgcctggacagccccggccccctggacagcaaggagaacctggagaaccccatgagaagaatccacagcctgccccagaagctgctgggctgcagccccgccctgaagagaagccacagcgacagcctggaccacgacatcttccagctgatcgaccccgacgagaacaaggagaactag

SEQ ID NO: 76169 - DNA, 1743 bp, Artificial Sequence
  Description of Artificial Sequence: Synthetic coding sequence
atggaggtgccccagcccgagcccgcccccggcagcgccctgagccccgccggcgtgtgcggcggcgcccagagacccggccacctgcccggcctgctgctgggcagccacggcctgctgggcagccccgtgagagccgccgccagcagccccgtgaccaccctgacccagaccatgcacgacctggccggcctgggcagcgagacccccaagagccaggtgggcaccctgctgttcagaagcagaagcagactgacccacctgagcctgagcagaagagccagcgagagcagcctgagcagcgagagcagcgagagcagcgacgccggcctgtgcatggacagccccagccccatggacccccacatggccgagcagaccttcgagcaggccatccaggccgccagcagaatcatcagaaacgagcagttcgccatcagaagattccagagcatgcccgtgagactgctgggccacagccccgtgctgagaaacatcaccaacagccaggcccccgacggcagaagaaagagcgaggccggcagcggcgccgccagcagcagcggcgaggacaaggagaacgacggcttcgtgttcaagatgccctggaagcccacccaccccagcagcacccacgccctggccgagtgggccagcagaagagaggccttcgcccagagacccagcagcgcccccgacctgatgtgcctgagccccgacagaaagatggaggtggaggagctgagccccctggccctgggcagattcagcctgacccccgccgagggcgacaccgaggaggacgacggcttcgtggacatcctggagagcgacctgaaggacgacgacgccgtgccccccggcatggagagcctgatcagcgcccccctggtgaagaccctggagaaggaggaggagaaggacctggtgatgtacagcaagtgccagagactgttcagaagccccagcatgccctgcagcgtgatcagacccatcctgaagagactggagagaccccaggacagagacacccccgtgcagaacaagagaagaagaagcgtgaccccccccgaggagcagcaggaggccgaggagcccaaggccagagtgctgagaagcaagagcctgtgccacgacgagatcgagaacctgctggacagcgaccacagagagctgatcggcgactacagcaaggccttcctgctgcagaccgtggacggcaagcaccaggacctgaagtacatcagccccgagaccatggtggccctgctgaccggcaagttcagcaacatcgtggacaagttcgtgatcgtggactgcagatacccctacgagtacgagggcggccacatcaagaccgccgtgaacctgcccctggagagagacgccgagagcttcctgctgaagagccccatcgccccctgcagcctggacaagagagtgatcctgatcttccactgcgagttcagcagcgagagaggccccagaatgtgcagattcatcagagagagagacagagccgtgaacgactaccccagcctgtactaccccgagatgtacatcctgaagggcggctacaaggagttcttcccccagcaccccaacttctgcgagccccaggactacagacccatgaaccacgaggccttcaaggacgagctgaagaccttcagactgaagaccagaagctgggccggcgagagaagcagaagagagctgtgcagcagactgcaggaccagtag

SEQ ID NO: 76170 - DNA, 1620 bp, Artificial Sequence
  Description of Artificial Sequence: Synthetic coding sequence
atggaggtgccccagcccgagcccgcccccggcagcgccctgagccccgccggcgtgtgcggcggcgcccagagacccggccacctgcccggcctgctgctgggcagccacggcctgctgggcagccccgtgagagccgccgccagcagccccgtgaccaccctgacccagaccatgcacgacctggccggcctgggcagcgagacccccaagagccaggtgggcaccctgctgttcagaagcagaagcagactgacccacctgagcctgagcagaagagccagcgagagcagcctgagcagcgagagcagcgagagcagcgacgccggcctgtgcatggacagccccagccccatggacccccacatggccgagcagaccttcgagcaggccatccaggccgccagcagaatcatcagaaacgagcagttcgccatcagaagattccagagcatgcccgacggcttcgtgttcaagatgccctggaagcccacccaccccagcagcacccacgccctggccgagtgggccagcagaagagaggccttcgcccagagacccagcagcgcccccgacctgatgtgcctgagccccgacagaaagatggaggtggaggagctgagccccctggccctgggcagattcagcctgacccccgccgagggcgacaccgaggaggacgacggcttcgtggacatcctggagagcgacctgaaggacgacgacgccgtgccccccggcatggagagcctgatcagcgcccccctggtgaagaccctggagaaggaggaggagaaggacctggtgatgtacagcaagtgccagagactgttcagaagccccagcatgccctgcagcgtgatcagacccatcctgaagagactggagagaccccaggacagagacacccccgtgcagaacaagagaagaagaagcgtgaccccccccgaggagcagcaggaggccgaggagcccaaggccagagtgctgagaagcaagagcctgtgccacgacgagatcgagaacctgctggacagcgaccacagagagctgatcggcgactacagcaaggccttcctgctgcagaccgtggacggcaagcaccaggacctgaagtacatcagccccgagaccatggtggccctgctgaccggcaagttcagcaacatcgtggacaagttcgtgatcgtggactgcagatacccctacgagtacgagggcggccacatcaagaccgccgtgaacctgcccctggagagagacgccgagagcttcctgctgaagagccccatcgccccctgcagcctggacaagagagtgatcctgatcttccactgcgagttcagcagcgagagaggccccagaatgtgcagattcatcagagagagagacagagccgtgaacgactaccccagcctgtactaccccgagatgtacatcctgaagggcggctacaaggagttcttcccccagcaccccaacttctgcgagccccaggactacagacccatgaaccacgaggccttcaaggacgagctgaagaccttcagactgaagaccagaagctgggccggcgagagaagcagaagagagctgtgcagcagactgcaggaccagtag

SEQ ID NO: 76171 - DNA, 1551 bp, Artificial Sequence
  Description of Artificial Sequence: Synthetic coding sequence
atgcacagcgagacccccaagagccaggtgggcaccctgctgttcagaagcagaagcagactgacccacctgagcctgagcagaagagccagcgagagcagcctgagcagcgagagcagcgagagcagcgacgccggcctgtgcatggacagccccagccccatggacccccacatggccgagcagaccttcgagcaggccatccaggccgccagcagaatcatcagaaacgagcagttcgccatcagaagattccagagcatgcccgtgagactgctgggccacagccccgtgctgagaaacatcaccaacagccaggcccccgacggcagaagaaagagcgaggccggcagcggcgccgccagcagcagcggcgaggacaaggagaacgacggcttcgtgttcaagatgccctggaagcccacccaccccagcagcacccacgccctggccgagtgggccagcagaagagaggccttcgcccagagacccagcagcgcccccgacctgatgtgcctgagccccgacagaaagatggaggtggaggagctgagccccctggccctgggcagattcagcctgacccccgccgagggcgacaccgaggaggacgacggcttcgtggacatcctggagagcgacctgaaggacgacgacgccgtgccccccggcatggagagcctgatcagcgcccccctggtgaagaccctggagaaggaggaggagaaggacctggtgatgtacagcaagtgccagagactgttcagaagccccagcatgccctgcagcgtgatcagacccatcctgaagagactggagagaccccaggacagagacacccccgtgcagaacaagagaagaagaagcgtgaccccccccgaggagcagcaggaggccgaggagcccaaggccagagtgctgagaagcaagagcctgtgccacgacgagatcgagaacctgctggacagcgaccacagagagctgatcggcgactacagcaaggccttcctgctgcagaccgtggacggcaagcaccaggacctgaagtacatcagccccgagaccatggtggccctgctgaccggcaagttcagcaacatcgtggacaagttcgtgatcgtggactgcagatacccctacgagtacgagggcggccacatcaagaccgccgtgaacctgcccctggagagagacgccgagagcttcctgctgaagagccccatcgccccctgcagcctggacaagagagtgatcctgatcttccactgcgagttcagcagcgagagaggccccagaatgtgcagattcatcagagagagagacagagccgtgaacgactaccccagcctgtactaccccgagatgtacatcctgaagggcggctacaaggagttcttcccccagcaccccaacttctgcgagccccaggactacagacccatgaaccacgaggccttcaaggacgagctgaagaccttcagactgaagaccagaagctgggccggcgagagaagcagaagagagctgtgcagcagactgcaggaccagtag

SEQ ID NO: 76172 - DNA, 1470 bp, Artificial Sequence
  Description of Artificial Sequence: Synthetic coding sequence
atgcacagcgagacccccaagagccaggtgggcaccctgctgttcagaagcagaagcagactgacccacctgagcctgagcagaagagccagcgagagcagcctgagcagcgagagcagcgagagcagcgacgccggcctgtgcatggacagccccagccccatggacccccacatggccgagcagaccttcgagcaggccatccaggccgccagcagaatcatcagaaacgagcagttcgccatcagaagattccagagcatgcccgtgagactgctgggccacagccccgtgctgagaaacatcaccaacagccaggcccccgacggcagaagaaagagcgaggccggcagcggcgccgccagcagcagcggcgaggacaaggagaacgacggcttcgtgttcaagatgccctggaagcccacccaccccagcagcacccacgccctggccgagtgggccagcagaagagaggccttcgcccagagacccagcagcgcccccgacctgatgtgcctgagccccgacagaaagatggaggtggaggagctgagccccctggccctgggcagattcagcctgacccccgccgagggcgacaccgaggaggacgacggcttcgtggacatcctggagagcgacctgaaggacctggtgatgtacagcaagtgccagagactgttcagaagccccagcatgccctgcagcgtgatcagacccatcctgaagagactggagagaccccaggacagagacacccccgtgcagaacaagagaagaagaagcgtgaccccccccgaggagcagcaggaggccgaggagcccaaggccagagtgctgagaagcaagagcctgtgccacgacgagatcgagaacctgctggacagcgaccacagagagctgatcggcgactacagcaaggccttcctgctgcagaccgtggacggcaagcaccaggacctgaagtacatcagccccgagaccatggtggccctgctgaccggcaagttcagcaacatcgtggacaagttcgtgatcgtggactgcagatacccctacgagtacgagggcggccacatcaagaccgccgtgaacctgcccctggagagagacgccgagagcttcctgctgaagagccccatcgccccctgcagcctggacaagagagtgatcctgatcttccactgcgagttcagcagcgagagaggccccagaatgtgcagattcatcagagagagagacagagccgtgaacgactaccccagcctgtactaccccgagatgtacatcctgaagggcggctacaaggagttcttcccccagcaccccaacttctgcgagccccaggactacagacccatgaaccacgaggccttcaaggacgagctgaagaccttcagactgaagaccagaagctgggccggcgagagaagcagaagagagctgtgcagcagactgcaggaccagtag

SEQ ID NO: 76173 - DNA, 1701 bp, Artificial Sequence
  Description of Artificial Sequence: Synthetic coding sequence
atggaggtgccccagcccgagcccgcccccggcagcgccctgagccccgccggcgtgtgcggcggcgcccagagacccggccacctgcccggcctgctgctgggcagccacggcctgctgggcagccccgtgagagccgccgccagcagccccgtgaccaccctgacccagaccatgcacgacctggccggcctgggcagcagaagcagactgacccacctgagcctgagcagaagagccagcgagagcagcctgagcagcgagagcagcgagagcagcgacgccggcctgtgcatggacagccccagccccatggacccccacatggccgagcagaccttcgagcaggccatccaggccgccagcagaatcatcagaaacgagcagttcgccatcagaagattccagagcatgcccgtgagactgctgggccacagccccgtgctgagaaacatcaccaacagccaggcccccgacggcagaagaaagagcgaggccggcagcggcgccgccagcagcagcggcgaggacaaggagaacgacggcttcgtgttcaagatgccctggaagcccacccaccccagcagcacccacgccctggccgagtgggccagcagaagagaggccttcgcccagagacccagcagcgcccccgacctgatgtgcctgagccccgacagaaagatggaggtggaggagctgagccccctggccctgggcagattcagcctgacccccgccgagggcgacaccgaggaggacgacggcttcgtggacatcctggagagcgacctgaaggacgacgacgccgtgccccccggcatggagagcctgatcagcgcccccctggtgaagaccctggagaaggaggaggagaaggacctggtgatgtacagcaagtgccagagactgttcagaagccccagcatgccctgcagcgtgatcagacccatcctgaagagactggagagaccccaggacagagacacccccgtgcagaacaagagaagaagaagcgtgaccccccccgaggagcagcaggaggccgaggagcccaaggccagagtgctgagaagcaagagcctgtgccacgacgagatcgagaacctgctggacagcgaccacagagagctgatcggcgactacagcaaggccttcctgctgcagaccgtggacggcaagcaccaggacctgaagtacatcagccccgagaccatggtggccctgctgaccggcaagttcagcaacatcgtggacaagttcgtgatcgtggactgcagatacccctacgagtacgagggcggccacatcaagaccgccgtgaacctgcccctggagagagacgccgagagcttcctgctgaagagccccatcgccccctgcagcctggacaagagagtgatcctgatcttccactgcgagttcagcagcgagagaggccccagaatgtgcagattcatcagagagagagacagagccgtgaacgactaccccagcctgtactaccccgagatgtacatcctgaagggcggctacaaggagttcttcccccagcaccccaacttctgcgagccccaggactacagacccatgaaccacgaggccttcaaggacgagctgaagaccttcagactgaagaccagaagctgggccggcgagagaagcagaagagagctgtgcagcagactgcaggaccagtag

SEQ ID NO: 76174 - DNA, 2475 bp, Artificial Sequence
  Description of Artificial Sequence: Synthetic coding sequence
atgaccgtgctgcaggagcccgtgcaggccgccatctggcaggccctgaaccactacgcctacagagacgccgtgttcctggccgagagactgtacgccgaggtgcacagcgaggaggccctgttcctgctggccacctgctactacagaagcggcaaggcctacaaggcctacagactgctgaagggccacagctgcaccaccccccagtgcaagtacctgctggccaagtgctgcgtggacctgagcaagctggccgagggcgagcagatcctgagcggcggcgtgttcaacaagcagaagagccacgacgacatcgtgaccgagttcggcgacagcgcctgcttcaccctgagcctgctgggccacgtgtactgcaagaccgacagactggccaagggcagcgagtgctaccagaagagcctgagcctgaaccccttcctgtggagccccttcgagagcctgtgcgagatcggcgagaagcccgaccccgaccagaccttcaagttcaccagcctgcagaacttcagcaactgcctgcccaacagctgcaccacccaggtgcccaaccacagcctgagccacagacagcccgagaccgtgctgaccgagaccccccaggacaccatcgagctgaacagactgaacctggagagcagcaacagcaagtacagcctgaacaccgacagcagcgtgagctacatcgacagcgccgtgatcagccccgacaccgtgcccctgggcaccggcaccagcatcctgagcaagcaggtgcagaacaagcccaagaccggcagaagcctgctgggcggccccgccgccctgagccccctgacccccagcttcggcatcctgcccctggagacccccagccccggcgacggcagctacctgcagaactacaccaacaccccccccgtgatcgacgtgcccagcaccggcgcccccagcaagaagagcgtggccagaatcggccagaccggcaccaagagcgtgttcagccagagcggcaacagcagagaggtgacccccatcctggcccagacccagagcagcggcccccagaccagcaccaccccccaggtgctgagccccaccatcaccagcccccccaacgccctgcccagaagaagcagcagactgttcaccagcgacagcagcaccaccaaggagaacagcaagaagctgaagatgaagttcccccccaagatccccaacagaaagaccaagagcaagaccaacaagggcggcatcacccagcccaacatcaacgacagcctggagatcaccaagctggacagcagcatcatcagcgagggcaagatcagcaccatcaccccccagatccaggccttcaacctgcagaaggccgccgccgagggcctgatgagcctgctgagagagatgggcaagggctacctggccctgtgcagctacaactgcaaggaggccatcaacatcctgagccacctgcccagccaccactacaacaccggctgggtgctgtgccagatcggcagagcctacttcgagctgagcgagtacatgcaggccgagagaatcttcagcgaggtgagaagaatcgagaactacagagtggagggcatggagatctacagcaccaccctgtggcacctgcagaaggacgtggccctgagcgtgctgagcaaggacctgaccgacatggacaagaacagccccgaggcctggtgcgccgccggcaactgcttcagcctgcagagagagcacgacatcgccatcaagttcttccagagagccatccaggtggaccccaactacgcctacgcctacaccctgctgggccacgagttcgtgctgaccgaggagctggacaaggccctggcctgcttcagaaacgccatcagagtgaaccccagacactacaacgcctggtacggcctgggcatgatctactacaagcaggagaagttcagcctggccgagatgcacttccagaaggccctggacatcaacccccagagcagcgtgctgctgtgccacatcggcgtggtgcagcacgccctgaagaagagcgagaaggccctggacaccctgaacaaggccatcgtgatcgaccccaagaaccccctgtgcaagttccacagagccagcgtgctgttcgccaacgagaagtacaagagcgccctgcaggagctggaggagctgaagcagatcgtgcccaaggagagcctggtgtacttcctgatcggcaaggtgtacaagaagctgggccagacccacctggccctgatgaacttcagctgggccatggacctggaccccaagggcgccaacaaccagatcaaggaggccatcgacaagagatacctgcccgacgacgaggagcccatcacccaggaggagcagatcatgggcaccgacgagagccaggagagcagcatgaccgacgccgacgacacccagctgcacgccgccgagagcgacgagttctag

SEQ ID NO: 76175 - DNA, 2292 bp, Artificial Sequence
  Description of Artificial Sequence: Synthetic coding sequence
atggccagcaccaagcccctgtgcctgcccagatgcggcttccccagaagaacccccctgtgcagaagactggccgagggcgagcagatcctgagcggcggcgtgttcaacaagcagaagagccacgacgacatcgtgaccgagttcggcgacagcgcctgcttcaccctgagcctgctgggccacgtgtactgcaagaccgacagactggccaagggcagcgagtgctaccagaagagcctgagcctgaaccccttcctgtggagccccttcgagagcctgtgcgagatcggcgagaagcccgaccccgaccagaccttcaagttcaccagcctgcagaacttcagcaactgcctgcccaacagctgcaccacccaggtgcccaaccacagcctgagccacagacagcccgagaccgtgctgaccgagaccccccaggacaccatcgagctgaacagactgaacctggagagcagcaacagcaagtacagcctgaacaccgacagcagcgtgagctacatcgacagcgccgtgatcagccccgacaccgtgcccctgggcaccggcaccagcatcctgagcaagcaggtgcagaacaagcccaagaccggcagaagcctgctgggcggccccgccgccctgagccccctgacccccagcttcggcatcctgcccctggagacccccagccccggcgacggcagctacctgcagaactacaccaacaccccccccgtgatcgacgtgcccagcaccggcgcccccagcaagaagagcgtggccagaatcggccagaccggcaccaagagcgtgttcagccagagcggcaacagcagagaggtgacccccatcctggcccagacccagagcagcggcccccagaccagcaccaccccccaggtgctgagccccaccatcaccagcccccccaacgccctgcccagaagaagcagcagactgttcaccagcgacagcagcaccaccaaggagaacagcaagaagctgaagatgaagttcccccccaagatccccaacagaaagaccaagagcaagaccaacaagggcggcatcacccagcccaacatcaacgacagcctggagatcaccaagctggacagcagcatcatcagcgagggcaagatcagcaccatcaccccccagatccaggccttcaacctgcagaaggccgccgccgagggcctgatgagcctgctgagagagatgggcaagggctacctggccctgtgcagctacaactgcaaggaggccatcaacatcctgagccacctgcccagccaccactacaacaccggctgggtgctgtgccagatcggcagagcctacttcgagctgagcgagtacatgcaggccgagagaatcttcagcgaggtgagaagaatcgagaactacagagtggagggcatggagatctacagcaccaccctgtggcacctgcagaaggacgtggccctgagcgtgctgagcaaggacctgaccgacatggacaagaacagccccgaggcctggtgcgccgccggcaactgcttcagcctgcagagagagcacgacatcgccatcaagttcttccagagagccatccaggtggaccccaactacgcctacgcctacaccctgctgggccacgagttcgtgctgaccgaggagctggacaaggccctggcctgcttcagaaacgccatcagagtgaaccccagacactacaacgcctggtacggcctgggcatgatctactacaagcaggagaagttcagcctggccgagatgcacttccagaaggccctggacatcaacccccagagcagcgtgctgctgtgccacatcggcgtggtgcagcacgccctgaagaagagcgagaaggccctggacaccctgaacaaggccatcgtgatcgaccccaagaaccccctgtgcaagttccacagagccagcgtgctgttcgccaacgagaagtacaagagcgccctgcaggagctggaggagctgaagcagatcgtgcccaaggagagcctggtgtacttcctgatcggcaaggtgtacaagaagctgggccagacccacctggccctgatgaacttcagctgggccatggacctggaccccaagggcgccaacaaccagatcaaggaggccatcgacaagagatacctgcccgacgacgaggagcccatcacccaggaggagcagatcatgggcaccgacgagagccaggagagcagcatgaccgacgccgacgacacccagctgcacgccgccgagagcgacgagttctag

SEQ ID NO: 76176 - DNA, 2472 bp, Artificial Sequence
  Description of Artificial Sequence: Synthetic coding sequence
atgaccgtgctgcaggagcccgtgcaggccgccatctggcaggccctgaaccactacgcctacagagacgccgtgttcctggccgagagactgtacgccgaggtgcacagcgaggaggccctgttcctgctggccacctgctactacagaagcggcaaggcctacaaggcctacagactgctgaagggccacagctgcaccaccccccagtgcaagtacctgctggccaagtgctgcgtggacctgagcaagctggccgagggcgagcagatcctgagcggcggcgtgttcaacaagcagaagagccacgacgacatcgtgaccgagttcggcgacagcgcctgcttcaccctgagcctgctgggccacgtgtactgcaagaccgacagactggccaagggcagcgagtgctaccagaagagcctgagcctgaaccccttcctgtggagccccttcgagagcctgtgcgagatcggcgagaagcccgaccccgaccagaccttcaagttcaccagcctgcagaacttcagcaactgcctgcccaacagctgcaccacccaggtgcccaaccacagcctgagccacagacagcccgagaccgtgctgaccgagaccccccaggacaccatcgagctgaacagactgaacctggagagcagcaacagcaagtacagcctgaacaccgacagcagcgtgagctacatcgacagcgccgtgatcagccccgacaccgtgcccctgggcaccggcaccagcatcctgagcaagcaggtgcagaacaagcccaagaccggcagaagcctgctgggcggccccgccgccctgagccccctgacccccagcttcggcatcctgcccctggagacccccagccccggcgacggcagctacctgcagaactacaccaacaccccccccgtgatcgacgtgcccagcaccggcgcccccagcaagaagagcgtggccagaatcggccagaccggcaccaagagcgtgttcagccagagcggcaacagcagagaggtgacccccatcctggcccagacccagagcagcggcccccagaccagcaccaccccccaggtgctgagccccaccatcaccagcccccccaacgccctgcccagaagaagcagcagactgttcaccagcgacagcagcaccaccaaggagaacagcaagaagctgaagatgaagttcccccccaagatccccaacagaaagaccaagagcaagaccaacaagggcggcatcacccagcccaacatcaacgacagcctggagatcaccaagctggacagcagcatcatcagcgagggcaagatcagcaccatcaccccccagatccaggccttcaacctgcagaaggccgccgccggcctgatgagcctgctgagagagatgggcaagggctacctggccctgtgcagctacaactgcaaggaggccatcaacatcctgagccacctgcccagccaccactacaacaccggctgggtgctgtgccagatcggcagagcctacttcgagctgagcgagtacatgcaggccgagagaatcttcagcgaggtgagaagaatcgagaactacagagtggagggcatggagatctacagcaccaccctgtggcacctgcagaaggacgtggccctgagcgtgctgagcaaggacctgaccgacatggacaagaacagccccgaggcctggtgcgccgccggcaactgcttcagcctgcagagagagcacgacatcgccatcaagttcttccagagagccatccaggtggaccccaactacgcctacgcctacaccctgctgggccacgagttcgtgctgaccgaggagctggacaaggccctggcctgcttcagaaacgccatcagagtgaaccccagacactacaacgcctggtacggcctgggcatgatctactacaagcaggagaagttcagcctggccgagatgcacttccagaaggccctggacatcaacccccagagcagcgtgctgctgtgccacatcggcgtggtgcagcacgccctgaagaagagcgagaaggccctggacaccctgaacaaggccatcgtgatcgaccccaagaaccccctgtgcaagttccacagagccagcgtgctgttcgccaacgagaagtacaagagcgccctgcaggagctggaggagctgaagcagatcgtgcccaaggagagcctggtgtacttcctgatcggcaaggtgtacaagaagctgggccagacccacctggccctgatgaacttcagctgggccatggacctggaccccaagggcgccaacaaccagatcaaggaggccatcgacaagagatacctgcccgacgacgaggagcccatcacccaggaggagcagatcatgggcaccgacgagagccaggagagcagcatgaccgacgccgacgacacccagctgcacgccgccgagagcgacgagttctag

SEQ ID NO: 76177 - DNA, 2493 bp, Artificial Sequence
  Description of Artificial Sequence: Synthetic coding sequence
atgaccgtgctgcaggagcccgtgcaggccgccatctggcaggccctgaaccactacgcctacagagacgccgtgttcctggccgagagactgtacgccgaggtgcacagcgaggaggccctgttcctgctggccacctgctactacagaagcggcaaggcctacaaggcctacagactgctgaagggccacagctgcaccaccccccagtgcaagtacctgctggccaagtgctgcgtggacctgagcaagctggccgagggcgagcagatcctgagcggcggcgtgttcaacaagcagaagagccacgacgacatcgtgaccgagttcggcgacagcgcctgcttcaccctgagcctgctgggccacgtgtactgcaagaccgacagactggccaagggcagcgagtgctaccagaagagcctgagcctgaaccccttcctgtggagccccttcgagagcctgtgcgagatcggcgagaagcccgaccccgaccagaccttcaagttcaccagcctgcagaacttcagcaactgcctgcccaacagctgcaccacccaggtgcccaaccacagcctgagccacagacagcccgagaccgtgctgaccgagaccccccaggacaccatcgagctgaacagactgaacctggagagcagcaacagcaagtacagcctgaacaccgacagcagcgtgagctacatcgacagcgccgtgatcagccccgacaccgtgcccctgggcaccggcaccagcatcctgagcaagcaggtgcagaacaagcccaagaccggcagaagcctgctgggcggccccgccgccctgagccccctgacccccagcttcggcatcctgcccctggagacccccagccccggcgacggcagctacctgcagaactacaccaacaccccccccgtgatcgacgtgcccagcaccggcgcccccagcaagaagaccttcagagtgctgcagagcgtggccagaatcggccagaccggcaccaagagcgtgttcagccagagcggcaacagcagagaggtgacccccatcctggcccagacccagagcagcggcccccagaccagcaccaccccccaggtgctgagccccaccatcaccagcccccccaacgccctgcccagaagaagcagcagactgttcaccagcgacagcagcaccaccaaggagaacagcaagaagctgaagatgaagttcccccccaagatccccaacagaaagaccaagagcaagaccaacaagggcggcatcacccagcccaacatcaacgacagcctggagatcaccaagctggacagcagcatcatcagcgagggcaagatcagcaccatcaccccccagatccaggccttcaacctgcagaaggccgccgccgagggcctgatgagcctgctgagagagatgggcaagggctacctggccctgtgcagctacaactgcaaggaggccatcaacatcctgagccacctgcccagccaccactacaacaccggctgggtgctgtgccagatcggcagagcctacttcgagctgagcgagtacatgcaggccgagagaatcttcagcgaggtgagaagaatcgagaactacagagtggagggcatggagatctacagcaccaccctgtggcacctgcagaaggacgtggccctgagcgtgctgagcaaggacctgaccgacatggacaagaacagccccgaggcctggtgcgccgccggcaactgcttcagcctgcagagagagcacgacatcgccatcaagttcttccagagagccatccaggtggaccccaactacgcctacgcctacaccctgctgggccacgagttcgtgctgaccgaggagctggacaaggccctggcctgcttcagaaacgccatcagagtgaaccccagacactacaacgcctggtacggcctgggcatgatctactacaagcaggagaagttcagcctggccgagatgcacttccagaaggccctggacatcaacccccagagcagcgtgctgctgtgccacatcggcgtggtgcagcacgccctgaagaagagcgagaaggccctggacaccctgaacaaggccatcgtgatcgaccccaagaaccccctgtgcaagttccacagagccagcgtgctgttcgccaacgagaagtacaagagcgccctgcaggagctggaggagctgaagcagatcgtgcccaaggagagcctggtgtacttcctgatcggcaaggtgtacaagaagctgggccagacccacctggccctgatgaacttcagctgggccatggacctggaccccaagggcgccaacaaccagatcaaggaggccatcgacaagagatacctgcccgacgacgaggagcccatcacccaggaggagcagatcatgggcaccgacgagagccaggagagcagcatgaccgacgccgacgacacccagctgcacgccgccgagagcgacgagttctag

SEQ ID NO: 76178 - DNA, 1740 bp, Artificial Sequence
  Description of Artificial Sequence: Synthetic coding sequence
atgagcgccgccatcgccgccctggccgccagctacggcagcggcagcggcagcgagagcgacagcgacagcgagagcagcagatgccccctgcccgccgccgacagcctgatgcacctgaccaagagccccagcagcaagcccagcctggccgtggccgtggacagcgcccccgaggtggccgtgaaggaggacctggagaccggcgtgcacctggaccccgccgtgaaggaggtgcagtacaaccccacctacgagaccatgttcgcccccgagttcggccccgagaaccccttcagaacccagcagatggccgcccccagaaacatgctgagcggctacgccgagcccgcccacatcaacgacttcatgttcgagcagcagagaagaaccttcgccacctacggctacgccctggaccccagcctggacaaccaccaggtgagcgccaagtacatcggcagcgtggaggaggccgagaagaaccagggcctgaccgtgttcgagaccggccagaagaagaccgagaagagaaagaagttcaaggagaacgacgccagcaacatcgacggcttcctgggcccctgggccaagtacgtggacgagaaggacgtggccaagcccagcgaggaggagcagaaggagctggacgagatcaccgccaagagacagaagaagggcaagcaggaggaggagaagcccggcgaggagaagaccatcctgcacgtgaaggagatgtacgactaccagggcagaagctacctgcacatcccccaggacgtgggcgtgaacctgagaagcaccatgccccccgagaagtgctacctgcccaagaagcagatccacgtgtggagcggccacaccaagggcgtgagcgccgtgagactgttccccctgagcggccacctgctgctgagctgcagcatggactgcaagatcaagctgtgggaggtgtacggcgagagaagatgcctgagaaccttcatcggccacagcaaggccgtgagagacatctgcttcaacaccgccggcacccagttcctgagcgccgcctacgacagatacctgaagctgtgggacaccgagaccggccagtgcatcagcagattcaccaacagaaaggtgccctactgcgtgaagttcaaccccgacgaggacaagcagaacctgttcgtggccggcatgagcgacaagaagatcgtgcagtgggacatcagaagcggcgagatcgtgcaggagtacgacagacacctgggcgccgtgaacaccatcgtgttcgtggacgagaacagaagattcgtgagcaccagcgacgacaagagcctgagagtgtgggagtgggacatccccgtggacttcaagtacatcgccgagcccagcatgcacagcatgcccgccgtgaccctgagccccaacggcaagtggctggcctgccagagcatggacaaccagatcctgatcttcggcgcccagaacagattcagactgaacaagaagaagatcttcaagggccacatggtggccggctacgcctgccaggtggacttcagccccgacatgagctacgtgatcagcggcgacggcaacggcaagctgaacatctgggactggaagaccaccaagctgtacagcagattcaaggcccacgacaaggtgtgcatcggcgccgtgtggcacccccacgagaccagcaaggtgatcacctgcggctgggacggcctgatcaagctgtgggactag

SEQ ID NO: 76179 - DNA, 1620 bp, Artificial Sequence
  Description of Artificial Sequence: Synthetic coding sequence
atgagcgccgccatcgccgccctggccgccagctacggcagcggcagcggcagcgagagcgacagcgacagcgagagcagcagatgccccctgcccgccgccgacagcctgatgcacctgaccaagagccccagcagcaagcccagcctggccgtggccgtggacagcgcccccgaggtggccgtgaaggaggacctggagaccggcgtgcacctggaccccgccgtgaaggaggtgcagtacaaccccacctacgagaccatgttcgcccccgagttcggccccgagaaccccttcagaacccagcagatggccgcccccagaaacatgctgagcggctacgccgagcccgcccacatcaacgacttcatgttcgagcagcagagaagaaccttcgccacctacggctacgccctggaccccagcctggacaaccaccaggtgagcgccaagtacatcggcagcgtggaggaggccgagaagaaccagggcctgaccgtgttcgagaccggccagaagaagaccgagaagagaaagaagttcaaggagaacgacgccagcaacatcgacggcttcctgggcccctgggccaagtacgtggacgagaaggacgtggccaagcccagcgaggaggagcagaaggagctggacgagatcaccgccaagagacagaagaagggcaagcaggaggaggagaagcccggcgaggagaagaccatcctgcacgtgaaggagatgtacgactaccagggcagaagctacctgcacatcccccaggacgtgggcgtgaacctgagaagcaccatgccccccgagaagtgctacctgcccaagaagcagatccacgtgtggagcggccacaccaagggcgtgagcgccgtgagactgttccccctgagcggccacctgctgctgagctgcagcatggactgcaagatcaagctgtgggaggtgtacggcgagagaagatgcctgagaaccttcatcggccacagcaaggccgtgagagacatctgcttcaacaccgccggcacccagttcctgagcgccgcctacgacagatacctgaagctgtgggacaccgagaccggccagtgcatcagcagattcaccaacagaaaggtgccctactgcgtgaagttcaaccccgacgaggacaagcagaacctgttcgtggccggcatgagcgacaagaagatcgtgcagtgggacatcagaagcggcgagatcgtgcaggagtacgacagacacctgggcgccgtgaacaccatcgtgttcgtggacgagaacagaagattcgtgagcaccagcgacgacaagagcctgagagtgtgggagtgggacatccccgtggacttcaagtacatcgccgagcccagcatgcacagcatgcccgccgtgaccctgagccccaacggcaagtggctggcctgccagagcatggacaaccagatcctgatcttcggcgcccagaacagattcagactgaacaagaagaagatcttcaagggccacatggtggccggctacgcctgccaggtggacttcagccccgacatgagagtgccccagagcttccagaacctgaaggaggtgaccgccggcccccaggagggctag

SEQ ID NO: 76180 - DNA, 1740 bp, Artificial Sequence; identical to SEQ ID NO: 76178
  Description of Artificial Sequence: Synthetic coding sequence

SEQ ID NO: 76181 - DNA, 1620 bp, Artificial Sequence; identical to SEQ ID NO: 76179
  Description of Artificial Sequence: Synthetic coding sequence

SEQ ID NO: 76182 - DNA, 378 bp, Artificial Sequence
  Description of Artificial Sequence: Synthetic coding sequence
tgaaacatgctgagcggctacgccgagcccgcccacatcaacgacttcatgttcgagcagcagagaagaaccttcgccacctacggctacgccctggaccccagcctggacaaccaccaggtgagcgccaagtacatcggcagcgtggaggaggccgagaagaaccagggcctgaccgtgttcgagaccggccagaagaagaccgagaagagaaagaagttcaaggagaacgacgccagcaacatcgacggcttcctgggcccctgggccaagtacgtggacgagaaggacgtggccaagcccagcgaggtgagcttcgacgtgttcaactgccagttcagatacaccctgtacctgtacgagggctacctgcactag

SEQ ID NO: 76183 - DNA, 495 bp, Artificial Sequence
  Description of Artificial Sequence: Synthetic coding sequence
atgagcgccgccatcgccgccctggccgccagctacggcagcggcagcggcagcgagagcgacagcgacagcgagagcagcagatgccccctgcccgccgccgacagcctgatgcacctgaccaagagccccagcagcaagcccagcctggccgtggccgtggacagcgcccccgaggtggccgtgaaggaggacctggagaccggcgtgcacctggaccccgccgtgaaggaggtgcagtacaaccccacctacgagaccatgttcgcccccgagttcggccccgagaaccccttcagaacccagcagatggccgcccccagaaacatgctgagcggctacgccgagcccgcccacatcaacgacttcatgttcgagcagcagagaagaaccttcgccacctacggctacgccctggaccccagcctggacaaccaccaggtgagcgccaagtacatcggcagcgtggaggaggccgagaagatcaaggtgtag

SEQ ID NO: 76184 - DNA, 213 bp, Artificial Sequence
  Description of Artificial Sequence: Synthetic coding sequence
atggccgcccccagaaacatgctgagcggctacgccgagcccgcccacatcaacgacttcatgttcgagcagcagagaagaaccttcgccacctacggctacgccctggaccccagcctggacaaccaccaggtgagcgccaagtacatcggcagcgtggaggaggccgagaagaaccagggcctgaccgtgttcgagaccggccagaagtag

SEQ ID NO: 76185 - DNA, 1305 bp, Artificial Sequence
  Description of Artificial Sequence: Synthetic coding sequence
atgagcatcctgaagatccacgccagagagatcttcgacagcagaggcaaccccaccgtggaggtggacctgttcaccagcaagggcctgttcagagccgccgtgcccagcggcgccagcaccggcatctacgaggccctggagctgagagacaacgacaagaccagatacatgggcaagggcgtgagcaaggccgtggagcacatcaacaagaccatcgcccccgccctggtgagcaagaagctgaacgtgaccgagcaggagaagatcgacaagctgatgatcgagatggacggcaccgagaacaagagcaagttcggcgccaacgccatcctgggcgtgagcctggccgtgtgcaaggccggcgccgtggagaagggcgtgcccctgtacagacacatcgccgacctggccggcaacagcgaggtgatcctgcccgtgcccgccttcaacgtgatcaacggcggcagccacgccggcaacaagctggccatgcaggagttcatgatcctgcccgtgggcgccgccaacttcagagaggccatgagaatcggcgccgaggtgtaccacaacctgaagaacgtgatcaaggagaagtacggcaaggacgccaccaacgtgggcgacgagggcggcttcgcccccaacatcctggagaacaaggagggcctggagctgctgaagaccgccatcggcaaggccggctacaccgacaaggtggtgatcggcatggacgtggccgccagcgagttcttcagaagcggcaagtacgacctggacttcaagagccccgacgaccccagcagatacatcagccccgaccagctggccgacctgtacaagagcttcatcaaggactaccccgtggtgagcatcgaggaccccttcgaccaggacgactggggcgcctggcagaagttcaccgccagcgccggcatccaggtggtgggcgacgacctgaccgtgaccaaccccaagagaatcgccaaggccgtgaacgagaagagctgcaactgcctgctgctgaaggtgaaccagatcggcagcgtgaccgagagcctgcaggcctgcaagctggcccaggccaacggctggggcgtgatggtgagccacagaagcggcgagaccgaggacaccttcatcgccgacctggtggtgggcctgtgcaccggccagatcaagaccggcgccccctgcagaagcgagagactggccaagtacaaccagctgctgagaatcgaggaggagctgggcagcaaggccaagttcgccggcagaaacttcagaaaccccctggccaagtag

SEQ ID NO: 76186 - DNA, 360 bp, Artificial Sequence
  Description of Artificial Sequence: Synthetic coding sequence
atgagaaagaccgccagcagctgccccgccagcctgacctgcgactgctacgccaccgacaaggtgtgcagcatctgcctgagcagaagacagcaggtggcccccagagccggcacccccggcttcagagcccccgaggtgctgaccaagtgccccaaccagaccaccggcaagagcatcctgtgcagcaaggaggtgcccgcccaggacctgagaaagctgtgcgagagactgagaggcatggacagcagcacccccaagctgaccagcgacatccagggccacgccagccaccagcccgccatcagcgagaagaccgaccacaaggccagctgcctggtgcagaccccccccggctag

SEQ ID NO: 76187 - DNA, 474 bp, Artificial Sequence
  Description of Artificial Sequence: Synthetic coding sequence
atggaggccagcctgggcatccagatggacgagcccatggccttcagcccccagagagacagattccaggccgagggcagcctgaagaagaacgagcagaacttcaagctggccggcgtgaagaaggacatcgagaagctgtacgaggccgtgccccagctgagcaacgtgttcaagatcgaggacaagatcggcgagggcaccttcagcagcgtgtacctggccaccgcccagctgcaggtgggccccgaggagaagatcgccctgaagcacctgatccccaccagccaccccatcagaatcgccgccgagctgcagtgcctgaccgtggccggcggccaggacaacgtgatgggcgtgaagtactgcttcagaaagaacgaccacgtggtgatcgccatgccctacctggagcacgagagcttcctggacatcctgaacagcctgagcttccaggaggtgagagagtactag

SEQ ID NO: 76188 - DNA, 1725 bp, Artificial Sequence
  Description of Artificial Sequence: Synthetic coding sequence
atggaggccagcctgggcatccagatggacgagcccatggccttcagcccccagagagacagattccaggccgagggcagcctgaagaagaacgagcagaacttcaagctggccggcgtgaagaaggacatcgagaagctgtacgaggccgtgccccagctgagcaacgtgttcaagatcgaggacaagatcggcgagggcaccttcagcagcgtgtacctggccaccgcccagctgcaggtgggccccgaggagaagatcgccctgaagcacctgatccccaccagccaccccatcagaatcgccgccgagctgcagtgcctgaccgtggccggcggccaggacaacgtgatgggcgtgaagtactgcttcagaaagaacgaccacgtggtgatcgccatgccctacctggagcacgagagcttcctggacatcctgaacagcctgagcttccaggaggtgagagagtacatgctgaacctgttcaaggccctgaagagaatccaccagttcggcatcgtgcacagagacgtgaagcccagcaacttcctgtacaacagaagactgaagaagtacgccctggtggacttcggcctggcccagggcacccacgacaccaagatcgagctgctgaagttcgtgcagagcgaggcccagcaggagagatgcagccagaacaagagccacatcatcaccggcaacaagatccccctgagcggccccgtgcccaaggagctggaccagcagagcaccaccaaggccagcgtgaagagaccctacaccaacgcccagatccagatcaagcagggcaaggacggcaaggagggcagcgtgggcctgagcgtgcagagaagcgtgttcggcgagagaaacttcaacatccacagcagcatcagccacgagagccccgccgtgaagctgatgaagcagagcaagaccgtggacgtgctgagcagaaagctggccaccaagaagaaggccatcagcaccaaggtgatgaacagcgccgtgatgagaaagaccgccagcagctgccccgccagcctgacctgcgactgctacgccaccgacaaggtgtgcagcatctgcctgagcagaagacagcaggtggcccccagagccggcacccccggcttcagagcccccgaggtgctgaccaagtgccccaaccagaccaccgccatcgacatgtggagcgccggcgtgatcttcctgagcctgctgagcggcagataccccttctacaaggccagcgacgacctgaccgccctggcccagatcatgaccatcagaggcagcagagagaccatccaggccgccaagaccttcggcaagagcatcctgtgcagcaaggaggtgcccgcccaggacctgagaaagctgtgcgagagactgagaggcatggacagcagcacccccaagctgaccagcgacatccagggccacgccagccaccagcccgccatcagcgagaagaccgaccacaaggccagctgcctggtgcagaccccccccggccagtacagcggcaacagcttcaagaagggcgacagcaacagctgcgagcactgcttcgacgagtacaacaccaacctggagggctggaacgaggtgcccgacgaggcctacgacctgctggacaagctgctggacctgaaccccgccagcagaatcaccgccgaggaggccctgctgcaccccttcttcaaggacatgagcctgtag

SEQ ID NO: 76189 - DNA, 1641 bp, Artificial Sequence
  Description of Artificial Sequence: Synthetic coding sequence
atggaggccagcctgggcatccagatggacgagcccatggccttcagcccccagagagacagattccaggccgagggcagcctgaagaagaacgagcagaacttcaagctggccggcaccttcagcagcgtgtacctggccaccgcccagctgcaggtgggccccgaggagaagatcgccctgaagcacctgatccccaccagccaccccatcagaatcgccgccgagctgcagtgcctgaccgtggccggcggccaggacaacgtgatgggcgtgaagtactgcttcagaaagaacgaccacgtggtgatcgccatgccctacctggagcacgagagcttcctggacatcctgaacagcctgagcttccaggaggtgagagagtacatgctgaacctgttcaaggccctgaagagaatccaccagttcggcatcgtgcacagagacgtgaagcccagcaacttcctgtacaacagaagactgaagaagtacgccctggtggacttcggcctggcccagggcacccacgacaccaagatcgagctgctgaagttcgtgcagagcgaggcccagcaggagagatgcagccagaacaagagccacatcatcaccggcaacaagatccccctgagcggccccgtgcccaaggagctggaccagcagagcaccaccaaggccagcgtgaagagaccctacaccaacgcccagatccagatcaagcagggcaaggacggcaaggagggcagcgtgggcctgagcgtgcagagaagcgtgttcggcgagagaaacttcaacatccacagcagcatcagccacgagagccccgccgtgaagctgatgaagcagagcaagaccgtggacgtgctgagcagaaagctggccaccaagaagaaggccatcagcaccaaggtgatgaacagcgccgtgatgagaaagaccgccagcagctgccccgccagcctgacctgcgactgctacgccaccgacaaggtgtgcagcatctgcctgagcagaagacagcaggtggcccccagagccggcacccccggcttcagagcccccgaggtgctgaccaagtgccccaaccagaccaccgccatcgacatgtggagcgccggcgtgatcttcctgagcctgctgagcggcagataccccttctacaaggccagcgacgacctgaccgccctggcccagatcatgaccatcagaggcagcagagagaccatccaggccgccaagaccttcggcaagagcatcctgtgcagcaaggaggtgcccgcccaggacctgagaaagctgtgcgagagactgagaggcatggacagcagcacccccaagctgaccagcgacatccagggccacgccagccaccagcccgccatcagcgagaagaccgaccacaaggccagctgcctggtgcagaccccccccggccagtacagcggcaacagcttcaagaagggcgacagcaacagctgcgagcactgcttcgacgagtacaacaccaacctggagggctggaacgaggtgcccgacgaggcctacgacctgctggacaagctgctggacctgaaccccgccagcagaatcaccgccgaggaggccctgctgcaccccttcttcaaggacatgagcctgtag

SEQ ID NO: 76190 - DNA, 3453 bp, Artificial Sequence
  Description of Artificial Sequence: Synthetic coding sequence
atggcccagttcggcggccagaagaaccccccctgggccacccagttcaccgccaccgccgtgagccagcccgccgccctgggcgtgcagcagcccagcctgctgggcgccagccccaccatctacacccagcagaccgccctggccgccgccggcctgaccacccagacccccgccaactaccagctgacccagaccgccgccctgcagcagcaggccgccgccgccgccgccgccctgcagcagcagtacagccagccccagcaggccctgtacagcgtgcagcagcagctgcagcagccccagcagaccctgctgacccagcccgccgtggccctgcccaccagcctgagcctgagcaccccccagcccaccgcccagatcaccgtgagctaccccacccccagaagcagccagcagcagacccagccccagaagcagagagtgttcaccggcgtggtgaccaagctgcacgacaccttcggcttcgtggacgaggacgtgttcttccagctgagcgccgtgaagggcaagaccccccaggtgggcgacagagtgctggtggaggccacctacaaccccaacatgcccttcaagtggaacgcccagagaatccagaccctgcccaaccagaaccagagccagacccagcccctgctgaagaccccccccgccgtgctgcagcccatcgccccccagaccaccttcggcgtgcagacccagccccagccccagagcctgctgcaggcccagatcagcgccgccagcatcacccccctgctgcagacccagccccagcccctgctgcagcagccccagcagaaggccggcctgctgcagccccccgtgagaatcgtgagccagccccagcccgccagaagactggacccccccagcagattcagcggcagaaacgacagaggcgaccaggtgcccaacagaaaggacgacagaagcagagagagagagagagagagaagaagaagcagagagagaagcccccagagaaagagaagcagagagagaagccccagaagagagagagagagaagccccagaagagtgagaagagtggtgcccagatacaccgtgcagttcagcaagttcagcctggactgccccagctgcgacatgatggagctgagaagaagataccagaacctgtacatccccagcgacttcttcgacgcccagttcacctgggtggacgccttccccctgagcagacccttccagctgggcaactactgcaacttctacgtgatgcacagagaggtggagagcctggagaagaacatggccatcctggacccccccgacgccgaccacctgtacagcgccaaggtgatgctgatggccagccccagcatggaggacctgtaccacaagagctgcgccctggccgaggacccccaggagctgagagacggcttccagcaccccgccagactggtgaagttcctggtgggcatgaagggcaaggacgaggccatggccatcggcggccactggagccccagcctggacggccccgaccccgagaaggaccccagcgtgctgatcaagaccgccatcagatgctgcaaggccctgaccggcatcgacctgagcgtgtgcacccagtggtacagattcgccgagatcagataccacagacccgaggagacccacaagggcagaaccgtgcccgcccacgtggagaccgtggtgctgttcttccccgacgtgtggcactgcctgcccaccagaagcgagtgggagaccctgagcagaggctacaagcagcagctggtggagaagctgcagggcgagagaaaggaggccgacggcgagcaggacgaggaggagaaggacgacggcgaggccaaggagatcagcacccccacccactggagcaagctggaccccaagaccatgaaggtgaacgacctgagaaaggagctggagagcagagccctgagcagcaagggcctgaagagccagctgatcgccagactgaccaagcagctgaaggtggaggagcagaaggaggagcagaaggagctggagaagagcgagaaggaggaggacgaggacgacgacagaaagagcgaggacgacaaggaggaggaggagagaaagagacaggaggagatcgagagacagagaagagagagaagatacatcctgcccgacgagcccgccatcatcgtgcaccccaactgggccgccaagagcggcaagttcgactgcagcatcatgagcctgagcgtgctgctggactacagactggaggacaacaaggagcacagcttcgaggtgagcctgttcgccgagctgttcaacgagatgctgcagagagacttcggcgtgagaatctacaagagcctgctgagcctgcccgagaaggaggacaagaaggagaaggacaagaagagcaagaaggacgagagaaaggacaagaaggaggagagagacgacgagaccgacgagcccaagcccaagagaagaaagagcggcgacgacaaggacaagaaggaggacagagacgagagaaagaaggaggacaagagaaaggacgacagcaaggacgacgacgagaccgaggaggacaacaaccaggacgagtacgaccccatggaggccgaggaggccgaggacgaggaggacgacagagacgaggaggagatgaccaagagagacgacaagagagacatcaacagatactgcaaggagagacccagcaaggacaaggagaaggagaagacccagatgatcaccatcaacagagacctgctgatggccttcgtgtacttcgaccagagccactgcggctacctgctggagaaggacctggaggagatcctgtacaccctgggcctgcacctgagcagagcccaggtgaagaagctgctgaacaaggtggtgctgagagagagctgcttctacagaaagctgaccgacaccagcaaggacgaggagaaccacgaggagagcgagagcctgcaggaggacatgctgggcaacagactgctgctgcccacccccaccgtgaagcaggagagcaaggacgtggaggagaacgtgggcctgatcgtgtacaacggcgccatggtggacgtgggcagcctgctgcagaagctggagaagagcgagaaggtgagagccgaggtggagcagaagctgcagctgctggaggagaagaccgacgaggacgagaagaccatcctgaacctggagaacagcaacaagagcctgagcggcgagctgagagaggtgaagaaggacctgagccagctgcaggagaacctgaagatcagcgagaacatgaacctgcagttcgagaaccagatgaacaagaccatcagaaacctgagcaccgtgatggacgagatccacaccgtgctgaagaaggacaacgtgaagaacgaggacaaggaccagaagagcaaggagaacggcgccagcgtgtag

SEQ ID NO: 76191 - DNA, 3408 bp, Artificial Sequence
  Description of Artificial Sequence: Synthetic coding sequence
atggcccagttcggcggccagaagaaccccccctgggccacccagttcaccgccaccgccgtgagccagcccgccgccctgggcgtgcagcagcccagcctgctgggcgccagccccaccatctacacccagcagaccgccctggccgccgccggcctgaccacccagacccccgccaactaccagctgacccagaccgccgccctgcagcagcaggccgccgccgccgccgccgccctgcagcagctgcagcagccccagcagaccctgctgacccagcccgccgtggccctgcccaccagcctgagcctgagcaccccccagcccaccgcccagatcaccgtgagctaccccacccccagaagcagccagcagcagacccagccccagaagcagagagtgttcaccggcgtggtgaccaagctgcacgacaccttcggcttcgtggacgaggacgtgttcttccagctgagcgccgtgaagggcaagaccccccaggtgggcgacagagtgctggtggaggccacctacaaccccaacatgcccttcaagtggaacgcccagagaatccagaccctgcccaaccagaaccagagccagacccagcccctgctgaagaccccccccgccgtgctgcagcccatcgccccccagaccaccttcggcgtgcagacccagccccagccccagagcctgctgcaggcccagatcagcgccgccagcatcacccccctgctgcagacccagccccagcccctgctgcagcagccccagcagaaggccggcctgctgcagccccccgtgagaatcgtgagccagccccagcccgccagaagactggacccccccagcagattcagcggcagaaacgacagaggcgaccaggtgcccaacagaaaggacgacagaagcagagagagagagagagagagaagaagaagcagagagagaagcccccagagaaagagaagcagagagagaagccccagaagagagagagagagaagccccagaagagtgagaagagtggtgcccagatacaccgtgcagttcagcaagttcagcctggactgccccagctgcgacatgatggagctgagaagaagataccagaacctgtacatccccagcgacttcttcgacgcccagttcacctgggtggacgccttccccctgagcagacccttccagctgggcaactactgcaacttctacgtgatgcacagagaggtggagagcctggagaagaacatggccatcctggacccccccgacgccgaccacctgtacagcgccaaggtgatgctgatggccagccccagcatggaggacctgtaccacaagagctgcgccctggccgaggacccccaggagctgagagacggcttccagcaccccgccagactggtgaagttcctggtgggcatgaagggcaaggacgaggccatggccatcggcggccactggagccccagcctggacggccccgaccccgagaaggaccccagcgtgctgatcaagaccgccatcagatgctgcaaggccctgaccggcatcgacctgagcgtgtgcacccagtggtacagattcgccgagatcagataccacagacccgaggagacccacaagggcagaaccgtgcccgcccacgtggagaccgtggtgctgttcttccccgacgtgtggcactgcctgcccaccagaagcgagtgggagaccctgagcagaggctacaagcagcagctggtggagaagctgcagggcgagagaaaggaggccgacggcgagcaggacgaggaggagaaggacgacggcgaggccaaggagatcagcacccccacccactggagcaagctggaccccaagaccatgaaggtgaacgacctgagaaaggagctggagagcagagccctgagcagcaagggcctgaagagccagctgatcgccagactgaccaagcagctgaaggtggaggagcagaaggaggagcagaaggagctggagaagagcgagaaggaggaggacgaggacgacgacagaaagagcgaggacgacaaggaggaggaggagagaaagagacaggaggagatcgagagacagagaagagagagaagatacatcctgcccgacgagcccgccatcatcgtgcaccccaactgggccgccaagagcggcaagttcgactgcagcatcatgagcctgagcgtgctgctggactacagactggaggacaacaaggagcacagcttcgaggtgagcctgttcgccgagctgttcaacgagatgctgcagagagacttcggcgtgagaatctacaagagcctgctgagcctgcccgagaaggaggacaagaaggagaaggacaagaagagcaagaaggacgagagaaaggacaagaaggaggagagagacgacgagaccgacgagcccaagcccaagagaagaaagagcggcgacgacaaggacaagaaggaggacagagacgagagaaagaaggaggacaagagaaaggacgacagcaaggacgacgacgagaccgaggaggacaacaaccaggacgagtacgaccccatggaggccgaggaggccgaggacgaggaggacgacagagacgaggaggagatgaccaagagagacgacaagagagacatcaacagatactgcaaggagagacccagcaaggacaaggagaaggagaagacccagatgatcaccatcaacagagacctgctgatggccttcgtgtacttcgaccagagccactgcggctacctgctggagaaggacctggaggagatcctgtacaccctgggcctgcacctgagcagagcccaggtgaagaagctgctgaacaaggtggtgctgagagagagctgcttctacagaaagctgaccgacaccagcaaggacgaggagaaccacgaggagagcgagagcctgcaggaggacatgctgggcaacagactgctgctgcccacccccaccgtgaagcaggagagcaaggacgtggaggagaacgtgggcctgatcgtgtacaacggcgccatggtggacgtgggcagcctgctgcagaagctggagaagagcgagaaggtgagagccgaggtggagcagaagctgcagctgctggaggagaagaccgacgaggacgagaagaccatcctgaacctggagaacagcaacaagagcctgagcggcgagctgagagaggtgaagaaggacctgagccagctgcaggagaacctgaagatcagcgagaacatgaacctgcagttcgagaaccagatgaacaagaccatcagaaacctgagcaccgtgatggacgagatccacaccgtgctgaagaaggacaacgtgaagaacgaggacaaggaccagaagagcaaggagaacggcgccagcgtgtag

SEQ ID NO: 76192 - DNA, 360 bp, Artificial Sequence
  Description of Artificial Sequence: Synthetic coding sequence
atggcccagttcggcggccagaagaaccccccctgggccacccagttcaccgccaccgccgtgagccagcccgccgccctgggcgtgcagcagcccagcctgctgggcgccagccccaccatctacacccagcagaccgccctggccgccgccggcctgaccacccagacccccgccaactaccagctgacccagaccgccgccctgcagcagcaggccgccgccgccgccgccgccctgcagcagcagtacagccagccccagcaggccctgtacagcgtgcagcagcagctgcagcagccccagcagaccctgctgacccagcccgccgtggccctgcccaccagcctgagcctgtag

SEQ ID NO: 76193 - DNA, 516 bp, Artificial Sequence
  Description of Artificial Sequence: Synthetic coding sequence
atggcccagttcggcggccagaagaaccccccctgggccacccagttcaccgccaccgccgtgagccagcccgccgccctgggcgtgcagcagcccagcctgctgggcgccagccccaccatctacacccagcagaccgccctggccgccgccggcctgaccacccagacccccgccaactaccagctgacccagaccgccgccctgcagcagcaggccgccgccgccgccgccgccctgcagcagcagtacagccagccccagcaggccctgtacagcgtgcagcagcagctgcagcagccccagcagaccctgctgacccagcccgccgtggccctgcccaccagcctgagcctgagcaccccccagcccaccgcccagatcaccgtgagctaccccacccccagaagcagccagcagcagacccagccccagaagcagagagtgttcaccggcgtggtgaccaagctgcacgacaccttcggcttcgtggacgaggacgtgttcttccagtag

SEQ ID NO: 76194 - DNA, 3132 bp, Artificial Sequence
  Description of Artificial Sequence: Synthetic coding sequence
atggcccagttcggcggccagaagaaccccccctgggccacccagttcaccgccaccgccgtgagccagcccgccgccctgggcgtgcagcagcccagcctgctgggcgccagccccaccatctacacccagcagaccgccctggccgccgccggcctgaccacccagacccccgccaactaccagctgacccagaccgccgccctgcagcagcaggccgccgccgccgccgccgccctgcagcagctgcagcagccccagcagaccctgctgacccagcccgccgtggccctgcccaccagcctgagcctgagcaccccccagcccaccgcccagatcaccgtgagctaccccacccccagaagcagccagcagcagacccagccccagaagcagagagtgttcaccggcgtggtgaccaagctgcacgacaccttcggcttcgtggacgaggacgtgttcttccagctgagcgccgtgaagggcaagaccccccaggtgggcgacagagtgctggtggaggccacctacaaccccaacatgcccttcaagtggaacgcccagagaatccagaccctgcccaaccagaaccagagccagacccagcccctgctgaagaccccccccgccgtgctgcagcccatcgccccccagaccaccttcggcgtgcagacccagccccagccccagagcctgctgcaggcccagatcagcgccgccagcatcacccccctgctgcagacccagccccagcccctgctgcagcagccccagcagaaggccggcctgctgcagccccccgtgagaatcgtgagccagccccagcccgccagaagactggacccccccagcagattcagcggcagaaacgacagaggcgaccaggtgcccaacagaaaggacgacagaagcagagagagagagagagagagaagaagaagcagagagagaagcccccagagaaagagaagcagagagagaagccccagaagagagagagagagaagccccagaagagtgagaagagtggtgcccagatacaccgtgcagttcagcaagttcagcctggactgccccagctgcgacatgatggagctgagaagaagataccagaacctgtacatccccagcgacttcttcgacgcccagttcacctgggtggacgccttccccctgagcagacccttccagctgggcaactactgcaacttctacgtgatgcacagagaggtggagagcctggagaagaacatggccatcctggacccccccgacgccgaccacctgtacagcgccaaggtgatgctgatggccagccccagcatggaggacctgtaccacaagagctgcgccctggccgaggacccccaggagctgagagacggcttccagcaccccgccagactggtgaagttcctggtgggcatgaagggcaaggacgaggccatggccatcggcggccactggagccccagcctggacggccccgaccccgagaaggaccccagcgtgctgatcaagaccgccatcagatgctgcaaggccctgaccggcatcgacctgagcgtgtgcacccagtggtacagattcgccgagatcagataccacagacccgaggagacccacaagggcagaaccgtgcccgcccacgtggagaccgtggtgctgttcttccccgacgtgtggcactgcctgcccaccagaagcgagtgggagaccctgagcagaggctacaagcagcagctggtggagaagctgcagggcgagagaaaggaggccgacggcgagcaggacgaggaggagaaggacgacggcgaggccaaggagatcagcacccccacccactggagcaagctggaccccaagaccatgaaggtgaacgacctgagaaaggagctggagagcagagccctgagcagcaagggcctgaagagccagctgatcgccagactgaccaagcagctgaaggtggaggagcagaaggaggagcagaaggagctggagaagagcgagaaggaggaggacgaggacgacgacagaaagagcgaggacgacaaggaggaggaggagagaaagagacaggaggagatcgagagacagagaagagagagaagatacatcctgcccgacgagcccgccatcatcgtgcaccccaactgggccgccaagagcggcaagttcgactgcagcatcatgagcctgagcgtgctgctggactacagactggaggacaacaaggagcacagcttcgaggtgagcctgttcgccgagctgttcaacgagatgctgcagagagacttcggcgtgagaatctacaagagcctgctgagcctgcccgagaaggaggacaagaaggagaaggacaagaagagcaagaaggacgagagaaaggacaagaaggaggagagagacgacgagaccgacgagcccaagcccaagagaagaaagagcggcgacgacaaggacaagaaggaggacagagacgagagaaagaaggaggacaagagaaaggacgacagcaaggacgacgacgagaccgaggaggacaacaaccaggacgagtacgaccccatggaggccgaggaggccgaggacgaggaggacgacagagacgaggaggagatgaccaagagagacgacaagagagacatcaacagatactgcaaggagagacccagcaaggacaaggagaaggagaagacccagatgatcaccatcaacagagacctgctgatggccttcgtgtacttcgaccagagccactgcggctacctgctggagaaggacctggaggagatcctgtacaccctgggcctgcacctgagcagagcccaggtgaagaagctgctgaacaaggtggtgctgagagagagctgcttctacagaaagctgaccgacaccagcaaggacgaggagaaccacgaggagagcgagagcctgcaggaggacatgctgggcaacagactgctgctgcccacccccaccgtgaagcaggagagcaaggacgtggaggagaacgtgggcctgatcgtgtacaacggcgccatggtggacgtgggcagcctgctgcagaagctggagaagagcgagaaggtgagagccgaggtggagcagaagctgcagctgctgtag

SEQ ID NO: 76195 - DNA, 726 bp, Artificial Sequence
  Description of Artificial Sequence: Synthetic coding sequence
atgttcgccagaggcctgaagagaaagtgcgtgggccacgaggaggacgtggagggcgccctggccggcctgaagaccgtgagcagctacagcctgcagagacagagcctgctggacatgagcctggtgaagctgcagctgtgccacatgctggtggagcccaacctgtgcagaagcgtgctgatcgccaacaccgtgagacagatccaggaggagatgacccaggacggcacctggagaaccgtggccccccaggccgccgagagagcccccctggacagactggtgagcaccgagatcctgtgcagagccgcctggggccaggagggcgcccaccccgcccccggcctgggcgacggccacacccagggccccgtgagcgacctgtgccccgtgaccagcgcccaggcccccagacacctgcagagcagcgcctgggagatggacggccccagagagaacagaggcagcttccacaagagcctggaccagatcttcgagaccctggagaccaagaaccccagctgcatggaggagctgttcagcgacgtggacagcccctactacgacctggacaccgtgctgaccggcatgatgggcggcgccagacccggcccctgcgagggcctggagggcctggcccccgccacccccggccccagcagcagctgcaagagcgacctgggcgagctggaccacgtggtggagatcctggtggagacctag

SEQ ID NO: 76196 - DNA, 726 bp, Artificial Sequence; identical to SEQ ID NO: 76195
  Description of Artificial Sequence: Synthetic coding sequence

SEQ ID NO: 76197 - DNA, 759 bp, Artificial Sequence
  Description of Artificial Sequence: Synthetic coding sequence
atgagcggcagaagaaccagaagcggcggcgccgcccagagaagcggccccagagcccccagccccaccaagcccctgagaagaagccagagaaagagcggcagcgagctgcccagcatcctgcccgagatctggcccaagacccccagcgccgccgccgtgagaaagcccatcgtgctgaagagaatcgtggcccacgccgtggaggtgcccgccgtgcagagccccagaagaagccccagaatcagcttcttcctggagaaggagaacgagccccccggcagagagctgaccaaggaggacctgttcaagacccacagcgtgcccgccacccccaccagcacccccgtgcccaaccccgaggccgagagcagcagcaaggagggcgagctggacgccagagacctggagatgagcaagaaggtgagaagaagctacagcagactggagaccctgggcagcgccagcaccagcacccccggcagaagaagctgcttcggcttcgagggcctgctgggcgccgaggacctgagcggcgtgagccccgtggtgtgcagcaagctgaccgaggtgcccagagtgtgcgccaagccctgggcccccgacatgaccctgcccggcatcagccccccccccgagaagcagaagagaaagaagaagaagatgcccgagatcctgaagaccgagctggacgagtgggccgccgccatgaacgccgagttcgaggccgccgagcagttcgacctgctggtggagtag

SEQ ID NO: 76198 - DNA, 216 bp, Artificial Sequence
  Description of Artificial Sequence: Synthetic coding sequence
cagttcctggaccaggaggactggggcccccagagaaccagcaaggagatcagacagctgcagaacgactgcatgagactgagagagagcctgaacaccacccaggtgcacaacctggccctgggcgagaagctgcagaacctgcccaccctgctgtacaagagcctgaaggagggcgcccaggccatccaggaggaggcccaggccatccagtag

SEQ ID NO: 76199 - DNA, 1353 bp, Artificial Sequence
  Description of Artificial Sequence: Synthetic coding sequence
atggacgccagaagagtgccccagaaggacctgagagtgaagaagaacctgaagaagttcagatacgtgaagctgatcagcatggagaccagcagcagcagcgacgacagctgcgacagcttcgccagcgacaacttcgccaacaccaagcccaagttcagaagcgacatcagcgaggagctggccaacgtgttctacgaggacagcgacaacgagagcttctgcggcttcagcgagagcgaggtgcaggacgtgctggaccactgcggcttcctgcagaagcccagacccgacgtgaccaacgagctggccggcatcttccacgccgacagcgacgacgagagcttctgcggcttcagcgagagcgagatccaggacggcatgagactgcagagcgtgagagagggctgcagaaccagaagccagtgcagacacagcggccccctgagagtggccatgaagttccccgccagaagcaccagaggcgccaccaacaagaaggccgagagcagacagcccagcgagaacagcgtgaccgacagcaacagcgacagcgaggacgagagcggcatgaacttcctggagaagagagccctgaacatcaagcagaacaaggccatgctggccaagctgatgagcgagctggagagcttccccggcagcttcagaggcagacaccccctgcccggcagcgacagccagagcagaagacccagaagaagaaccttccccggcgtggccagcagaagaaaccccgagagaagagccagacccctgaccagaagcagaagcagaatcctgggcagcctggacgccctgcccatggaggaggaggaggaggaggacaagtacatgctggtgagaaagagaaagaccgtggacggctacatgaacgaggacgacctgcccagaagcagaagaagcagaagcagcgtgaccctgccccacatcatcagacccgtggaggagatcaccgaggaggagctggagaacgtgtgcagcaacagcagagagaagatctacaacagaagcctgggcagcacctgccaccagtgcagacagaagaccatcgacaccaagaccaactgcagaaaccccgactgctggggcgtgagaggccagttctgcggcccctgcctgagaaacagatacggcgaggaggtgagagacgccctgctggaccccaactggcactgccccccctgcagaggcatctgcaactgcagcttctgcagacagagagacggcagatgcgccaccggcgtgctggtgtacctggccaagtaccacggcttcggcaacgtgcacgcctacctgaagagcctgaagcaggagttcgagatgcaggcctag

SEQ ID NO: 76200 - DNA, 1116 bp, Artificial Sequence
  Description of Artificial Sequence: Synthetic coding sequence
atggacgccagaagagtgccccagaaggacctgagagtgaagaagaacctgaagaagttcagatacgtgaagctgatcagcatggagaccagcagcagcagcgacgacagctgcgacagcttcgccagcgacaacttcgccaacaccagactgcagagcgtgagagagggctgcagaaccagaagccagtgcagacacagcggccccctgagagtggccatgaagttccccgccagaagcaccagaggcgccaccaacaagaaggccgagagcagacagcccagcgagaacagcgtgaccgacagcaacagcgacagcgaggacgagagcggcatgaacttcctggagaagagagccctgaacatcaagcagaacaaggccatgctggccaagctgatgagcgagctggagagcttccccggcagcttcagaggcagacaccccctgcccggcagcgacagccagagcagaagacccagaagaagaaccttccccggcgtggccagcagaagaaaccccgagagaagagccagacccctgaccagaagcagaagcagaatcctgggcagcctggacgccctgcccatggaggaggaggaggaggaggacaagtacatgctggtgagaaagagaaagaccgtggacggctacatgaacgaggacgacctgcccagaagcagaagaagcagaagcagcgtgaccctgccccacatcatcagacccgtggaggagatcaccgaggaggagctggagaacgtgtgcagcaacagcagagagaagatctacaacagaagcctgggcagcacctgccaccagtgcagacagaagaccatcgacaccaagaccaactgcagaaaccccgactgctggggcgtgagaggccagttctgcggcccctgcctgagaaacagatacggcgaggaggtgagagacgccctgctggaccccaactggcactgccccccctgcagaggcatctgcaactgcagcttctgcagacagagagacggcagatgcgccaccggcgtgctggtgtacctggccaagtaccacggcttcggcaacgtgcacgcctacctgaagagcctgaagcaggagttcgagatgcaggcctag

SEQ ID NO: 76201 - DNA, 966 bp, Artificial Sequence
  Description of Artificial Sequence: Synthetic coding sequence
atggacgccagaagagtgccccagaaggacctgagagtgaagaagaacctgaagaagttcagatacgtgaagctgatcagcatggagaccagcagcagcagcgacgacagctgcgacagcttcgccagcgacaacttcgccaacaccagactgcagagcgtgagagagggctgcagaaccagaagccagtgcagacacagcggccccctgagagtggccatgaagttccccgccagaagcaccagaggcgccaccaacaagaaggccgagagcagacagcccagcgagaacagcgtgaccgacagcaacagcgacagcgaggacgagagcggcatgaacttcctggagaagagagccctgaacatcaagcagaacaaggccatgctggccaagctgatgagcgagctggagagcttccccggcagcttcagaggcagacaccccctgcccggcagcgacagccagagcagaagacccagaagaagaaccttccccggcgtggccagcagaagaaaccccgagagaagagccagacccctgaccagaagcagaagcagaatcctgggcagcctggacgccctgcccatggaggaggaggaggaggaggacaagtacatgctggtgagaaagagaaagaccgtggacggctacatgaacgaggacgacctgcccagaagcagaagaagcagaagcagcgtgaccctgccccacatcatcagacccgtggaggagatcaccgaggaggagctggagaacgtgtgcagcaacagcagagagaagatctacaacagaagcctgaactggcactgccccccctgcagaggcatctgcaactgcagcttctgcagacagagagacggcagatgcgccaccggcgtgctggtgtacctggccaagtaccacggcttcggcaacgtgcacgcctacctgaagagcctgaagcaggagttcgagatgcaggcctag

SEQ ID NO: 76202 - DNA, 1263 bp, Artificial Sequence
  Description of Artificial Sequence: Synthetic coding sequence
atggagaccctgagcagcgaggagagctgcgacagcttcgacagcctggagagcggcaagcagcaggacgtgagattccacagcaagtacttcaccgaggagctgagaagaatcttcatcgaggacaccgacagcgagaccgaggacttcgccggcttcacccagagcgacctgaacggcaagaccaaccccgaggtgatggtggtggagagcgacctgagcgacgacggcaaggccagcctggtgagcgaggaggaggaggacgaggaggaggacaaggccacccccagaagaagcagaagcagaagaagcagcatcggcctgagagtggccttccagttccccaccaagaagctggccaacaagcccgacaagaacagcagcagcgagcagctgttcagcagcgccagactgcagaacgagaagaagaccatcctggagagaaagaaggactgcagacaggtgatccagagagaggacagcaccagcgagagcgaggacgacagcagagacgagagccaggagagcagcgacgccctgctgaagagaaccatgaacatcaaggagaacaaggccatgctggcccagctgctggccgagctgaacagcatgcccgacttcttccccgtgagaacccccaccagcgccagcagaaagaagaccgtgagaagagccttcagcgagggccagatcaccagaagaatgaaccccaccagaagcgccagaccccccgagaagttcgccctggagaacttcaccgtgagcgccgccaagttcgccgaggagttctacagcttcagaagaagaaagaccatcggcggcaagtgcagagagtacagaagaagacacagaatcagcagcttcagacccgtggaggacatcaccgaggaggacctggagaacgtggccatcaccgtgagagacaagatctacgacaaggtgctgggcaacacctgccaccagtgcagacagaagaccatcgacaccaagaccgtgtgcagaaaccagggctgctgcggcgtgagaggccagttctgcggcccctgcctgagaaacagatacggcgaggacgtgagaagcgccctgctggaccccgactgggtgtgccccccctgcagaggcatctgcaactgcagctactgcagaaagagagacggcagatgcgccaccggcatcctgatccacctggccaagttctacggctacgacaacgtgaaggagtacctggagagcctgcagaaggagctggtggaggacaactag

SEQ ID NO: 76203 - DNA, 1227 bp, Artificial Sequence
  Description of Artificial Sequence: Synthetic coding sequence
atggagctggccaccagataccagatccccaaggaggtggccgacatcttcaacgcccccagcgacgacgaggagttcgtgggcttcagagacgacgtgcccatggagaccctgagcagcgaggagagctgcgacagcttcgacagcctggagagcggcaagcaggtggtggagagcgacctgagcgacgacggcaaggccagcctggtgagcgaggaggaggaggacgaggaggaggacaaggccacccccagaagaagcagaagcagaagaagcagcatcggcctgagagtggccttccagttccccaccaagaagctggccaacaagcccgacaagaacagcagcagcgagcagctgttcagcagcgccagactgcagaacgagaagaagaccatcctggagagaaagaaggactgcagacaggtgatccagagagaggacagcaccagcgagagcgaggacgacagcagagacgagagccaggagagcagcgacgccctgctgaagagaaccatgaacatcaaggagaacaaggccatgctggcccagctgctggccgagctgaacagcatgcccgacttcttccccgtgagaacccccaccagcgccagcagaaagaagaccgtgagaagagccttcagcgagggccagatcaccagaagaatgaaccccaccagaagcgccagaccccccgagaagttcgccctggagaacttcaccgtgagcgccgccaagttcgccgaggagttctacagcttcagaagaagaaagaccatcggcggcaagtgcagagagtacagaagaagacacagaatcagcagcttcagacccgtggaggacatcaccgaggaggacctggagaacgtggccatcaccgtgagagacaagatctacgacaaggtgctgggcaacacctgccaccagtgcagacagaagaccatcgacaccaagaccgtgtgcagaaaccagggctgctgcggcgtgagaggccagttctgcggcccctgcctgagaaacagatacggcgaggacgtgagaagcgccctgctggaccccgactgggtgtgccccccctgcagaggcatctgcaactgcagctactgcagaaagagagacggcagatgcgccaccggcatcctgatccacctggccaagttctacggctacgacaacgtgaaggagtacctggagagcctgcagaaggagctggtggaggacaactag

SEQ ID NO: 76204 - DNA, 1365 bp, Artificial Sequence
  Description of Artificial Sequence: Synthetic coding sequence
atggagctggccaccagataccagatccccaaggaggtggccgacatcttcaacgcccccagcgacgacgaggagttcgtgggcttcagagacgacgtgcccatggagaccctgagcagcgaggagagctgcgacagcttcgacagcctggagagcggcaagcagcaggacgtgagattccacagcaagtacttcaccgaggagctgagaagaatcttcatcgaggacaccgacagcgagaccgaggacttcgccggcttcacccagagcgacctgaacggcaagaccaaccccgaggtgatggtggtggagagcgacctgagcgacgacggcaaggccagcctggtgagcgaggaggaggaggacgaggaggaggacaaggccacccccagaagaagcagaagcagaagaagcagcatcggcctgagagtggccttccagttccccaccaagaagctggccaacaagcccgacaagaacagcagcagcgagcagctgttcagcagcgccagactgcagaacgagaagaagaccatcctggagagaaagaaggactgcagacaggtgatccagagagaggacagcaccagcgagagcgaggacgacagcagagacgagagccaggagagcagcgacgccctgctgaagagaaccatgaacatcaaggagaacaaggccatgctggcccagctgctggccgagctgaacagcatgcccgacttcttccccgtgagaacccccaccagcgccagcagaaagaagaccgtgagaagagccttcagcgagggccagatcaccagaagaatgaaccccaccagaagcgccagaccccccgagaagttcgccctggagaacttcaccgtgagcgccgccaagttcgccgaggagttctacagcttcagaagaagaaagaccatcggcggcaagtgcagagagtacagaagaagacacagaatcagcagcttcagacccgtggaggacatcaccgaggaggacctggagaacgtggccatcaccgtgagagacaagatctacgacaaggtgctgggcaacacctgccaccagtgcagacagaagaccatcgacaccaagaccgtgtgcagaaaccagggctgctgcggcgtgagaggccagttctgcggcccctgcctgagaaacagatacggcgaggacgtgagaagcgccctgctggaccccgactgggtgtgccccccctgcagaggcatctgcaactgcagctactgcagaaagagagacggcagatgcgccaccggcatcctgatccacctggccaagttctacggctacgacaacgtgaaggagtacctggagagcctgcagaaggagctggtggaggacaactag

SEQ ID NO: 76205 - DNA, 291 bp, Artificial Sequence
  Description of Artificial Sequence: Synthetic coding sequence
atggagaccctgagcagcgaggagagctgcgacagcttcgacagcctggagagcggcaagcagcaggacgtgagattccacagcaagtacttcaccgaggagctgagaagaatcttcatcgaggacaccgacagcgagaccgaggacttcgccggcttcacccagagcgacctgaacggcaagaccaaccccgaggtgatggtggtggagagcgacctgagcgacgacggcaaggccagcctggtgagcgaggaggaggaggacgaggaggaggacaaggccaccccctag

SEQ ID NO: 76206 - DNA, 843 bp, Artificial Sequence
  Description of Artificial Sequence: Synthetic coding sequence
atggcccccagaaagggcagcagcagagtggccaagaccaacagcctgagaagaagaaagctggccagcttcctgaaggacttcgacagagaggtggagatcagaatcaagcagatcgagagcgacagacagaacctgctgaaggaggtggacaacctgtacaacatcgagatcctgagactgcccaaggccctgagagagatgaactggctggactacttcgccctgggcggcaacaagcaggccctggaggaggccgccaccgccgacctggacatcaccgagatcaacaagctgaccgccgaggccatccagacccccctgaagagcgccaagaccagaaaggtgatccaggtggacgagatgatcgtggaggaggaggaggaggaggagaacgagagaaagaacctgcagaccgccagagtgaagagatgcccccccagcaagaagagaacccagagcatccagggcaagggcaagggcaagagaagcagcagagccaacaccgtgacccccgccgtgggcagactggaggtgagcatggtgaagcccacccccggcctgacccccagattcgacagcagagtgttcaagacccccggcctgagaacccccgccgccggcgagagaatctacaacatcagcggcaacggcagccccctggccgacagcaaggagatcttcctgaccgtgcccgtgggcggcggcgagagcctgagactgctggccagcgacctgcagagacacagcatcgcccagctggaccccgaggccctgggcaacatcaagaagctgagcaacagactggcccagatctgcagcagcatcagaacccacaagtag

SEQ ID NO: 76207 - DNA, 843 bp, Artificial Sequence; identical to SEQ ID NO: 76206
  Description of Artificial Sequence: Synthetic coding sequence

SEQ ID NO: 76208 - DNA, 414 bp, Artificial Sequence
  Description of Artificial Sequence: Synthetic coding sequence
atgcccaacttcgccggcacctggaagatgagaagcagcgagaacttcgacgagctgctgaaggccctgggcgtgaacgccatgctgagaaaggtggccgtggccgccgccagcaagccccacgtggagatcagacaggacggcgaccagttctacatcaagaccagcaccaccgtgagaaccaccgagatcaacttcaaggtgggcgagggcttcgaggaggagaccgtggacggcagaaagtgcagaagcctggccacctgggagaacgagaacaagatccactgcacccagaccctgctggagggcgacggccccaagacctactggaccagagagctggccaacgacgagctgatcctgaccttcggcgccgacgacgtggtgtgcaccagaatctacgtgagagagtag

SEQ ID NO: 76209 - DNA, 249 bp, Artificial Sequence
  Description of Artificial Sequence: Synthetic coding sequence
atgcccaacttcagcggcaactggaagatcatcagaagcgagaacttcgaggagctgctgaaggtgctgggcgtgaacgtgatgctgagaaagatcgccgtggccgccgccagcaagcccgccgtggagatcaagcaggagggcgacaccttctacatcaagaccagcaccaccgtgagaaccaccgagatcaacttcaaggtgggcgaggagttcgaggagcagaccgtggacggcagaccctgctag

SEQ ID NO: 76210 - DNA, 417 bp, Artificial Sequence
  Description of Artificial Sequence: Synthetic coding sequence
atgcccaacttcagcggcaactggaagatcatcagaagcgagaacttcgaggagctgctgaaggtgctgggcgtgaacgtgatgctgagaaagatcgccgtggccgccgccagcaagcccgccgtggagatcaagcaggagggcgacaccttctacatcaagaccagcaccaccgtgagaaccaccgagatcaacttcaaggtgggcgaggagttcgaggagcagaccgtggacggcagaccctgcaagagcctggtgaagtgggagagcgagaacaagatggtgtgcgagcagaagctgctgaagggcgagggccccaagaccagctggaccagagagctgaccaacgacggcgagctgatcctgaccatgaccgccgacgacgtggtgtgcaccagagtgtacgtgagagagtag

SEQ ID NO: 76211 - DNA, 417 bp, Artificial Sequence; identical to SEQ ID NO: 76210
  Description of Artificial Sequence: Synthetic coding sequence

SEQ ID NO: 76212 - DNA, 744 bp, Artificial Sequence
  Description of Artificial Sequence: Synthetic coding sequence
atgggcaccagcagcaccgacagccagcaggccggccacagaagatgcagcaccagcaacaccagcgccgagaacctgacctgcctgagcctgcccggcagccccggcaagaccgcccccctgcccggccccgcccaggccggcgccggccagcccctgcccaagggctgcgccgccgtgaaggccgaggtgggcatccccgccccccacaccagccaggaggtgagaatccacatcagaagactgctgagctgggccgcccccggcgcctgcggcctgagaagcaccccctgcgccctgccccaggccctgccccaggccagaccctgccccggcagatggttcttccccggctgcagcctgcccaccggcggcgcccagaccatcctgagcctgtggacctggagacacttcctgaactgggccctgcagcagagagaggagaacagcggcagagccagaagagtgccccccgtgcccagaaccgcccccgtgagcaagggcgagggcagccaccccccccagaacagcaacggcgagaaggtgaagaccatcacccccgacgtgggcctgcaccagagcctgaccagcgaccccaccgtggccgtgctgagagccaagagagcccccgaggcccacccccccagaagctgcagcggcagcctgaccgccagagtgtgccacatgggcgtgtgccagggccagggcgacaccgaggacggcagaatgaccctgatgggctag

SEQ ID NO: 76213 - DNA, 744 bp, Artificial Sequence; identical to SEQ ID NO: 76212
  Description of Artificial Sequence: Synthetic coding sequence

SEQ ID NO: 76214 - DNA, 4218 bp, Artificial Sequence
  Description of Artificial Sequence: Synthetic coding sequence
atggccgccagaagcccccccagcccccaccccagcccccccgccagacagctgggccccagaagccccagagtgggcagaggcgccgaggtgcacgccatgagaagcgaggccagcggcttcgccggcgccgccagagaggtggtggccgacgagagcgacaagatctgggtgggcgaggagggcagcggcggcagaagaggccccggcggcgccgcccccgcccacgcccccctgctgagcgcccccatgggcagcagaagactggagggcatcagcgtggaggaggccatggtgaccagaacccagctgctggaggaggagctgagcagcctgaaggaggagctggccctgtgccaggccgacaaggagttcgtgtggagcctgtggaagagactgcaggtgaccaaccccgacctgacccaggtggtgagcctggtggtggagagagagaagcagaagagcgaggccaaggacagaaaggtgctggagatcctgcaggtgaaggacgccaagatccaggagttcgagcagagagagagcgtgctgaagcaggagatcaacgacctggtgaagagaaagatcgccgtggacgaggagaacgccttcctgagaaaggagttcagcgacctggagaagaagttcaaggacaagagccaggagatcaaggacaccaaggagtgcgtgcagaacaaggaggagcagaacagactggtgatcaagaacctggaggaggagaacaagaagctgagcaccagatgcaccgacctgctgaacgacctggagaagctgagaaagcaggaggcccacctgagaaaggagaagtacagcaccgacgccaagatcaagaccttcgaggacaacctgatcgaggccagaaaggaggtggaggtgagccagagcaagtacaacgccctgagcctgcagctgagcaacaagcagaccgagctgatccagaaggacatggacatcaccctggtgagacaggagctgcaggagctgcagaacctgtacaagcagaacagcacccacaccgcccagcaggccgagctgatccagcagctgcaggtgctgaacatggacacccagaaggtgctgagaaaccaggaggacgtgcacaccgccgagagcatcagctaccagaagctgtacaacgagctgcacatctgcttcgagaccaccaagagcaacgaggccatgctgagacagagcgtgaccaacctgcaggaccagctgctgcagaaggagcaggagaacgccaagctgaaggagaagctgcaggagagccagggcgcccccctgcccctgccccaggagagcgaccccgactacagcgcccaggtgccccacagacccagcctgagcagcctggagaccctgatggtgagccagaagagcgagatcgagtacctgcaggagaagctgaagatcgccaacgagaagctgagcgagaacatcagcgccaacaagggcttcagcagaaagagcatcatgaccagcgccgagggcaagcacaaggagccccccgtgaagagaagcagaagcctgagccccaagagcagcttcaccgacagcgaggagctgcagaagctgagaaaggccgagagaaagatcgagaacctggagaaggccctgcagctgaagagccaggagaacgacgagctgagagacgcccacgagaagagaaaggagagactgcagatgctgcagaccaactacagagccgtgaaggagcagctgaagcagtgggaggagggcagcggcatgaccgagatcagaaagatcaagagagccgacccccagcagctgagacaggaggacagcgacgccgtgtggaacgagctggcctacttcaagagagagaaccaggagctgatgatccagaagatgaacctggaggaggagctggacgagctgaaggtgcacatcagcatcgacaaggccgccatccaggagctgaacagatgcgtggccgagagaagagaggagcagctgttcagaagcggcgaggacgacgaggtgaagagaagcacccccgagaagaacggcaaggagatgctggagcagaccctgcagaaggtgaccgagctggagaacagactgaagagcttcgagaagagaagcagaaagctgaaggagggcaacaagaagctgatgaaggagaacgacttcctgaagagcctgctgaagcagcagcaggaggacaccgagaccagagagaaggagctggagcagatcatcaagggcagcaaggacgtggagaaggagaacaccgagctgcaggtgaagatcagcgagctggagaccgaggtgaccagcctgagaagacaggtggccgaggccaacgccctgagaaacgagaacgaggagctgatcaaccccatggagaagagccaccagagcgccgacagagccaagagcgagatggccaccatgaaggtgagaagcggcagatacgactgcaagaccaccatgaccaaggtgaagttcaaggccgccaagaagaactgcagcgtgggcagacaccacaccgtgctgaaccacagcatcaaggtgatgagcaacgtgttcgagaacctgagcaaggacggctgggaggacgtgagcgagagcagcagcgacagcgaggcccagaccagccagaccctgggcaccatcatcgtggagaccagccagaagatcagccccaccgaggacggcaaggaccagaaggagagcgaccccaccgaggacagccagacccagggcaaggagatcgtgcagacctacctgaacatcgacggcaagacccccaaggactacttccacgacaagaacgccaagaagcccaccttccagaagaagaactgcaagatgcagaagagcagccacaccgccgtgcccaccagagtgaacagagagaagtacaagaacatcaccgcccagaagagcagcagcaacatcatcctgctgagagagagaatcatcagcctgcagcagcagaacagcgtgctgcagaacgccaagaagaccgccgagctgagcgtgaaggagtacaaggaggtgaacgagaagctgctgcaccagcagcaggtgagcgaccagagattccagaccagcagacagaccatcaagaagctgaacctggacctggccggcctgagaaaggagaaggaggacctgctgaagaagctggagagcagcagcgagatcaccagcctggccgaggagaacagccaggtgaccttccccagaatccaggtgaccagcctgagccccagcagaagcatggacctggagatgaagcagctgcagtacaagctgaagaacgccaccaacgagctgaccaagcagagcagcaacgtgaagaccctgaagttcgagctgctggccaaggaggagcacatcaaggagatgcacgagaagatcagcagaatggagagagacatcaccatgaagagacacctgatcgaggacctgaagttcagacagaaggtgaacctggagagcaacaagagcttcagcgagatgctgcagaacctggacaagaaggtgaagaccctgaccgaggagtgcagcaacaagaaggtgagcatcgacagcctgaagcagagactgaacgtggccgtgaaggagaagagccagtacgagcagatgtaccagaagagcaaggaggagctggagaagaaggacctgaagctgaccctgctggtgagcagaatcagcgagaccgagagcgccatggccgagatcgagaccgccgccagcaagcagctgcaggagctggccctgcagagcgagcaggtgctggagggcgcccagaagaccctgctgctggccaacgagaaggtggaggagttcaccaccttcgtgaaggccctggccaaggagctgcagaacgacgtgcacgtggtgagaagacagatcagagagctgaagaagatgaagaagaacagagacgcctgcaagaccagcacccacaaggcccagaccctggccgccagcatcctgaacatcagcagaagcgacctggaggagatcctggacaccgaggaccaggtggagatcgagaagaccaagatcgacgccgagaacgacaaggagtggatgctgtacatccagaagctgctggagggccagagcctggccctgagccccagactgaagtgcaacggcgccatcgtggcccaccagaacctgagactgcccgacagcagcagcagcgccagcgccagctag

SEQ ID NO: 76215 - DNA, 1176 bp, Artificial Sequence
  Description of Artificial Sequence: Synthetic coding sequence
atggccgccagaagcccccccagcccccaccccagcccccccgccagacagctgggccccagaagccccagagtgggcagaggcgccgaggtgcacgccatgagaagcgaggccagcggcttcgccggcgccgccagagaggtggtggccgacgagagcgacaagatctgggtgggcgaggagggcagcggcggcagaagaggccccggcggcgccgcccccgcccacgcccccctgctgagcgcccccatgggcagcagaagactggagggcatcagcgtggaggaggccatggtgaccagaacccagctgctggaggaggagctgagcagcctgaaggaggagctggccctgtgccaggccgacaaggagttcgtgtggagcctgtggaagagactgcaggtgaccaaccccgacctgacccaggtggtgagcctggtggtggagagagagaagcagaagagcgaggccaaggacagaaaggtgctggagatcctgcaggtgaaggacgccaagatccaggagttcgagcagagagagagcgtgctgaagcaggagatcaacgacctggtgaagagaaagatcgccgtggacgaggagaacgccttcctgagaaaggagttcagcgacctggagaagaagttcaaggacaagagccaggagatcaaggacaccaaggagtgcgtgcagaacaaggaggagcagaacagactggtgatcaagaacctggaggaggagaacaagaagctgagcaccagatgcaccgacctgctgaacgacctggagaagctgagaaagcaggaggcccacctgagaaaggagaagtacagcaccgacgccaagatcaagaccttcgaggacaacctgatcgaggccagaaaggaggtggaggtgagccagagcaagtacaacgccctgagcctgcagctgagcaacaagcagaccgagctgatccagaaggacatggacatcaccctggtgagaaaggagctgcaggagctgcagaacctgtacaagcagaacagcacccacaccgcccagcaggccgagctgatccagcagctgcaggtgctgaacatggacacccagaaggtgctgagaaaccaggaggacgtgcacaccgccgagagcatcagctaccagaaggtgtgcttctacagcgtgatcaagatgtag

SEQ ID NO: 76216 - DNA, 4221 bp, Artificial Sequence
  Description of Artificial Sequence: Synthetic coding sequence
atggccgccagaagcccccccagcccccaccccagcccccccgccagacagctgggccccagaagccccagagtgggcagaggcgccgaggtgcacgccatgagaagcgaggccagcggcttcgccggcgccgccagagaggtggtggccgacgagagcgacaagatctgggtgggcgaggagggcagcggcggcagaagaggccccggcggcgccgcccccgcccacgcccccctgctgagcgcccccatgggcagcagaagactggagggcatcagcgtggaggaggccatggtgaccagaacccagctgctggaggaggagctgagcagcctgaaggaggagctggccctgtgccaggccgacaaggagttcgtgtggagcctgtggaagagactgcaggtgaccaaccccgacctgacccaggtggtgagcctggtggtggagagagagaagcagaagagcgaggccaaggacagaaaggtgctggagatcctgcaggtgaaggacgccaagatccaggagttcgagcagagagagagcgtgctgaagcaggagatcaacgacctggtgaagagaaagatcgccgtggacgaggagaacgccttcctgagaaaggagttcagcgacctggagaagaagttcaaggacaagagccaggagatcaaggacaccaaggagtgcgtgcagaacaaggaggagcagaacagactggtgatcaagaacctggaggaggagaacaagaagctgagcaccagatgcaccgacctgctgaacgacctggagaagctgagaaagcaggaggcccacctgagaaaggagaagtacagcaccgacgccaagatcaagaccttcgaggacaacctgatcgaggccagaaaggaggtggaggtgagccagagcaagtacaacgccctgagcctgcagctgagcaacaagcagaccgagctgatccagaaggacatggacatcaccctggtgagaaaggagctgcaggagctgcagaacctgtacaagcagaacagcacccacaccgcccagcaggccgagctgatccagcagctgcaggtgctgaacatggacacccagaaggtgctgagaaaccaggaggacgtgcacaccgccgagagcatcagctaccagaagctgtacaacgagctgcacatctgcttcgagaccaccaagagcaacgaggccatgctgagacagagcgtgaccaacctgcaggaccagctgctgcagaaggagcaggagaacgccaagctgaaggagaagctgcaggagagccagggcgcccccctgcccctgccccaggagagcgaccccgactacagcgcccaggtgccccacagacccagcctgagcagcctggagaccctgatggtgagccagaagagcgagatcgagtacctgcaggagaagctgaagatcgccaacgagaagctgagcgagaacatcagcgccaacaagggcttcagcagaaagagcatcatgaccagcgccgagggcaagcacaaggagccccccgtgaagagaagcagaagcctgagccccaagagcagcttcaccgacagcgaggagctgcagaagctgagaaaggccgagagaaagatcgagaacctggagaaggccctgcagctgaagagccaggagaacgacgagctgagagacgcccacgagaagagaaaggagagactgcagatgctgcagaccaactacagagccgtgaaggagcagctgaagcagtgggaggagggcagcggcatgaccgagatcagaaagatcaagagagccgacccccagcagctgagacaggaggacagcgacgccgtgtggaacgagctggcctacttcaagagagagaaccaggagctgatgatccagaagatgaacctggaggaggagctggacgagctgaaggtgcacatcagcatcgacaaggccgccatccaggagctgaacagatgcgtggccgagagaagagaggagcagctgttcagaagcggcgaggacgacgaggtgaagagaagcacccccgagaagaacggcaaggagatgctggagcagaccctgcagaaggtgaccgagctggagaacagactgaagagcttcgagaagagaagcagaaagctgaaggagggcaacaagaagctgatgaaggagaacgacttcctgaagagcctgctgaagcagcagcaggaggacaccgagaccagagagaaggagctggagcagatcatcaagggcagcaaggacgtggagaaggagaacaccgagctgcaggtgaagatcagcgagctggagaccgaggtgaccagcctgagaagacaggtggccgaggccaacgccctgagaaacgagaacgaggagctgatcaaccccatggagaagagccaccagagcgccgacagagccaagagcgagatggccaccatgaaggtgagaagcggcagatacgactgcaagaccaccatgaccaaggtgaagttcaaggccgccaagaagaactgcagcgtgggcagacaccacaccgtgctgaaccacagcatcaaggtgatgagcaacgtgttcgagaacctgagcaaggacggctgggaggacgtgagcgagagcagcagcgacagcgaggcccagaccagccagaccctgggcaccatcatcgtggagaccagccagaagatcagccccaccgaggacggcaaggaccagaaggagagcgaccccaccgaggacagccagacccagggcaaggagatcgtgcagacctacctgaacatcgacggcaagacccccaaggactacttccacgacaagaacgccaagaagcccaccttccagaagaagaactgcaagatgcagaagagcagccacaccgccgtgcccaccagagtgaacagagagaagtacaagaacatcaccgcccagaagagcagcagcaacatcatcctgctgagagagagaatcatcagcctgcagcagcagaacagcgtgctgcagaacgccaagaagaccgccgagctgagcgtgaaggagtacaaggaggtgaacgagaagctgctgcaccagcagcaggtgagcgaccagagattccagaccagcagacagaccatcaagaagctgaacctggacctggccggcctgagaaaggagaaggaggacctgctgaagaagctggagagcagcagcgagatcaccagcctggccgaggagaacagccaggtgaccttccccagaatccaggtgaccagcctgagccccagcagaagcatggacctggagatgaagcagctgcagtacaagctgaagaacgccaccaacgagctgaccaagcagagcagcaacgtgaagaccctgaagttcgagctgctggccaaggaggagcacatcaaggagatgcacgagaagatcagcagaatggagagagacatcaccatgaagagacacctgatcgaggacctgaagttcagacagaaggtgaacctggagagcaacaagagcttcagcgagatgctgcagaacctggacaagaaggtgaagaccctgaccgaggagtgcagcaacaagaaggtgagcatcgacagcctgaagcagagactgaacgtggccgtgaaggagaagagccagtacgagcagatgtaccagaagagcaaggaggagctggagaagaaggacctgaagctgaccctgctggtgagcagaatcagcgagaccgagagcgccatggccgagatcgagaccgccgccagcaagcagctgcaggagctggccctgcagagcgagcaggtgctggagggcgcccagaagaccctgctgctggccaacgagaaggtggaggagttcaccaccttcgtgaaggccctggccaaggagctgcagaacgacgtgcacgtggtgagaagacagatcagagagctgaagaagatgaagaagaacagagacgcctgcaagaccagcacccacaaggcccagaccctggccgccagcatcctgaacatcagcagaagcgacctggaggagatcctggacaccgaggaccaggtggagatcgagaagaccaagatcgacgccgagaacgacaaggagtggatgctgtacatccagaagctgctggagggccagctgcccttcgccagctacctgctggaggccgtgctggagaagatcaacgagaagaagaagctggtggagggctacttcaccatcatgaaggacatcagatag

SEQ ID NO: 76217 - DNA, 4221 bp, Artificial Sequence
  Description of Artificial Sequence: Synthetic coding sequence
atggccgccagaagcccccccagcccccaccccagcccccccgccagacagctgggccccagaagccccagagtgggcagaggcgccgaggtgcacgccatgagaagcgaggccagcggcttcgccggcgccgccagagaggtggtggccgacgagagcgacaagatctgggtgggcgaggagggcagcggcggcagaagaggccccggcggcgccgcccccgcccacgcccccctgctgagcgcccccatgggcagcagaagactggagggcatcagcgtggaggaggccatggtgaccagaacccagctgctggaggaggagctgagcagcctgaaggaggagctggccctgtgccaggccgacaaggagttcgtgtggagcctgtggaagagactgcaggtgaccaaccccgacctgacccaggtggtgagcctggtggtggagagagagaagcagaagagcgaggccaaggacagaaaggtgctggagatcctgcaggtgaaggacgccaagatccaggagttcgagcagagagagagcgtgctgaagcaggagatcaacgacctggtgaagagaaagatcgccgtggacgaggagaacgccttcctgagaaaggagttcagcgacctggagaagaagttcaaggacaagagccaggagatcaaggacaccaaggagtgcgtgcagaacaaggaggagcagaacagactggtgatcaagaacctggaggaggagaacaagaagctgagcaccagatgcaccgacctgctgaacgacctggagaagctgagaaagcaggaggcccacctgagaaaggagaagtacagcaccgacgccaagatcaagaccttcgaggacaacctgatcgaggccagaaaggaggtggaggtgagccagagcaagtacaacgccctgagcctgcagctgagcaacaagcagaccgagctgatccagaaggacatggacatcaccctggtgagacaggagctgcaggagctgcagaacctgtacaagcagaacagcacccacaccgcccagcaggccgagctgatccagcagctgcaggtgctgaacatggacacccagaaggtgctgagaaaccaggaggacgtgcacaccgccgagagcatcagctaccagaagctgtacaacgagctgcacatctgcttcgagaccaccaagagcaacgaggccatgctgagacagagcgtgaccaacctgcaggaccagctgctgcagaaggagcaggagaacgccaagctgaaggagaagctgcaggagagccagggcgcccccctgcccctgccccaggagagcgaccccgactacagcgcccaggtgccccacagacccagcctgagcagcctggagaccctgatggtgagccagaagagcgagatcgagtacctgcaggagaagctgaagatcgccaacgagaagctgagcgagaacatcagcgccaacaagggcttcagcagaaagagcatcatgaccagcgccgagggcaagcacaaggagccccccgtgaagagaagcagaagcctgagccccaagagcagcttcaccgacagcgaggagctgcagaagctgagaaaggccgagagaaagatcgagaacctggagaaggccctgcagctgaagagccaggagaacgacgagctgagagacgcccacgagaagagaaaggagagactgcagatgctgcagaccaactacagagccgtgaaggagcagctgaagcagtgggaggagggcagcggcatgaccgagatcagaaagatcaagagagccgacccccagcagctgagacaggaggacagcgacgccgtgtggaacgagctggcctacttcaagagagagaaccaggagctgatgatccagaagatgaacctggaggaggagctggacgagctgaaggtgcacatcagcatcgacaaggccgccatccaggagctgaacagatgcgtggccgagagaagagaggagcagctgttcagaagcggcgaggacgacgaggtgaagagaagcacccccgagaagaacggcaaggagatgctggagcagaccctgcagaaggtgaccgagctggagaacagactgaagagcttcgagaagagaagcagaaagctgaaggagggcaacaagaagctgatgaaggagaacgacttcctgaagagcctgctgaagcagcagcaggaggacaccgagaccagagagaaggagctggagcagatcatcaagggcagcaaggacgtggagaaggagaacaccgagctgcaggtgaagatcagcgagctggagaccgaggtgaccagcctgagaagacaggtggccgaggccaacgccctgagaaacgagaacgaggagctgatcaaccccatggagaagagccaccagagcgccgacagagccaagagcgagatggccaccatgaaggtgagaagcggcagatacgactgcaagaccaccatgaccaaggtgaagttcaaggccgccaagaagaactgcagcgtgggcagacaccacaccgtgctgaaccacagcatcaaggtgatgagcaacgtgttcgagaacctgagcaaggacggctgggaggacgtgagcgagagcagcagcgacagcgaggcccagaccagccagaccctgggcaccatcatcgtggagaccagccagaagatcagccccaccgaggacggcaaggaccagaaggagagcgaccccaccgaggacagccagacccagggcaaggagatcgtgcagacctacctgaacatcgacggcaagacccccaaggactacttccacgacaagaacgccaagaagcccaccttccagaagaagaactgcaagatgcagaagagcagccacaccgccgtgcccaccagagtgaacagagagaagtacaagaacatcaccgcccagaagagcagcagcaacatcatcctgctgagagagagaatcatcagcctgcagcagcagaacagcgtgctgcagaacgccaagaagaccgccgagctgagcgtgaaggagtacaaggaggtgaacgagaagctgctgcaccagcagcaggtgagcgaccagagattccagaccagcagacagaccatcaagaagctgaacctggacctggccggcctgagaaaggagaaggaggacctgctgaagaagctggagagcagcagcgagatcaccagcctggccgaggagaacagccaggtgaccttccccagaatccaggtgaccagcctgagccccagcagaagcatggacctggagatgaagcagctgcagtacaagctgaagaacgccaccaacgagctgaccaagcagagcagcaacgtgaagaccctgaagttcgagctgctggccaaggaggagcacatcaaggagatgcacgagaagatcagcagaatggagagagacatcaccatgaagagacacctgatcgaggacctgaagttcagacagaaggtgaacctggagagcaacaagagcttcagcgagatgctgcagaacctggacaagaaggtgaagaccctgaccgaggagtgcagcaacaagaaggtgagcatcgacagcctgaagcagagactgaacgtggccgtgaaggagaagagccagtacgagcagatgtaccagaagagcaaggaggagctggagaagaaggacctgaagctgaccctgctggtgagcagaatcagcgagaccgagagcgccatggccgagatcgagaccgccgccagcaagcagctgcaggagctggccctgcagagcgagcaggtgctggagggcgcccagaagaccctgctgctggccaacgagaaggtggaggagttcaccaccttcgtgaaggccctggccaaggagctgcagaacgacgtgcacgtggtgagaagacagatcagagagctgaagaagatgaagaagaacagagacgcctgcaagaccagcacccacaaggcccagaccctggccgccagcatcctgaacatcagcagaagcgacctggaggagatcctggacaccgaggaccaggtggagatcgagaagaccaagatcgacgccgagaacgacaaggagtggatgctgtacatccagaagctgctggagggccagctgcccttcgccagctacctgctggaggccgtgctggagaagatcaacgagaagaagaagctggtggagggctacttcaccatcatgaaggacatcagatag

SEQ ID NO: 76218 - DNA, 519 bp, Artificial Sequence
  Description of Artificial Sequence: Synthetic coding sequence
atggccagcggcttcaagaagcccagcgccgccagcaccggccagaagagaaaggtggcccccaagcccgagctgaccgaggaccagaagcaggaggtgagagaggccttcgacctgttcgacgtggacggcagcggcaccatcgacgccaaggagctgaaggtggccatgagagccctgggcttcgagcccagaaaggaggagatgaagaagatgatcagcgaggtggacagagagggcaccggcaagatcagcttcaacgacttcctggccgtgatgacccagaagatgagcgagaaggacaccaaggaggagatcctgaaggccttcagactgttcgacgacgacgagaccggcaagatcagcttcaagaacctgaagagagtggccaacgagctgggcgagaacctgaccgacgaggagctgcaggagatgatcgacgaggccgacagagacggcgacggcgaggtgaacgaggaggagttcctgagaatcatgaagaagaccagcctgtactag

SEQ ID NO: 76219 - DNA, 519 bp, Artificial Sequence
  Description of Artificial Sequence: Synthetic coding sequence
atggccagcaacttcaagaaggccaacatggccagcagcagccagagaaagagaatgagccccaagcccgagctgaccgaggagcagaagcaggagatcagagaggccttcgacctgttcgacgccgacggcaccggcaccatcgacgtgaaggagctgaaggtggccatgagagccctgggcttcgagcccaagaaggaggagatcaagaagatgatcagcgagatcgacaaggagggcaccggcaagatgaacttcggcgacttcctgaccgtgatgacccagaagatgagcgagaaggacaccaaggaggagatcctgaaggccttcaagctgttcgacgacgacgagaccggcaagatcagcttcaagaacctgaagagagtggccaaggagctgggcgagaacctgaccgacgaggagctgcaggagatgatcgacgaggccgacagagacggcgacggcgaggtgagcgagcaggagttcctgagaatcatgaagaagaccagcctgtactag

SEQ ID NO: 76220 - DNA, 378 bp, Artificial Sequence
  Description of Artificial Sequence: Synthetic coding sequence
atggccatgcaggccgccaagagagccaacatcagactgccccccgaggtgaacagaatcctgtacatcagaaacctgccctacaagatcaccgccgaggagatgtacgacatcttcggcaagtacggccccatcagacagatcagagtgggcaacacccccgagaccagaggcaccgcctacgtggtgtacgaggacatcttcgacgccaagaacgcctgcgaccacctgagcggcttcaacgtgtgcaacagatacctggtggtgctgtactacaacgccaacagagccttccagaagatggacaccaagaagaaggaggagcagctgaagctgctgaaggagaagtacggcatcaacaccgacccccccaagtag

SEQ ID NO: 76221 - DNA, 423 bp, Artificial Sequence
  Description of Artificial Sequence: Synthetic coding sequence
atgggccccagaagaagaagcagaaagcccgaggcccccagaagaagaagccccagccccacccccacccccggccccagcagaagaggccccagcctgggcgccagcagccaccagcacagcagaagaagacagggctggctgaaggagatcagaaagctgcagaagagcacccacctgctgatcagaaagctgcccttcagcagactggccagagagatctgcgtgaagttcaccagaggcgtggacttcaactggcaggcccaggccctgctggccctgcaggaggccgccgaggccttcctggtgcacctgttcgaggacgcctacctgctgaccctgcacgccggcagagtgaccctgttccccaaggacgtgcagctggccagaagaatcagaggcctggaggagggcctgggctag

SEQ ID NO: 76222 - DNA, 1800 bp, Artificial Sequence
  Description of Artificial Sequence: Synthetic coding sequence
atgggccccaagagaagacagctgaccttcagagagaagagcagaatcatccaggaggtggaggagaaccccgacctgagaaagggcgagatcgccagaagattcaacatcccccccagcaccctgagcaccatcctgaagaacaagagagccatcctggccagcgagagaaagtacggcgtggccagcacctgcagaaagaccaacaagctgagcccctacgacaagctggagggcctgctgatcgcctggttccagcagatcagagccgccggcctgcccgtgaagggcatcatcctgaaggagaaggccctgagaatcgccgaggagctgggcatggacgacttcaccgccagcaacggctggctggacagattcagaagaagacacggcgtggtgagctgcagcggcgtggccagagccagagccagaaacgccgcccccagaacccccgccgcccccgccagccccgccgccgtgcccagcgagggcagcggcggcagcaccaccggctggagagccagagaggagcagccccccagcgtggccgagggctacgccagccaggacgtgttcagcgccaccgagaccagcctgtggtacgacttcctgcccgaccaggccgccggcctgtgcggcggcgacggcagacccagacaggccacccagagactgagcgtgctgctgtgcgccaacgccgacggcagcgagaagctgccccccctggtggccggcaagagcgccaagcccagagccggccaggccggcctgccctgcgactacaccgccaacagcaagggcggcgtgaccacccaggccctggccaagtacctgaaggccctggacaccagaatggccgccgagagcagaagagtgctgctgctggccggcagactggccgcccagagcctggacaccagcggcctgagacacgtgcagctggccttcttcccccccggcaccgtgcaccccctggagagaggcgtggtgcagcaggtgaagggccactacagacaggccatgctgctgaaggccatggccgccctggagggccaggaccccagcggcctgcagctgggcctgaccgaggccctgcacttcgtggccgccgcctggcaggccgtggagcccagcgacatcgccgcctgcttcagagaggccggcttcggcggcggccccaacgccaccatcaccaccagcctgaagagcgagggcgaggaggaggaggaggaggaggaggaggaggaggaggaggagggcgagggcgaggaggaggaggaggagggcgaggaggaggaggaggagggcggcgagggcgaggagctgggcgaggaggaggaggtggaggaggagggcgacgtggacagcgacgaggaggaggaggaggacgaggagagcagcagcgagggcctggaggccgaggactgggcccagggcgtggtggaggccggcggcagcttcggcgcctacggcgcccaggaggaggcccagtgccccaccctgcacttcctggagggcggcgaggacagcgacagcgacagcgaggaggaggacgacgaggaggaggacgacgaggacgaggacgacgacgacgacgaggaggacggcgacgaggtgcccgtgcccagcttcggcgaggccatggcctacttcgccatggtgaagagatacctgaccagcttccccatcgacgacagagtgcagagccacatcctgcacctggagcacgacctggtgcacgtgaccagaaagaaccacgccagacaggccggcgtgagaggcctgggccaccagagctag

SEQ ID NO: 76223 - DNA, 417 bp, Artificial Sequence
  Description of Artificial Sequence: Synthetic coding sequence
gaggacgaggagagcagcagcgagggcctggaggccgaggactgggcccagggcgtggtggaggccggcggcagcttcggcgcctacggcgcccaggaggaggcccagtgccccaccctgcacttcctggagggcggcgaggacagcgacagcgacagcgaggaggaggacgacgaggaggaggacgacgaggacgaggacgacgacgacgacgaggaggacggcgacgaggtgcccgtgcccagcttcggcgaggccatggcctacttcgccatggtgaagagatacctgaccagcttccccatcgacgacagagtgcagagccacatcctgcacctggagcacgacctggtgcacgtgaccagaaagaaccacgccagacaggccggcgtgagaggcctgggccaccagagctag

SEQ ID NO: 76224 - DNA, 2832 bp, Artificial Sequence
  Description of Artificial Sequence: Synthetic coding sequence
atggccgccagcggcctggaccacctgaagaacggctacagaagaagattctgcagacccagcagagccagagacatcaacaccgagcagggccagaacgtgctggagatcctgcaggactgcttcgaggagaagagcctggccaacgacttcagcaccaacagcaccaagagcgtgcccaacagcaccagaaagatcaaggacacctgcatccagagccccagcaaggagtgccagaagagccaccccaagagcgtgcccgtgagcagcaagaagaaggaggccagcctgcagttcgtggtggagcccagcgaggccaccaacagaagcgtgcaggcccacgaggtgcaccagaagatcctggccaccgacgtgagcagcaagaacacccccgacagcaagaagatcagcagcagaaacatcaacgaccaccacagcgaggccgacgaggagttctacctgagcgtgggcagccccagcgtgctgctggacgccaagaccagcgtgagccagaacgtgatccccagcagcgcccagaagagagagacctacaccttcgagaacagcgtgaacatgctgcccagcagcaccgaggtgagcgtgaagaccaagaagagactgaacttcgacgacaaggtgatgctgaagaagatcgagatcgacaacaaggtgagcgacgaggaggacaagaccagcgagggccaggagagaaagcccagcggcagcagccagaacagaatcagagacagcgagtacgagatccagagacaggccaagaagagcttcagcaccctgttcctggagaccgtgaagagaaagagcgagagcagccccatcgtgagacacgccgccaccgcccccccccacagctgcccccccgacgacaccaagctgatcgaggacgagttcatcatcgacgagagcgaccagagcttcgccagcagaagctggatcaccatccccagaaaggccggcagcctgaagcagagaaccatcagccccgccgagagcaccgccctgctgcagggcagaaagagcagagagaagcaccacaacatcctgcccaagaccctggccaacgacaagcacagccacaagccccaccccgtggagaccagccagcccagcgacaagaccgtgctggacaccagctacgccctgatcggcgagaccgtgaacaactacagaagcaccaagtacgagatgtacagcaagaacgccgagaagcccagcagaagcaagagaaccatcaagcagaagcagagaagaaagttcatggccaagcccgccgaggagcagctggacgtgggccagagcaaggacgagaacatccacaccagccacatcacccaggacgagttccagagaaacagcgacagaaacatggaggagcacgaggagatgggcaacgactgcgtgagcaagaagcagatgccccccgtgggcagcaagaagagcagcaccagaaaggacaaggaggagagcaagaagaagagattcagcagcgagagcaagaacaagctggtgcccgaggaggtgaccagcaccgtgaccaagagcagaagaatcagcagaagacccagcgactggtgggtggtgaagagcgaggagagccccgtgtacagcaacagcagcgtgagaaacgagctgcccatgcaccacaacagcagcagaaagagcaccaagaagaccaaccagagcagcaagaacatcagaaagaagaccatccccctgaagagacagaagaccgccaccaagggcaaccagagagtgcagaagttcctgaacgccgagggcagcggcggcatcgtgggccacgacgagatcagcagatgcagcctgagcgagcccctggagagcgacgaggccgacctggccaagaagaagaacctggactgcagcagaagcaccagaagcagcaagaacgaggacaacatcatgaccgcccagaacgtgcccctgaagccccagaccagcggctacacctgcaacatccccaccgagagcaacctggacagcggcgagcacaagaccagcgtgctggaggagagcggccccagcagactgaacaacaactacctgatgagcggcaagaacgacgtggacgacgaggaggtgcacggcagcagcgacgacagcaagcagagcaaggtgatccccaagaacagaatccaccacaagctggtgctgcccagcaacacccccaacgtgagaagaaccaagagaaccagactgaagcccctggagtactggagaggcgagagaatcgactaccagggcagacccagcggcggcttcgtgatcagcggcgtgctgagccccgacaccatcagcagcaagagaaaggccaaggagaacatcggcaaggtgaacaagaagagcaacaagaagagaatctgcctggacaacgacgagagaaagaccaacctgatggtgaacctgggcatccccctgggcgaccccctgcagcccaccagagtgaaggaccccgagaccagagagatcatcctgatggacctggtgagaccccaggacacctaccagttcttcgtgaagcacggcgagctgaaggtgtacaagaccctggacacccccttcttcagcaccggcaagctgatcctgggcccccaggaggagaagggcaagcagcacgtgggccaggacatcctggtgttctacgtgaacttcggcgacctgctgtgcaccctgcacgagaccccctacatcctgagcaccggcgacagcttctacgtgcccagcggcaactactacaacatcaagaacctgagaaacgaggagagcgtgctgctgttcacccagatcaagagatag

SEQ ID NO: 76225 - DNA, 8106 bp, Artificial Sequence
  Description of Artificial Sequence: Synthetic coding sequence
atggccgaggagggcgccgtggccgtgtgcgtgagagtgagacccctgaacagcagagaggagagcctgggcgagaccgcccaggtgtactggaagaccgacaacaacgtgatctaccaggtggacggcagcaagagcttcaacttcgacagagtgttccacggcaacgagaccaccaagaacgtgtacgaggagatcgccgcccccatcatcgacagcgccatccagggctacaacggcaccatcttcgcctacggccagaccgccagcggcaagacctacaccatgatgggcagcgaggaccacctgggcgtgatccccagagccatccacgacatcttccagaagatcaagaagttccccgacagagagttcctgctgagagtgagctacatggagatctacaacgagaccatcaccgacctgctgtgcggcacccagaagatgaagcccctgatcatcagagaggacgtgaacagaaacgtgtacgtggccgacctgaccgaggaggtggtgtacaccagcgagatggccctgaagtggatcaccaagggcgagaagagcagacactacggcgagaccaagatgaaccagagaagcagcagaagccacaccatcttcagaatgatcctggagagcagagagaagggcgagcccagcaactgcgagggcagcgtgaaggtgagccacctgaacctggtggacctggccggcagcgagagagccgcccagaccggcgccgccggcgtgagactgaaggagggctgcaacatcaacagaagcctgttcatcctgggccaggtgatcaagaagctgagcgacggccaggtgggcggcttcatcaactacagagacagcaagctgaccagaatcctgcagaacagcctgggcggcaacgccaagaccagaatcatctgcaccatcacccccgtgagcttcgacgagaccctgaccgccctgcagttcgccagcaccgccaagtacatgaagaacaccccctacgtgaacgaggtgagcaccgacgaggccctgctgaagagatacagaaaggagatcatggacctgaagaagcagctggaggaggtgagcctggagaccagagcccaggccatggagaaggaccagctggcccagctgctggaggagaaggacctgctgcagaaggtgcagaacgagaagatcgagaacctgaccagaatgctggtgaccagcagcagcctgaccctgcagcaggagctgaaggccaagagaaagagaagagtgacctggtgcctgggcaagatcaacaagatgaagaacagcaactacgccgaccagttcaacatccccaccaacatcaccaccaagacccacaagctgagcatcaacctgctgagagagatcgacgagagcgtgtgcagcgagagcgacgtgttcagcaacaccctggacaccctgagcgagatcgagtggaaccccgccaccaagctgctgaaccaggagaacatcgagagcgagctgaacagcctgagagccgactacgacaacctggtgctggactacgagcagctgagaaccgagaaggaggagatggagctgaagctgaaggagaagaacgacctggacgagttcgaggccctggagagaaagaccaagaaggaccaggagatgcagctgatccacgagatcagcaacctgaagaacctggtgaagcacgccgaggtgtacaaccaggacctggagaacgagctgagcagcaaggtggagctgctgagagagaaggaggaccagatcaagaagctgcaggagtacatcgacagccagaagctggagaacatcaagatggacctgagctacagcctggagagcatcgaggaccccaagcagatgaagcagaccctgttcgacgccgagaccgtggccctggacgccaagagagagagcgccttcctgagaagcgagaacctggagctgaaggagaagatgaaggagctggccaccacctacaagcagatggagaacgacatccagctgtaccagagccagctggaggccaagaagaagatgcaggtggacctggagaaggagctgcagagcgccttcaacgagatcaccaagctgaccagcctgatcgacggcaaggtgcccaaggacctgctgtgcaacctggagctggagggcaagatcaccgacctgcagaaggagctgaacaaggaggtggaggagaacgaggccctgagagaggaggtgatcctgctgagcgagctgaagagcctgcccagcgaggtggagagactgagaaaggagatccaggacaagagcgaggagctgcacatcatcaccagcgagaaggacaagctgttcagcgaggtggtgcacaaggagagcagagtgcagggcctgctggaggagatcggcaagaccaaggacgacctggccaccacccagagcaactacaagagcaccgaccaggagttccagaacttcaagaccctgcacatggacttcgagcagaagtacaagatggtgctggaggagaacgagagaatgaaccaggagatcgtgaacctgagcaaggaggcccagaagttcgacagcagcctgggcgccctgaagaccgagctgagctacaagacccaggagctgcaggagaagaccagagaggtgcaggagagactgaacgagatggagcagctgaaggagcagctggagaacagagacagcaccctgcagaccgtggagagagagaagaccctgatcaccgagaagctgcagcagaccctggaggaggtgaagaccctgacccaggagaaggacgacctgaagcagctgcaggagagcctgcagatcgagagagaccagctgaagagcgacatccacgacaccgtgaacatgaacatcgacacccaggagcagctgagaaacgccctggagagcctgaagcagcaccaggagaccatcaacaccctgaagagcaagatcagcgaggaggtgagcagaaacctgcacatggaggagaacaccggcgagaccaaggacgagttccagcagaagatggtgggcatcgacaagaagcaggacctggaggccaagaacacccagaccctgaccgccgacgtgaaggacaacgagatcatcgagcagcagagaaagatcttcagcctgatccaggagaagaacgagctgcagcagatgctggagagcgtgatcgccgagaaggagcagctgaagaccgacctgaaggagaacatcgagatgaccatcgagaaccaggaggagctgagactgctgggcgacgagctgaagaagcagcaggagatcgtggcccaggagaagaaccacgccatcaagaaggagggcgagctgagcagaacctgcgacagactggccgaggtggaggagaagctgaaggagaagagccagcagctgcaggagaagcagcagcagctgctgaacgtgcaggaggagatgagcgagatgcagaagaagatcaacgagatcgagaacctgaagaacgagctgaagaacaaggagctgaccctggagcacatggagaccgagagactggagctggcccagaagctgaacgagaactacgaggaggtgaagagcatcaccaaggagagaaaggtgctgaaggagctgcagaagagcttcgagaccgagagagaccacctgagaggctacatcagagagatcgaggccaccggcctgcagaccaaggaggagctgaagatcgcccacatccacctgaaggagcaccaggagaccatcgacgagctgagaagaagcgtgagcgagaagaccgcccagatcatcaacacccaggacctggagaagagccacaccaagctgcaggaggagatccccgtgctgcacgaggagcaggagctgctgcccaacgtgaaggaggtgagcgagacccaggagaccatgaacgagctggagctgctgaccgagcagagcaccaccaaggacagcaccaccctggccagaatcgagatggagagactgagactgaacgagaagttccaggagagccaggaggagatcaagagcctgaccaaggagagagacaacctgaagaccatcaaggaggccctggaggtgaagcacgaccagctgaaggagcacatcagagagaccctggccaagatccaggagagccagagcaagcaggagcagagcctgaacatgaaggagaaggacaacgagaccaccaagatcgtgagcgagatggagcagttcaagcccaaggacagcgccctgctgagaatcgagatcgagatgctgggcctgagcaagagactgcaggagagccacgacgagatgaagagcgtggccaaggagaaggacgacctgcagagactgcaggaggtgctgcagagcgagagcgaccagctgaaggagaacatcaaggagatcgtggccaagcacctggagaccgaggaggagctgaaggtggcccactgctgcctgaaggagcaggaggagaccatcaacgagctgagagtgaacctgagcgagaaggagaccgagatcagcaccatccagaagcagctggaggccatcaacgacaagctgcagaacaagatccaggagatctacgagaaggaggagcagttcaacatcaagcagatcagcgaggtgcaggagaaggtgaacgagctgaagcagttcaaggagcacagaaaggccaaggacagcgccctgcagagcatcgagagcaagatgctggagctgaccaacagactgcaggagagccaggaggagatccagatcatgatcaaggagaaggaggagatgaagagagtgcaggaggccctgcagatcgagagagaccagctgaaggagaacaccaaggagatcgtggccaagatgaaggagagccaggagaaggagtaccagttcctgaagatgaccgccgtgaacgagacccaggagaagatgtgcgagatcgagcacctgaaggagcagttcgagacccagaagctgaacctggagaacatcgagaccgagaacatcagactgacccagatcctgcacgagaacctggaggagatgagaagcgtgaccaaggagagagacgacctgagaagcgtggaggagaccctgaaggtggagagagaccagctgaaggagaacctgagagagaccatcaccagagacctggagaagcaggaggagctgaagatcgtgcacatgcacctgaaggagcaccaggagaccatcgacaagctgagaggcatcgtgagcgagaagaccaacgagatcagcaacatgcagaaggacctggagcacagcaacgacgccctgaaggcccaggacctgaagatccaggaggagctgagaatcgcccacatgcacctgaaggagcagcaggagaccatcgacaagctgagaggcatcgtgagcgagaagaccgacaagctgagcaacatgcagaaggacctggagaacagcaacgccaagctgcaggagaagatccaggagctgaaggccaacgagcaccagctgatcaccctgaagaaggacgtgaacgagacccagaagaaggtgagcgagatggagcagctgaagaagcagatcaaggaccagagcctgaccctgagcaagctggagatcgagaacctgaacctggcccagaagctgcacgagaacctggaggagatgaagagcgtgatgaaggagagagacaacctgagaagagtggaggagaccctgaagctggagagagaccagctgaaggagagcctgcaggagaccaaggccagagacctggagatccagcaggagctgaagaccgccagaatgctgagcaaggagcacaaggagaccgtggacaagctgagagagaagatcagcgagaagaccatccagatcagcgacatccagaaggacctggacaagagcaaggacgagctgcagaagaagatccaggagctgcagaagaaggagctgcagctgctgagagtgaaggaggacgtgaacatgagccacaagaagatcaacgagatggagcagctgaagaagcagttcgaggcccagaacctgagcatgcagagcgtgagaatggacaacttccagctgaccaagaagctgcacgagagcctggaggagatcagaatcgtggccaaggagagagacgagctgagaagaatcaaggagagcctgaagatggagagagaccagttcatcgccaccctgagagagatgatcgccagagacagacagaaccaccaggtgaagcccgagaagagactgctgagcgacggccagcagcacctgaccgagagcctgagagagaagtgcagcagaatcaaggagctgctgaagagatacagcgagatggacgaccactacgagtgcctgaacagactgagcctggacctggagaaggagatcgagttccagaaggagctgagcatgagagtgaaggccaacctgagcctgccctacctgcagaccaagcacatcgagaagctgttcaccgccaaccagagatgcagcatggagttccacagaatcatgaagaagctgaagtacgtgctgagctacgtgaccaagatcaaggaggagcagcacgagagcatcaacaagttcgagatggacttcatcgacgaggtggagaagcagaaggagctgctgatcaagatccagcacctgcagcaggactgcgacgtgcccagcagagagctgagagacctgaagctgaaccagaacatggacctgcacatcgaggagatcctgaaggacttcagcgagagcgagttccccagcatcaagaccgagttccagcaggtgctgagcaacagaaaggagatgacccagttcctggaggagtggctgaacaccagattcgacatcgagaagctgaagaacggcatccagaaggagaacgacagaatctgccaggtgaacaacttcttcaacaacagaatcatcgccatcatgaacgagagcaccgagttcgaggagagaagcgccaccatcagcaaggagtgggagcaggacctgaagagcctgaaggagaagaacgagaagctgttcaagaactaccagaccctgaagaccagcctggccagcggcgcccaggtgaaccccaccacccaggacaacaagaacccccacgtgaccagcagagccacccagctgaccaccgagaagatcagagagctggagaacagcctgcacgaggccaaggagagcgccatgcacaaggagagcaagatcatcaagatgcagaaggagctggaggtgaccaacgacatcatcgccaagctgcaggccaaggtgcacgagagcaacaagtgcctggagaagaccaaggagaccatccaggtgctgcaggacaaggtggccctgggcgccaagccctacaaggaggagatcgaggacctgaagatgaagctggtgaagatcgacctggagaagatgaagaacgccaaggagttcgagaaggagatcagcgccaccaaggccaccgtggagtaccagaaggaggtgatcagactgctgagagagaacctgagaagaagccagcaggcccaggacaccagcgtgatcagcgagcacaccgacccccagcccagcaacaagcccctgacctgcggcggcggcagcggcatcgtgcagaacaccaaggccctgatcctgaagagcgagcacatcagactggagaaggagatcagcaagctgaagcagcagaacgagcagctgatcaagcagaagaacgagctgctgagcaacaaccagcacctgagcaacgaggtgaagacctggaaggagagaaccctgaagagagaggcccacaagcaggtgacctgcgagaacagccccaagagccccaaggtgaccggcaccgccagcaagaagaagcagatcacccccagccagtgcaaggagagaaacctgcaggaccccgtgcccaaggagagccccaagagctgcttcttcgacagcagaagcaagagcctgcccagcccccaccccgtgagatacttcgacaacagcagcctgggcctgtgccccgaggtgcagaacgccggcgccgagagcgtggacagccagcccggcccctggcacgccagcagcggcaaggacgtgcccgagtgcaagacccagtag

SEQ ID NO: 76226 - DNA, 7743 bp, Artificial Sequence
  Description of Artificial Sequence: Synthetic coding sequence
atggccgaggagggcgccgtggccgtgtgcgtgagagtgagacccctgaacagcagagaggagagcctgggcgagaccgcccaggtgtactggaagaccgacaacaacgtgatctaccaggtggacggcagcaagagcttcaacttcgacagagtgttccacggcaacgagaccaccaagaacgtgtacgaggagatcgccgcccccatcatcgacagcgccatccagggctacaacggcaccatcttcgcctacggccagaccgccagcggcaagacctacaccatgatgggcagcgaggaccacctgggcgtgatccccagagccatccacgacatcttccagaagatcaagaagttccccgacagagagttcctgctgagagtgagctacatggagatctacaacgagaccatcaccgacctgctgtgcggcacccagaagatgaagcccctgatcatcagagaggacgtgaacagaaacgtgtacgtggccgacctgaccgaggaggtggtgtacaccagcgagatggccctgaagtggatcaccaagggcgagaagagcagacactacggcgagaccaagatgaaccagagaagcagcagaagccacaccatcttcagaatgatcctggagagcagagagaagggcgagcccagcaactgcgagggcagcgtgaaggtgagccacctgaacctggtggacctggccggcagcgagagagccgcccagaccggcgccgccggcgtgagactgaaggagggctgcaacatcaacagaagcctgttcatcctgggccaggtgatcaagaagctgagcgacggccaggtgggcggcttcatcaactacagagacagcaagctgaccagaatcctgcagaacagcctgggcggcaacgccaagaccagaatcatctgcaccatcacccccgtgagcttcgacgagaccctgaccgccctgcagttcgccagcaccgccaagtacatgaagaacaccccctacgtgaacgaggtgagcaccgacgaggccctgctgaagagatacagaaaggagatcatggacctgaagaagcagctggaggaggtgagcctggagaccagagcccaggccatggagaaggaccagctggcccagctgctggaggagaaggacctgctgcagaaggtgcagaacgagaagatcgagaacctgaccagaatgctggtgaccagcagcagcctgaccctgcagcaggagctgaaggccaagagaaagagaagagtgacctggtgcctgggcaagatcaacaagatgaagaacagcaactacgccgaccagttcaacatccccaccaacatcaccaccaagacccacaagctgagcatcaacctgctgagagagatcgacgagagcgtgtgcagcgagagcgacgtgttcagcaacaccctggacaccctgagcgagatcgagtggaaccccgccaccaagctgctgaaccaggagaacatcgagagcgagctgaacagcctgagagccgactacgacaacctggtgctggactacgagcagctgagaaccgagaaggaggagatggagctgaagctgaaggagaagaacgacctggacgagttcgaggccctggagagaaagaccaagaaggaccaggagaacgagctgagcagcaaggtggagctgctgagagagaaggaggaccagatcaagaagctgcaggagtacatcgacagccagaagctggagaacatcaagatggacctgagctacagcctggagagcatcgaggaccccaagcagatgaagcagaccctgttcgacgccgagaccgtggccctggacgccaagagagagagcgccttcctgagaagcgagaacctggagctgaaggagaagatgaaggagctggccaccacctacaagcagatggagaacgacatccagctgtaccagagccagctggaggccaagaagaagatgcaggtggacctggagaaggagctgcagagcgccttcaacgagatcaccaagctgaccagcctgatcgacggcaaggtgcccaaggacctgctgtgcaacctggagctggagggcaagatcaccgacctgcagaaggagctgaacaaggaggtggaggagaacgaggccctgagagaggaggtgatcctgctgagcgagctgaagagcctgcccagcgaggtggagagactgagaaaggagatccaggacaagagcgaggagctgcacatcatcaccagcgagaaggacaagctgttcagcgaggtggtgcacaaggagagcagagtgcagggcctgctggaggagatcggcaagaccaaggacgacctggccaccacccagagcaactacaagagcaccgaccaggagttccagaacttcaagaccctgcacatggacttcgagcagaagtacaagatggtgctggaggagaacgagagaatgaaccaggagatcgtgaacctgagcaaggaggcccagaagttcgacagcagcctgggcgccctgaagaccgagctgagctacaagacccaggagctgcaggagaagaccagagaggtgcaggagagactgaacgagatggagcagctgaaggagcagctggagaacagagacagcaccctgcagaccgtggagagagagaagaccctgatcaccgagaagctgcagcagaccctggaggaggtgaagaccctgacccaggagaaggacgacctgaagcagctgcaggagagcctgcagatcgagagagaccagctgaagagcgacatccacgacaccgtgaacatgaacatcgacacccaggagcagctgagaaacgccctggagagcctgaagcagcaccaggagaccatcaacaccctgaagagcaagatcagcgaggaggtgagcagaaacctgcacatggaggagaacaccggcgagaccaaggacgagttccagcagaagatggtgggcatcgacaagaagcaggacctggaggccaagaacacccagaccctgaccgccgacgtgaaggacaacgagatcatcgagcagcagagaaagatcttcagcctgatccaggagaagaacgagctgcagcagatgctggagagcgtgatcgccgagaaggagcagctgaagaccgacctgaaggagaacatcgagatgaccatcgagaaccaggaggagctgagactgctgggcgacgagctgaagaagcagcaggagatcgtggcccaggagaagaaccacgccatcaagaaggagggcgagctgagcagaacctgcgacagactggccgaggtggaggagaagctgaaggagaagagccagcagctgcaggagaagcagcagcagctgctgaacgtgcaggaggagatgagcgagatgcagaagaagatcaacgagatcgagaacctgaagaacgagctgaagaacaaggagctgaccctggagcacatggagaccgagagactggagctggcccagaagctgaacgagaactacgaggaggtgaagagcatcaccaaggagagaaaggtgctgaaggagctgcagaagagcttcgagaccgagagagaccacctgagaggctacatcagagagatcgaggccaccggcctgcagaccaaggaggagctgaagatcgcccacatccacctgaaggagcaccaggagaccatcgacgagctgagaagaagcgtgagcgagaagaccgcccagatcatcaacacccaggacctggagaagagccacaccaagctgcaggaggagatccccgtgctgcacgaggagcaggagctgctgcccaacgtgaaggaggtgagcgagacccaggagaccatgaacgagctggagctgctgaccgagcagagcaccaccaaggacagcaccaccctggccagaatcgagatggagagactgagactgaacgagaagttccaggagagccaggaggagatcaagagcctgaccaaggagagagacaacctgaagaccatcaaggaggccctggaggtgaagcacgaccagctgaaggagcacatcagagagaccctggccaagatccaggagagccagagcaagcaggagcagagcctgaacatgaaggagaaggacaacgagaccaccaagatcgtgagcgagatggagcagttcaagcccaaggacagcgccctgctgagaatcgagatcgagatgctgggcctgagcaagagactgcaggagagccacgacgagatgaagagcgtggccaaggagaaggacgacctgcagagactgcaggaggtgctgcagagcgagagcgaccagctgaaggagaacatcaaggagatcgtggccaagcacctggagaccgaggaggagctgaaggtggcccactgctgcctgaaggagcaggaggagaccatcaacgagctgagagtgaacctgagcgagaaggagaccgagatcagcaccatccagaagcagctggaggccatcaacgacaagctgcagaacaagatccaggagatctacgagaaggaggagcagttcaacatcaagcagatcagcgaggtgcaggagaaggtgaacgagctgaagcagttcaaggagcacagaaaggccaaggacagcgccctgcagagcatcgagagcaagatgctggagctgaccaacagactgcaggagagccaggaggagatccagatcatgatcaaggagaaggaggagatgaagagagtgcaggaggccctgcagatcgagagagaccagctgaaggagaacaccaaggagatcgtggccaagatgaaggagagccaggagaaggagtaccagttcctgaagatgaccgccgtgaacgagacccaggagaagatgtgcgagatcgagcacctgaaggagcagttcgagacccagaagctgaacctggagaacatcgagaccgagaacatcagactgacccagatcctgcacgagaacctggaggagatgagaagcgtgaccaaggagagagacgacctgagaagcgtggaggagaccctgaaggtggagagagaccagctgaaggagaacctgagagagaccatcaccagagacctggagaagcaggaggagctgaagatcgtgcacatgcacctgaaggagcaccaggagaccatcgacaagctgagaggcatcgtgagcgagaagaccaacgagatcagcaacatgcagaaggacctggagcacagcaacgacgccctgaaggcccaggacctgaagatccaggaggagctgagaatcgcccacatgcacctgaaggagcagcaggagaccatcgacaagctgagaggcatcgtgagcgagaagaccgacaagctgagcaacatgcagaaggacctggagaacagcaacgccaagctgcaggagaagatccaggagctgaaggccaacgagcaccagctgatcaccctgaagaaggacgtgaacgagacccagaagaaggtgagcgagatggagcagctgaagaagcagatcaaggaccagagcctgaccctgagcaagctggagatcgagaacctgaacctggcccagaagctgcacgagaacctggaggagatgaagagcgtgatgaaggagagagacaacctgagaagagtggaggagaccctgaagctggagagagaccagctgaaggagagcctgcaggagaccaaggccagagacctggagatccagcaggagctgaagaccgccagaatgctgagcaaggagcacaaggagaccgtggacaagctgagagagaagatcagcgagaagaccatccagatcagcgacatccagaaggacctggacaagagcaaggacgagctgcagaagaagcaggacagacagaaccaccaggtgaagcccgagaagagactgctgagcgacggccagcagcacctgaccgagagcctgagagagaagtgcagcagaatcaaggagctgctgaagagatacagcgagatggacgaccactacgagtgcctgaacagactgagcctggacctggagaaggagatcgagttccagaaggagctgagcatgagagtgaaggccaacctgagcctgccctacctgcagaccaagcacatcgagaagctgttcaccgccaaccagagatgcagcatggagttccacagaatcatgaagaagctgaagtacgtgctgagctacgtgaccaagatcaaggaggagcagcacgagagcatcaacaagttcgagatggacttcatcgacgaggtggagaagcagaaggagctgctgatcaagatccagcacctgcagcaggactgcgacgtgcccagcagagagctgagagacctgaagctgaaccagaacatggacctgcacatcgaggagatcctgaaggacttcagcgagagcgagttccccagcatcaagaccgagttccagcaggtgctgagcaacagaaaggagatgacccagttcctggaggagtggctgaacaccagattcgacatcgagaagctgaagaacggcatccagaaggagaacgacagaatctgccaggtgaacaacttcttcaacaacagaatcatcgccatcatgaacgagagcaccgagttcgaggagagaagcgccaccatcagcaaggagtgggagcaggacctgaagagcctgaaggagaagaacgagaagctgttcaagaactaccagaccctgaagaccagcctggccagcggcgcccaggtgaaccccaccacccaggacaacaagaacccccacgtgaccagcagagccacccagctgaccaccgagaagatcagagagctggagaacagcctgcacgaggccaaggagagcgccatgcacaaggagagcaagatcatcaagatgcagaaggagctggaggtgaccaacgacatcatcgccaagctgcaggccaaggtgcacgagagcaacaagtgcctggagaagaccaaggagaccatccaggtgctgcaggacaaggtggccctgggcgccaagccctacaaggaggagatcgaggacctgaagatgaagctggtgaagatcgacctggagaagatgaagaacgccaaggagttcgagaaggagatcagcgccaccaaggccaccgtggagtaccagaaggaggtgatcagactgctgagagagaacctgagaagaagccagcaggcccaggacaccagcgtgatcagcgagcacaccgacccccagcccagcaacaagcccctgacctgcggcggcggcagcggcatcgtgcagaacaccaaggccctgatcctgaagagcgagcacatcagactggagaaggagatcagcaagctgaagcagcagaacgagcagctgatcaagcagaagaacgagctgctgagcaacaaccagcacctgagcaacgaggtgaagacctggaaggagagaaccctgaagagagaggcccacaagcaggtgacctgcgagaacagccccaagagccccaaggtgaccggcaccgccagcaagaagaagcagatcacccccagccagtgcaaggagagaaacctgcaggaccccgtgcccaaggagagccccaagagctgcttcttcgacagcagaagcaagagcctgcccagcccccaccccgtgagatacttcgacaacagcagcctgggcctgtgccccgaggtgcagaacgccggcgccgagagcgtggacagccagcccggcccctggcacgccagcagcggcaaggacgtgcccgagtgcaagacccagtag

SEQ ID NO: 76227 - DNA, 7038 bp, Artificial Sequence
  Description of Artificial Sequence: Synthetic coding sequence
atggccgaggagggcgccgtggccgtgtgcgtgagagtgagacccctgaacagcagagaggagagcctgggcgagaccgcccaggtgtactggaagaccgacaacaacgtgatctaccaggtggacggcagcaagagcttcaacttcgacagagtgttccacggcaacgagaccaccaagaacgtgtacgaggagatcgccgcccccatcatcgacagcgccatccagggctacaacggcaccatcttcgcctacggccagaccgccagcggcaagacctacaccatgatgggcagcgaggaccacctgggcgtgatccccagagccatccacgacatcttccagaagatcaagaagttccccgacagagagttcctgctgagagtgagctacatggagatctacaacgagaccatcaccgacctgctgtgcggcacccagaagatgaagcccctgatcatcagagaggacgtgaacagaaacgtgtacgtggccgacctgaccgaggaggtggtgtacaccagcgagatggccctgaagtggatcaccaagggcgagaagagcagacactacggcgagaccaagatgaaccagagaagcagcagaagccacaccatcttcagaatgatcctggagagcagagagaagggcgagcccagcaactgcgagggcagcgtgaaggtgagccacctgaacctggtggacctggccggcagcgagagagccgcccagaccggcgccgccggcgtgagactgaaggagggctgcaacatcaacagaagcctgttcatcctgggccaggtgatcaagaagctgagcgacggccaggtgggcggcttcatcaactacagagacagcaagctgaccagaatcctgcagaacagcctgggcggcaacgccaagaccagaatcatctgcaccatcacccccgtgagcttcgacgagaccctgaccgccctgcagttcgccagcaccgccaagtacatgaagaacaccccctacgtgaacgaggtgagcaccgacgaggccctgctgaagagatacagaaaggagatcatggacctgaagaagcagctggaggaggtgagcctggagaccagagcccaggccatggagaaggaccagctggcccagctgctggaggagaaggacctgctgcagaaggtgcagaacgagaagatcgagaacctgaccagaatgctggtgaccagcagcagcctgaccctgcagcaggagctgaaggccaagagaaagagaagagtgacctggtgcctgggcaagatcaacaagatgaagaacagcaactacgccgaccagttcaacatccccaccaacatcaccaccaagacccacaagctgagcatcaacctgctgagagagatcgacgagagcgtgtgcagcgagagcgacgtgttcagcaacaccctggacaccctgagcgagatcgagtggaaccccgccaccaagctgctgaaccaggagaacatcgagagcgagctgaacagcctgagagccgactacgacaacctggtgctggactacgagcagctgagaaccgagaaggaggagatggagctgaagctgaaggagaagaacgacctggacgagttcgaggccctggagagaaagaccaagaaggaccaggagatgcagctgatccacgagatcagcaacctgaagaacctggtgaagcacgccgaggtgtacaaccaggacctggagaacgagctgagcagcaaggtggagctgctgagagagaaggaggaccagatcaagaagctgcaggagtacatcgacagccagaagctggagaacatcaagatggacctgagctacagcctggagagcatcgaggaccccaagcagatgaagcagaccctgttcgacgccgagaccgtggccctggacgccaagagagagagcgccttcctgagaagcgagaacctggagctgaaggagaagatgaaggagctggccaccacctacaagcagatggagaacgacatccagctgtaccagagccagctggaggccaagaagaagatgcaggtggacctggagaaggagctgcagagcgccttcaacgagatcaccaagctgaccagcctgatcgacggcaaggtgcccaaggacctgctgtgcaacctggagctggagggcaagatcaccgacctgcagaaggagctgaacaaggaggtggaggagaacgaggccctgagagaggaggtgatcctgctgagcgagctgaagagcctgcccagcgaggtggagagactgagaaaggagatccaggacaagagcgaggagctgcacatcatcaccagcgagaaggacaagctgttcagcgaggtggtgcacaaggagagcagagtgcagggcctgctggaggagatcggcaagaccaaggacgacctggccaccacccagagcaactacaagagcaccgaccaggagttccagaacttcaagaccctgcacatggacttcgagcagaagtacaagatggtgctggaggagaacgagagaatgaaccaggagatcgtgaacctgagcaaggaggcccagaagttcgacagcagcctgggcgccctgaagaccgagctgagctacaagacccaggagctgcaggagaagaccagagaggtgcaggagagactgaacgagatggagcagctgaaggagcagctggagaacagagacagcaccctgcagaccgtggagagagagaagaccctgatcaccgagaagctgcagcagaccctggaggaggtgaagaccctgacccaggagaaggacgacctgaagcagctgcaggagagcctgcagatcgagagagaccagctgaagagcgacatccacgacaccgtgaacatgaacatcgacacccaggagcagctgagaaacgccctggagagcctgaagcagcaccaggagaccatcaacaccctgaagagcaagatcagcgaggaggtgagcagaaacctgcacatggaggagaacaccggcgagaccaaggacgagttccagcagaagatggtgggcatcgacaagaagcaggacctggaggccaagaacacccagaccctgaccgccgacgtgaaggacaacgagatcatcgagcagcagagaaagatcttcagcctgatccaggagaagaacgagctgcagcagatgctggagagcgtgatcgccgagaaggagcagctgaagaccgacctgaaggagaacatcgagatgaccatcgagaaccaggaggagctgagactgctgggcgacgagctgaagaagcagcaggagatcgtggcccaggagaagaaccacgccatcaagaaggagggcgagctgagcagaacctgcgacagactggccgaggtggaggagaagctgaaggagaagagccagcagctgcaggagaagcagcagcagctgctgaacgtgcaggaggagatgagcgagatgcagaagaagatcaacgagatcgagaacctgaagaacgagctgaagaacaaggagctgaccctggagcacatggagaccgagagactggagctggcccagaagctgaacgagaactacgaggaggtgaagagcatcaccaaggagagaaaggtgctgaaggagctgcagaagagcttcgagaccgagagagaccacctgagaggctacatcagagagatcgaggccaccggcctgcagaccaaggaggagctgaagatcgcccacatccacctgaaggagcaccaggagaccatcgacgagctgagaagaagcgtgagcgagaagaccgcccagatcatcaacacccaggacctggagaagagccacaccaagctgcaggaggagatccccgtgctgcacgaggagcaggagctgctgcccaacgtgaaggaggtgagcgagacccaggagaccatgaacgagctggagctgctgaccgagcagagcaccaccaaggacagcaccaccctggccagaatcgagatggagagactgagactgaacgagaagttccaggagagccaggaggagatcaagagcctgaccaaggagagagacaacctgaagaccatcaaggaggccctggaggtgaagcacgaccagctgaaggagcacatcagagagaccctggccaagatccaggagagccagagcaagcaggagcagagcctgaacatgaaggagaaggacaacgagaccaccaagatcgtgagcgagatggagcagttcaagcccaaggacagcgccctgctgagaatcgagatcgagatgctgggcctgagcaagagactgcaggagagccacgacgagatgaagagcgtggccaaggagaaggacgacctgcagagactgcaggaggtgctgcagagcgagagcgaccagctgaaggagaacatcaaggagatcgtggccaagcacctggagaccgaggaggagctgaaggtggcccactgctgcctgaaggagcaggaggagaccatcaacgagctgagagtgaacctgagcgagaaggagaccgagatcagcaccatccagaagcagctggaggccatcaacgacaagctgcagaacaagatccaggagatctacgagaaggaggagcagttcaacatcaagcagatcagcgaggtgcaggagaaggtgaacgagctgaagcagttcaaggagcacagaaaggccaaggacagcgccctgcagagcatcgagagcaagatgctggagctgaccaacagactgcaggagagccaggaggagatccagatcatgatcaaggagaaggaggagatgaagagagtgcaggaggccctgcagatcgagagagaccagctgaaggagaacaccaaggagatcgtggccaagatgaaggagagccaggagaaggagtaccagttcctgaagatgaccgccgtgaacgagacccaggagaagatgtgcgagatcgagcacctgaaggagcagttcgagacccagaagctgaacctggagaacatcgagaccgagaacatcagactgacccagatcctgcacgagaacctggaggagatgagaagcgtgaccaaggagagagacgacctgagaagcgtggaggagaccctgaaggtggagagagaccagctgaaggagaacctgagagagaccatcaccagagacctggagaagcaggaggagctgaagatcgtgcacatgcacctgaaggagcaccaggagaccatcgacaagctgagaggcatcgtgagcgagaagaccaacgagatcagcaacatgcagaaggacctggagcacagcaacgacgccctgaaggcccaggacctgaagatccaggaggagctgagaatcgcccacatgcacctgaaggagcagcaggagaccatcgacaagctgagaggcatcgtgagcgagaagaccgacaagctgagcaacatgcagaaggacctggagaacagcaacgccaagctgcaggagaagatccaggagctgaaggccaacgagcaccagctgatcaccctgaagaaggacgtgaacgagacccagaagaaggtgagcgagatggagcagctgaagaagcagatcaaggaccagagcctgaccctgagcaagctggagatcgagaacctgaacctggcccagaagctgcacgagaacctggaggagatgaagagcgtgatgaaggagagagacaacctgagaagagtggaggagaccctgaagctggagagagaccagctgaaggagagcctgcaggagaccaaggccagagacctggagatccagcaggagctgaagaccgccagaatgctgagcaaggagcacaaggagaccgtggacaagctgagagagaagatcagcgagaagaccatccagatcagcgacatccagaaggacctggacaagagcaaggacgagctgcagaagaagatccaggagctgcagaagaaggagctgcagctgctgagagtgaaggaggacgtgaacatgagccacaagaagatcaacgagatggagcagctgaagaagcagttcgaggcccagaacctgagcatgcagagcgtgagaatggacaacttccagctgaccaagaagctgcacgagagcctggaggagatcagaatcgtggccaaggagagagacgagctgagaagaatcaaggagagcctgaagatggagagagaccagttcatcgccaccctgagagagatgatcgccagagacagacagaaccaccaggtgaagcccgagaagagactgctgagcgacggccagcagcacctgaccgagagcctgagagagaagtgcagcagaatcaaggagctgctgaagagatacagcgagatggacgaccactacgagtgcctgaacagactgagcctggacctggagaaggagatcgagttccacagaatcatgaagaagctgaagtacgtgctgagctacgtgaccaagatcaaggaggagcagcacgagagcatcaacaagttcgagatggacttcatcgacgaggtggagaagcagaaggagctgctgatcaagatccagcacctgcagcaggactgcgacgtgcccagcagagagctgagagacctgaagctgaaccagaacatggacctgcacatcgaggagatcctgaaggacttcagcgagagcgagttccccagcatcaagaccgagttccagcaggtgctgagcaacagaaaggagatgacccagttcctggaggagtggctgaacaccagattcgacatcgagaagctgaagaacggcatccagaaggagaacgacagaatctgccaggtgaacaacttcttcaacaacagaatcatcgccatcatgaacgagagcaccgagttcgaggagagaagcgccaccatcagcaaggagtgggagcaggacctgaagagcctgaaggagaagaacgagaagctgttcaagaactaccagaccctgaagaccagcctggccagcggcgcccaggtgaaccccaccacccaggacaacaagaacccccacgtgaccagcagagccacccagctgaccaccgagtag

SEQ ID NO: 76228 - DNA, 9345 bp, Artificial Sequence
  Description of Artificial Sequence: Synthetic coding sequence
atgagctgggccctggaggagtggaaggagggcctgcccaccagagccctgcagaagatccaggagctggagggccagctggacaagctgaagaaggagaagcagcagagacagttccagctggacagcctggaggccgccctgcagaagcagaagcagaaggtggagaacgagaagaccgagggcaccaacctgaagagagagaaccagagactgatggagatctgcgagagcctggagaagaccaagcagaagatcagccacgagctgcaggtgaaggagagccaggtgaacttccaggagggccagctgaacagcggcaagaagcagatcgagaagctggagcaggagctgaagagatgcaagagcgagctggagagaagccagcaggccgcccagagcgccgacgtgagcctgaacccctgcaacaccccccagaagatcttcaccacccccctgacccccagccagtactacagcggcagcaagtacgaggacctgaaggagaagtacaacaaggaggtggaggagagaaagagactggaggccgaggtgaaggccctgcaggccaagaaggccagccagaccctgccccaggccaccatgaaccacagagacatcgccagacaccaggccagcagcagcgtgttcagctggcagcaggagaagacccccagccacctgagcagcaacagccagagaacccccatcagaagagacttcagcgccagctacttcagcggcgagcaggaggtgacccccagcagaagcaccctgcagatcggcaagagagacgccaacagcagcttcttcgacaacagcagcagcccccacctgctggaccagctgaaggcccagaaccaggagctgagaaacaagatcaacgagctggagctgagactgcagggccacgagaaggagatgaagggccaggtgaacaagttccaggagctgcagctgcagctggagaaggccaaggtggagctgatcgagaaggagaaggtgctgaacaagtgcagagacgagctggtgagaaccaccgcccagtacgaccaggccagcaccaagtacaccgccctggagcagaagctgaagaagctgaccgaggacctgagctgccagagacagaacgccgagagcgccagatgcagcctggagcagaagatcaaggagaaggagaaggagttccaggaggagctgagcagacagcagagaagcttccagaccctggaccaggagtgcatccagatgaaggccagactgacccaggagctgcagcaggccaagaacatgcacaacgtgctgcaggccgagctggacaagctgaccagcgtgaagcagcagctggagaacaacctggaggagttcaagcagaagctgtgcagagccgagcaggccttccaggccagccagatcaaggagaacgagctgagaagaagcatggaggagatgaagaaggagaacaacctgctgaagagccacagcgagcagaaggccagagaggtgtgccacctggaggccgagctgaagaacatcaagcagtgcctgaaccagagccagaacttcgccgaggagatgaaggccaagaacaccagccaggagaccatgctgagagacctgcaggagaagatcaaccagcaggagaacagcctgaccctggagaagctgaagctggccgtggccgacctggagaagcagagagactgcagccaggacctgctgaagaagagagagcaccacatcgagcagctgaacgacaagctgagcaagaccgagaaggagagcaaggccctgctgagcgccctggagctgaagaagaaggagtacgaggagctgaaggaggagaagaccctgttcagctgctggaagagcgagaacgagaagctgctgacccagatggagagcgagaaggagaacctgcagagcaagatcaaccacctggagacctgcctgaagacccagcagatcaagagccacgagtacaacgagagagtgagaaccctggagatggacagagagaacctgagcgtggagatcagaaacctgcacaacgtgctggacagcaagagcgtggaggtggagacccagaagctggcctacatggagctgcagcagaaggccgagttcagcgaccagaagcaccagaaggagatcgagaacatgtgcctgaagaccagccagctgaccggccaggtggaggacctggagcacaagctgcagctgctgagcaacgagatcatggacaaggacagatgctaccaggacctgcacgccgagtacgagagcctgagagacctgctgaagagcaaggacgccagcctggtgaccaacgaggaccaccagagaagcctgctggccttcgaccagcagcccgccatgcaccacagcttcgccaacatcatcggcgagcagggcagcatgcccagcgagagaagcgagtgcagactggaggccgaccagagccccaagaacagcgccatcctgcagaacagagtggacagcctggagttcagcctggagagccagaagcagatgaacagcgacctgcagaagcagtgcgaggagctggtgcagatcaagggcgagatcgaggagaacctgatgaaggccgagcagatgcaccagagcttcgtggccgagaccagccagagaatcagcaagctgcaggaggacaccagcgcccaccagaacgtggtggccgagaccctgagcgccctggagaacaaggagaaggagctgcagctgctgaacgacaaggtggagaccgagcaggccgagatccaggagctgaagaagagcaaccacctgctggaggacagcctgaaggagctgcagctgctgagcgagaccctgagcctggagaagaaggagatgagcagcatcatcagcctgaacaagagagagatcgaggagctgacccaggagaacggcaccctgaaggagatcaacgccagcctgaaccaggagaagatgaacctgatccagaagagcgagagcttcgccaactacatcgacgagagagagaagagcatcagcgagctgagcgaccagtacaagcaggagaagctgatcctgctgcagagatgcgaggagaccggcaacgcctacgaggacctgagccagaagtacaaggccgcccaggagaagaacagcaagctggagtgcctgctgaacgagtgcaccagcctgtgcgagaacagaaagaacgagctggagcagctgaaggaggccttcgccaaggagcaccaggagttcctgaccaagctggccttcgccgaggagagaaaccagaacctgatgctggagctggagaccgtgcagcaggccctgagaagcgagatgaccgacaaccagaacaacagcaagagcgaggccggcggcctgaagcaggagatcatgaccctgaaggaggagcagaacaagatgcagaaggaggtgaacgacctgctgcaggagaacgagcagctgatgaaggtgatgaagaccaagcacgagtgccagaacctggagagcgagcccatcagaaacagcgtgaaggagagagagagcgagagaaaccagtgcaacttcaagccccagatggacctggaggtgaaggagatcagcctggacagctacaacgcccagctggtgcagctggaggccatgctgagaaacaaggagctgaagctgcaggagagcgagaaggagaaggagtgcctgcagcacgagctgcagaccatcagaggcgacctggagaccagcaacctgcaggacatgcagagccaggagatcagcggcctgaaggactgcgagatcgacgccgaggagaagtacatcagcggcccccacgagctgagcaccagccagaacgacaacgcccacctgcagtgcagcctgcagaccaccatgaacaagctgaacgagctggagaagatctgcgagatcctgcaggccgagaagtacgagctggtgaccgagctgaacgacagcagaagcgagtgcatcaccgccaccagaaagatggccgaggaggtgggcaagctgctgaacgaggtgaagatcctgaacgacgacagcggcctgctgcacggcgagctggtggaggacatccccggcggcgagttcggcgagcagcccaacgagcagcaccccgtgagcctggcccccctggacgagagcaacagctacgagcacctgaccctgagcgacaaggaggtgcagatgcacttcgccgagctgcaggagaagttcctgagcctgcagagcgagcacaagatcctgcacgaccagcactgccagatgagcagcaagatgagcgagctgcagacctacgtggacagcctgaaggccgagaacctggtgctgagcaccaacctgagaaacttccagggcgacctggtgaaggagatgcagctgggcctggaggagggcctggtgcccagcctgagcagcagctgcgtgcccgacagcagcagcctgagcagcctgggcgacagcagcttctacagagccctgctggagcagaccggcgacatgagcctgctgagcaacctggagggcgccgtgagcgccaaccagtgcagcgtggacgaggtgttctgcagcagcctgcaggaggagaacctgaccagaaaggagacccccagcgcccccgccaagggcgtggaggagctggagagcctgtgcgaggtgtacagacagagcctggagaagctggaggagaagatggagagccagggcatcatgaagaacaaggagatccaggagctggagcagctgctgagcagcgagagacaggagctggactgcctgagaaagcagtacctgagcgagaacgagcagtggcagcagaagctgaccagcgtgaccctggagatggagagcaagctggccgccgagaagaagcagaccgagcagctgagcctggagctggaggtggccagactgcagctgcagggcctggacctgagcagcagaagcctgctgggcatcgacaccgaggacgccatccagggcagaaacgagagctgcgacatcagcaaggagcacaccagcgagaccaccgagagaacccccaagcacgacgtgcaccagatctgcgacaaggacgcccagcaggacctgaacctggacatcgagaagatcaccgagaccggcgccgtgaagcccaccggcgagtgcagcggcgagcagagccccgacaccaactacgagccccccggcgaggacaagacccagggcagcagcgagtgcatcagcgagctgagcttcagcggccccaacgccctggtgcccatggacttcctgggcaaccaggaggacatccacaacctgcagctgagagtgaaggagaccagcaacgagaacctgagactgctgcacgtgatcgaggacagagacagaaaggtggagagcctgctgaacgagatgaaggagctggacagcaagctgcacctgcaggaggtgcagctgatgaccaagatcgaggcctgcatcgagctggagaagatcgtgggcgagctgaagaaggagaacagcgacctgagcgagaagctggagtacttcagctgcgaccaccaggagctgctgcagagagtggagaccagcgagggcctgaacagcgacctggagatgcacgccgacaagagcagcagagaggacatcggcgacaacgtggccaaggtgaacgacagctggaaggagagattcctggacgtggagaacgagctgagcagaatcagaagcgagaaggccagcatcgagcacgaggccctgtacctggaggccgacctggaggtggtgcagaccgagaagctgtgcctggagaaggacaacgagaacaagcagaaggtgatcgtgtgcctggaggaggagctgagcgtggtgaccagcgagagaaaccagctgagaggcgagctggacaccatgagcaagaagaccaccgccctggaccagctgagcgagaagatgaaggagaagacccaggagctggagagccaccagagcgagtgcctgcactgcatccaggtggccgaggccgaggtgaaggagaagaccgagctgctgcagaccctgagcagcgacgtgagcgagctgctgaaggacaagacccacctgcaggagaagctgcagagcctggagaaggacagccaggccctgagcctgaccaagtgcgagctggagaaccagatcgcccagctgaacaaggagaaggagctgctggtgaaggagagcgagagcctgcaggccagactgagcgagagcgactacgagaagctgaacgtgagcaaggccctggaggccgccctggtggagaagggcgagttcgccctgagactgagcagcacccaggaggaggtgcaccagctgagaagaggcatcgagaagctgagagtgagaatcgaggccgacgagaagaagcagctgcacatcgccgagaagctgaaggagagagagagagagaacgacagcctgaaggacaaggtggagaacctggagagagagctgcagatgagcgaggagaaccaggagctggtgatcctggacgccgagaacagcaaggccgaggtggagaccctgaagacccagatcgaggagatggccagaagcctgaaggtgttcgagctggacctggtgaccctgagaagcgagaaggagaacctgaccaagcagatccaggagaagcagggccagctgagcgagctggacaagctgctgagcagcttcaagagcctgctggaggagaaggagcaggccgagatccagatcaaggaggagagcaagaccgccgtggagatgctgcagaaccagctgaaggagctgaacgaggccgtggccgccctgtgcggcgaccaggagatcatgaaggccaccgagcagagcctggacccccccatcgaggaggagcaccagctgagaaacagcatcgagaagctgagagccagactggaggccgacgagaagaagcagctgtgcgtgctgcagcagctgaaggagagcgagcaccacgccgacctgctgaagggcagagtggagaacctggagagagagctggagatcgccagaaccaaccaggagcacgccgccctggaggccgagaacagcaagggcgaggtggagaccctgaaggccaagatcgagggcatgacccagagcctgagaggcctggagctggacgtggtgaccatcagaagcgagaaggagaacctgaccaacgagctgcagaaggagcaggagagaatcagcgagctggagatcatcaacagcagcttcgagaacatcctgcaggagaaggagcaggagaaggtgcagatgaaggagaagagcagcaccgccatggagatgctgcagacccagctgaaggagctgaacgagagagtggccgccctgcacaacgaccaggaggcctgcaaggccaaggagcagaacctgagcagccaggtggagtgcctggagctggagaaggcccagctgctgcagggcctggacgaggccaagaacaactacatcgtgctgcagagcagcgtgaacggcctgatccaggaggtggaggacggcaagcagaagctggagaagaaggacgaggagatcagcagactgaagaaccagatccaggaccaggagcagctggtgagcaagctgagccaggtggagggcgagcaccagctgtggaaggagcagaacctggagctgagaaacctgaccgtggagctggagcagaagatccaggtgctgcagagcaagaacgccagcctgcaggacaccctggaggtgctgcagagcagctacaagaacctggagaacgagctggagctgaccaagatggacaagatgagcttcgtggagaaggtgaacaagatgaccgccaaggagaccgagctgcagagagagatgcacgagatggcccagaagaccgccgagctgcaggaggagctgagcggcgagaagaacagactggccggcgagctgcagctgctgctggaggagatcaagagcagcaaggaccagctgaaggagctgaccctggagaacagcgagctgaagaagagcctggactgcatgcacaaggaccaggtggagaaggagggcaaggtgagagaggagatcgccgagtaccagctgagactgcacgaggccgagaagaagcaccaggccctgctgctggacaccaacaagcagtacgaggtggagatccagacctacagagagaagctgaccagcaaggaggagtgcctgagcagccagaagctggagatcgacctgctgaagagcagcaaggaggagctgaacaacagcctgaaggccaccacccagatcctggaggagctgaagaagaccaagatggacaacctgaagtacgtgaaccagctgaagaaggagaacgagagagcccagggcaagatgaagctgctgatcaagagctgcaagcagctggaggaggagaaggagatcctgcagaaggagctgagccagctgcaggccgcccaggagaagcagaagaccggcaccgtgatggacaccaaggtggacgagctgaccaccgagatcaaggagctgaaggagaccctggaggagaagaccaaggaggccgacgagtacctggacaagtactgcagcctgctgatcagccacgagaagctggagaaggccaaggagatgctggagacccaggtggcccacctgtgcagccagcagagcaagcaggacagcagaggcagccccctgctgggccccgtggtgcccggccccagccccatccccagcgtgaccgagaagagactgagcagcggccagaacaaggccagcggcaagagacagagaagcagcggcatctgggagaacggcagaggccccacccccgccacccccgagagcttcagcaagaagagcaagaaggccgtgatgagcggcatccaccccgccgaggacaccgagggcaccgagttcgagcccgagggcctgcccgaggtggtgaagaagggcttcgccgacatccccaccggcaagaccagcccctacatcctgagaagaaccaccatggccaccagaaccagccccagactggccgcccagaagctggccctgagccccctgagcctgggcaaggagaacctggccgagagcagcaagcccaccgccggcggcagcagaagccagaaggtgaaggtggcccagagaagccccgtggacagcggcaccatcctgagagagcccaccaccaagagcgtgcccgtgaacaacctgcccgagagaagccccaccgacagccccagagagggcctgagagtgaagagaggcagactggtgcccagccccaaggccggcctggagagcaacggcagcgagaactgcaaggtgcagtag

SEQ ID NO: 76229 - DNA, 528 bp, Artificial Sequence
  Description of Artificial Sequence: Synthetic coding sequence
ctgatgatcaagggcagaaagggcaaggtgaacaagatgaccgccaaggagaccgagctgcagagagagatgcacgagatggcccagaagaccgccgagctgcaggaggagctgagcggcgagaagaacagactggccggcgagctgcagctgctgctggaggagatcaagagcagcaaggaccagctgaaggagctgaccctggagaacagcgagctgaagaagagcctggactgcatgcacaaggaccaggtggagaaggagggcaaggtgagagaggagatcgccgagtaccagctgagactgcacgaggccgagaagaagcaccaggccctgctgctggacaccaacaagcagtacgaggtggagatccagacctacagagagaagctgaccagcaaggaggagtgcctgagcagccagaagctggagatcgacctgctgaagagcagcaaggaggagctgaacaacagcctgaaggccaccacccagatcctggaggagctgaagaagaccaaggagaactag

SEQ ID NO: 76230 - DNA, 4017 bp, Artificial Sequence
  Description of Artificial Sequence: Synthetic coding sequence
atgttcctgatgcccaccagcagcgagctgaacagcggccagaacttcctgacccagtggatgaccaaccccagcagagccggcgtgatcctgaacagaggcttccccatcctggaggccgacaaggagaagagagccgccgtggacatcagcaccagcttccccatcaagggcacccacttcagcgacagcttcagcttcatcaacgaggaggacagcctgctggaggagcagaagctggagagcaacaacccctacaagccccagagcgacaagagcgagacccacaccgccttcccctgcatcaagaagggcccccaggtggccgcctgccacagcgcccccggccaccaggaggagaacaagaacgacttcatccccgacctggccagcgagttcaaggagggcgcctacaaggaccccctgttcaagaagctggagcagctgaaggaggtgcagcagaagaagcaggagcagctgaagagacagcagctggagcagctgcagagactgatggaggagcaggagaagctgctgaccatggtgagcggccagtgcaccctgcccggcctgagcctgctgcccgacgaccagagccagaagcacagaagccccggcaacaccaccaccggcgagagagccacctgctgcttccccagctacgtgtaccccgaccccacccaggaggagacctaccccagcaacatcctgagccacgagcagagcaacttctgcagaaccgcccacggcgacttcgtgctgaccagcaagagagccagccccaacctgttcagcgaggcccagtaccaggaggcccccgtggagaagaacaacctgaaggaggagaacagaaaccaccccaccggcgagagcatcctgtgctgggagaaggtgaccgagcagatccaggaggccaacgacaagaacctgcagaagcacgacgacagcagcgaggtggccaacatcgaggagagacccatcaaggccgccatcggcgagagaaagcagaccttcgaggactacctggaggagcagatccagctggaggagcaggagctgaagcagaagcagctgaaggaggccgagggccccctgcccatcaaggccaagcccaagcagcccttcctgaagagaggcgagggcctggccagattcaccaacgccaagagcaagttccagaagggcaaggagagcaagctggtgaccaaccagagcaccagcgaggaccagcccctgttcaagatggacagacagcagctgcagagaaagaccgccctgaagaacaaggagctgtgcgccgacaaccccatcctgaagaaggacagcaaggccagaaccaagagcggcagcgtgaccctgagccagaagcccaagatgctgaagtgcagcaacagaaagagcctgagccccagcggcctgaagatccagaccggcaagaagtgcgacggccagttcagagaccagatcaagttcgagaacaaggtgaccagcaacaacaaggagaacgtgaccgagtgccccaagccctgcgacaccggctgcaccggctggaacaagacccagggcaaggacagactgcccctgagcaccggccccgccagcagactggccgccaagagccccatcagagagaccatgaaggagagcgagagcagcctggacgtgagcctgcagaagaagctggagacctgggagagagagaaggagaaggagaacctggagctggacgagttcctgttcctggagcaggccgccgacgagatcagcttcagcagcaacagcagcttcgtgctgaagatcctggagagagaccagcagatctgcaagggccacagaatgagcagcacccccgtgaaggccgtgccccagaagaccaaccccgccgaccccatcagccactgcaacagaagcgaggacctggaccacaccgccagagagaaggagagcgagtgcgaggtggcccccaagcagctgcacagcctgagcagcgccgacgagctgagagagcagccctgcaagatcagaaaggccgtgcagaagagcaccagcgagaaccagaccgagtggaacgccagagacgacgagggcgtgcccaacagcgacagcagcaccgacagcgaggagcagctggacgtgaccatcaagcccagcaccgaggacagagagagaggcatcagcagcagagaggacagcccccaggtgtgcgacgacaagggccccttcaaggacaccagaacccaggaggacaagagaagagacgtggacctggacctgagcgacaaggactacagcagcgacgagagcatcatggagagcatcaagcacaaggtgagcgagcccagcagaagcagcagcctgagcctgagcaagatggacttcgacgacgagagaacctggaccgacctggaggagaacctgtgcaaccacgacgtggtgctgggcaacgagagcacctacggcaccccccagacctgctaccccaacaacgagatcggcatcctggacaagaccatcaagagaaagatcgcccccgtgaagagaggcgaggacctgagcaagagcagaagaagcagaagcccccccaccagcgagctgatgatgaagttcttccccagcctgaagcccaagcccaagagcgacagccacctgggcaacgagctgaagctgaacatcagccaggaccagccccccggcgacaacgccagaagccaggtgctgagagagaagatcatcgagctggagaccgagatcgagaagttcaaggccgagaacgccagcctggccaagctgagaatcgagagagagagcgccctggagaagctgagaaaggagatcgccgacttcgagcagcagaaggccaaggagctggccagaatcgaggagttcaagaaggaggagatgagaaagctgcagaaggagagaaaggtgttcgagaagtacaccaccgccgccagaaccttccccgacaagaaggagagagaggagatccagaccctgaagcagcagatcgccgacctgagagaggacctgaagagaaaggagaccaagtggagcagcacccacagcagactgagaagccagatccagatgctggtgagagagaacaccgacctgagagaggagatcaaggtgatggagagattcagactggacgcctggaagagagccgaggccatcgagagcagcctggaggtggagaagaaggacaagctggccaacaccagcgtgagattccagaacagccagatcagcagcggcacccaggtggagaagtacaagaagaactacctgcccatgcagggcaacccccccagaagaagcaagagcgccccccccagagacctgggcaacctggacaagggccaggccgccagccccagagagcccctggagcccctgaacttccccgaccccgagtacaaggaggaggaggaggaccaggacatccagggcgagatcagccaccccgacggcaaggtggagaaggtgtacaagaacggctgcagagtgatcctgttccccaacggcaccagaaaggaggtgagcgccgacggcaagaccatcaccgtgaccttcttcaacggcgacgtgaagcaggtgatgcccgaccagagagtgatctactactacgccgccgcccagaccacccacaccacctaccccgagggcctggaggtgctgcacttcagcagcggccagatcgagaagcactaccccgacggcagaaaggagatcaccttccccgaccagaccgtgaagaacctgttccccgacggccaggaggagagcatcttccccgacggcaccatcgtgagagtgcagagagacggcaacaagctgatcgagttcaacaacggccagagagagctgcacaccgcccagttcaagagaagagagtaccccgacggcaccgtgaagaccgtgtacgccaacggccaccaggagaccaagtacagaagcggcagaatcagagtgaaggacaaggagggcaacgtgctgatggacaccgagctgtag

SEQ ID NO: 76231 - DNA, 3411 bp, Artificial Sequence
  Description of Artificial Sequence: Synthetic coding sequence
atgttcctgatgcccaccagcagcgagctgaacagcggccagaacttcctgacccagtggatgaccaaccccagcagagccggcgtgatcctgaacagaggcttccccatcctggaggccgacaaggagaagagagccgccgtggacatcagcaccagcttccccatcaagggcacccacttcagcgacagcttcagcttcatcaacgaggaggacagcctgctggaggagcagaagctggagagcaacaacccctacaagccccagagcgacaagagcgagacccacaccgccttcccctgcatcaagaagggcccccaggtggccgcctgccacagcgcccccggccaccaggaggagaacaagaacgacttcatccccgacctggccagcgagttcaaggagggcgcctacaaggaccccctgttcaagaagctggagcagctgaaggaggtgcagcagaagaagcaggagcagctgaagagacagcagctggagcagctgcagagactgatggaggagcaggagaagctgctgaccatggtgagcggccagtgcaccctgcccggcctgagcctgctgcccgacgaccagagccagaagcacagaagccccggcaacaccaccaccggcgagagagccacctgctgcttccccagctacgtgtaccccgaccccacccaggaggagacctaccccagcaacatcctgagccacgagcagagcaacttctgcagaaccgcccacggcgacttcgtgctgaccagcaagagagccagccccaacctgttcagcgaggcccagtaccaggaggcccccgtggagaagaacaacctgaaggaggagaacagaaaccaccccaccggcgagagcatcctgtgctgggagaaggtgaccgagcagatccaggaggccaacgacaagaacctgcagaagcacgacgacagcagcgaggtggccaacatcgaggagagacccatcaaggccgccatcggcgagagaaagcagaccttcgaggactacctggaggagcagatccagctggaggagcaggagctgaagcagaagcagctgaaggaggccgagggccccctgcccatcaaggccaagcccaagcagcccttcctgaagagaggcgagggcctggccagattcaccaacgccaagagcaagttccagaagggcaaggagagcaagctggtgaccaaccagagcaccagcgaggaccagcccctgttcaagatggacagacagcagctgcagagaaagaccgccctgaagaacaaggagctgtgcgccgacaaccccatcctgaagaaggacagcaaggccagaaccaagagcggcagcgtgaccctgagccagaagcccaagatgctgaagtgcagcaacagaaagagcctgagccccagcggcctgaagatccagaccggcaagaagtgcgacggccagttcagagaccagatcaagttcgagaacaaggtgaccagcaacaacaaggagaacgtgaccgagtgccccaagccctgcgacaccggctgcaccggctggaacaagacccagggcaaggacagactgcccctgagcaccggccccgccagcagactggccgccaagagccccatcagagagaccatgaaggagagcgagagcagcctggacgtgagcctgcagaagaagctggagacctgggagagagagaaggagaaggagaacctggagctggacgagttcctgttcctggagcaggccgccgacgagatcagcttcagcagcaacagcagcttcgtgctgaagatcctggagagagaccagcagatctgcaagggccacagaatgagcagcacccccgtgaaggccgtgccccagaagaccaaccccgccgaccccatcagccactgcaacagaagcgaggacctggaccacaccgccagagagaaggagagcgagtgcgaggtggcccccaagcagctgcacagcctgagcagcgccgacgagctgagagagcagccctgcaagatcagaaaggccgtgcagaagagcaccagcgagaaccagaccgagtggaacgccagagacgacgagggcgtgcccaacagcgacagcagcaccgacagcgaggagcagctggacgtgaccatcaagcccagcaccgaggacagagagagaggcatcagcagcagagaggacagcccccaggtgtgcgacgacaagggccccttcaaggacaccagaacccaggaggacaagagaagagacgtggacctggacctgagcgacaaggactacagcagcgacgagagcatcatggagagcatcaagcacaaggtgagcgagcccagcagaagcagcagcctgagcctgagcaagatggacttcgacgacgagagaacctggaccgacctggaggagaacctgtgcaaccacgacgtggtgctgggcaacgagagcacctacggcaccccccagacctgctaccccaacaacgagatcggcatcctggacaagaccatcaagagaaagatcgcccccgtgaagagaggcgaggacctgagcaagagcagaagaagcagaagcccccccaccagcgagctgatgatgaagttcttccccagcctgaagcccaagcccaagagcgacagccacctgggcaacgagctgaagctgaacatcagccaggaccagccccccggcgacaacgccagaagccaggtgctgagagagaagatcatcgagctggagaccgagatcgagaagttcaaggccgagaacgccagcctggccaagctgagaatcgagagagagagcgccctggagaagctgagaaaggagatcgccgacttcgagcagcagaaggccaaggagctggccagaatcgaggagttcaagaaggaggagatgagaaagctgcagaaggagagaaaggtgttcgagaagtacaccaccgccgccagaaccttccccgacaagaaggagagagaggagatccagaccctgaagcagcagatcgccgacctgagagaggacctgaagagaaaggagaccaagtggagcagcacccacagcagactgagaagccagatccagatgctggtgagagagaacaccgacctgagagaggagatcaaggtgatggagagattcagactggacgcctggaagagagccgaggccatcgagagcagcctggaggtggagaagaaggacaagctggccaacaccagcgtgagattccagaacagccagatcagcagcggcacccaggtggagaagtacaagaagaactacctgcccatgcagggcaccgcccagcccccccacacccccagcagcctgctggccgaccacctgccccccctgagcagcttcagacccttcagcagaaacatccagctgtgctacaccttctag

SEQ ID NO: 76232 - DNA, 3261 bp, Artificial Sequence
  Description of Artificial Sequence: Synthetic coding sequence
atgttcctgatgcccaccagcagcgagctgaacagcggccagaacttcctgacccagtggatgaccaaccccagcagagccggcgtgatcctgaacagaggcttccccatcctggaggccgacaaggagaagagagccgccgtggacatcagcaccagcttccccatcaagggcacccacttcagcgacagcttcagcttcatcaacgaggaggacagcctgctggaggagcagaagctggagagcaacaacccctacaagccccagagcgacaagagcgagacccacaccgccttcccctgcatcaagaagggcccccaggtggccgcctgccacagcgcccccggccaccaggaggagaacaagaacgacttcatccccgacctggccagcgagttcaaggagggcgcctacaaggaccccctgttcaagaagctggagcagctgaaggaggtgcagcagaagaagcaggagcagctgaagagacagcagctggagcagctgcagagactgatggaggagcaggagaagctgctgaccatggtgagcggccagtgcaccctgcccggcctgagcctgctgcccgacgaccagagccagaagcacagaagccccggcaacaccaccaccggcgagagagccacctgctgcttccccagctacgtgtaccccgaccccacccaggaggagacctaccccagcaacatcctgagccacgagcagagcaacttctgcagaaccgcccacggcgacttcgtgctgaccagcaagagagccagccccaacctgttcagcgaggcccagtaccaggaggcccccgtggagaagaacaacctgaaggaggagaacagaaaccaccccaccggcgagagcatcctgtgctgggagaaggtgaccgagcagatccaggaggccaacgacaagaacctgcagaagcacgacgacagcagcgaggtggccaacatcgaggagagacccatcaaggccgccatcggcgagagaaagcagaccttcgaggactacctggaggagcagatccagctggaggagcaggagctgaagcagaagcagctgaaggaggccgagggccccctgcccatcaaggccaagcccaagcagcccttcctgaagagaggcgagggcctggccagattcaccaacgccaagagcaagttccagaagggcaaggagagcaagctggtgaccaaccagagcaccagcgaggaccagcccctgttcaagatggacagacagcagctgcagagaaagaccgccctgaagaacaaggagctgtgcgccgacaaccccatcctgaagaaggacagcaaggccagaaccaagagcggcagcgtgaccctgagccagaagcccaagatgctgaagtgcagcaacagaaagagcctgagccccagcggcctgaagatccagaccggcaagaagtgcgacggccagttcagagaccagatcaagttcgagaacaaggtgaccagcaacaacaaggagaacgtgaccgagtgccccaagccctgcgacaccggctgcaccggctggaacaagacccagggcaaggacagactgcccctgagcaccggccccgccagcagactggccgccaagagccccatcagagagaccatgaaggagagcgagagcagcctggacgtgagcctgcagaagaagctggagacctgggagagagagaaggagaaggagaacctggagctggacgagttcctgttcctggagcaggccgccgacgagatcagcttcagcagcaacagcagcttcgtgctgaagatcctggagagagaccagcagatctgcaagggccacagaatgagcagcacccccgtgaaggccgtgccccagaagaccaaccccgccgaccccatcagccactgcaacagaagcgaggacctggaccacaccgccagagagaaggagagcgagtgcgaggtggcccccaagcagctgcacagcctgagcagcgccgacgagctgagagagcagccctgcaagatcagaaaggccgtgcagaagagcaccagcgagaaccagaccgagtggaacgccagagacgacgagggcgtgcccaacagcgacagcagcaccgacagcgaggagcagctggacgtgaccatcaagcccagcaccgaggacagagagagaggcatcagcagcagagaggacagcccccaggtgtgcgacgacaagggccccttcaaggacaccagaacccaggaggacaagagaagagacgtggacctggacctgagcgacaaggactacagcagcgacgagagcatcatggagagcatcaagcacaaggtgagcgagcccagcagaagcagcagcctgagcctgagcaagatggacttcgacgacgagagaacctggaccgacctggaggagaacctgtgcaaccacgacgtggtgctgggcaacgagagcacctacggcaccccccagacctgctaccccaacaacgagatcggcatcctggacaagaccatcaagagaaagatcgcccccgtgaagagaggcgaggacctgagcaagagcagaagaagcagaagcccccccaccagcgagctgatgatgaagttcttccccagcctgaagcccaagcccaagagcgacagccacctgggcaacgagctgaagctgaacatcagccaggaccagccccccggcgacaacgccagaagccaggtgctgagagagaagatcatcgagctggagaccgagatcgagaagttcaaggccgagaacgccagcctggccaagctgagaatcgagagagagagcgccctggagaagctgagaaaggagatcgccgacttcgagcagcagaaggccaaggagctggccagaatcgaggagttcaagaaggaggagatgagaaagctgcagaaggagagaaaggtgttcgagaagtacaccaccgccgccagaaccttccccgacaagaaggagagagaggagatccagaccctgaagcagcagatcgccgacctgagagaggacctgaagagaaaggagaccaagtggagcagcacccacagcagactgagaagccagatccagatgctggtgagagagaacaccgacctgagagaggagatcaaggtgatggagagattcagactggacgcctggaagagagccgaggccatcgagagcagcctggaggtggagaagaaggacaagctggccgccatccacctggaggaccccagcctgcacctgctggtgatctag

SEQ ID NO: 76233 - DNA, 1035 bp, Artificial Sequence
  Description of Artificial Sequence: Synthetic coding sequence
atggacagctacagcgcccccgagagcacccccagcgccagcagcagacccgaggactacttcatcggcgccacccccctgcagaagagactggagagcgtgagaaagcagagcagcttcatcctgaccccccccagaagaaagatcccccagtgcagccagctgcaggaggacgtggacccccagaaggtggccttcctgctgcacaagcagtggaccctgtacagcctgacccccctgtacaagttcagctacagcaacctgaaggagtacagcagactgctgaacgccttcatcgtggccgagaagcagaagggcctggccgtggaggtgggcgaggacttcaacatcaaggtgatcttcagcaccctgctgggcatgaagggcacccagagagaccccgaggccttcctggtgcagatcgtgagcaagagccagctgcccagcgagaacagagagggcaaggtgctgtggaccggctggttctgctgcgtgttcggcgacagcctgctggagaccgtgagcgaggacttcacctgcctgcccctgttcctggccaacggcgccgagagcaacaccgccatcatcggcacctggttccagaagaccttcgactgctacttcagccccctggccatcaacgccttcaacctgagctggatggccgccatgtggaccgcctgcaagatggaccactacgtggccaccaccgagttcctgtggagcgtgccctgcagcccccagagcctggacatcagcttcgccatccaccccgaggacgccaaggccctgtgggacagcgtgcacaagacccccggcgaggtgacccaggaggaggtggacctgttcatggactgcctgtacagccacttccacagacacttcaagatccacctgagcgccaccagactggtgagagtgagcaccagcgtggccagcgcccacaccgacggcaagatcaagatcctgtgccacaagtacctgatcggcgtgctggcctacctgaccgagctggccatcttccagatcgagtag

SEQ ID NO: 76234 - DNA, 1173 bp, Artificial Sequence
  Description of Artificial Sequence: Synthetic coding sequence
atggacagctacagcgcccccgagagcacccccagcgccagcagcagacccgaggactacttcatcggcgccacccccctgcagaagagactggagagcgtgagaaagcagagcagcttcatcctgaccccccccagaagaaagatcccccagtgcagccagctgcaggaggacgtggacccccagaaggtggccttcctgctgcacaagcagtggaccctgtacagcctgacccccctgtacaagttcagctacagcaacctgaaggagtacagcagactgctgaacgccttcatcgtggccgagaagcagaagggcctggccgtggaggtgggcgaggacttcaacatcaaggtgatcttcagcaccctgctgggcatgaagggcacccagagagaccccgaggccttcctggtgcagggcctgatcctgagccccagactggagtacagcggcaccatcctggtggactgcaacctgtgcctgctgggcagcagcgaccccagcaccctggccttccaggtggccggcaccgccggcgcctgccaccacaccagaatcgtgagcaagagccagctgcccagcgagaacagagagggcaaggtgctgtggaccggctggttctgctgcgtgttcggcgacagcctgctggagaccgtgagcgaggacttcacctgcctgcccctgttcctggccaacggcgccgagagcaacaccgccatcatcggcacctggttccagaagaccttcgactgctacttcagccccctggccatcaacgccttcaacctgagctggatggccgccatgtggaccgcctgcaagatggaccactacgtggccaccaccgagttcctgtggagcgtgccctgcagcccccagagcctggacatcagcttcgccatccaccccgaggacgccaaggccctgtgggacagcgtgcacaagacccccggcgaggtgacccaggaggaggtggacctgttcatggactgcctgtacagccacttccacagacacttcaagatccacctgagcgccaccagactggtgagagtgagcaccagcgtggccagcgcccacaccgacggcaagatcaagatcctgtgccacaagtacctgatcggcgtgctggcctacctgaccgagctggccatcttccagatcgagtag

SEQ ID NO: 76235 - DNA, 1035 bp, Artificial Sequence; identical to SEQ ID NO: 76233
  Description of Artificial Sequence: Synthetic coding sequence

SEQ ID NO: 76236 - DNA, 615 bp, Artificial Sequence
  Description of Artificial Sequence: Synthetic coding sequence
atggacgagaccgtggccgagttcatcaagagaaccatcctgaagatccccatgaacgagctgaccaccatcctgaaggcctgggacttcctgagcgagaaccagctgcagaccgtgaacttcagacagagaaaggagagcgtggtgcagcacctgatccacctgtgcgaggagaagagagccagcatcagcgacgccgccctgctggacatcatctacatgcagttccaccagcaccagaaggtgtgggaggtgttccagatgagcaagggccccggcgaggacgtggacctgttcgacatgaagcagttcaagaacagcttcaagaagatcctgcagagagccctgaagaacgtgaccgtgagcttcagagagaccgaggagaacgccgtgtggatcagaatcgcctggggcacccagtacaccaagcccaaccagtacaagcccacctacgtggtgtactacagccagaccccctacgccttcaccagcagcagcatgctgagaagaaacacccccctgctgggccaggagctggaggccaccggcaagatctacctgagacaggaggagatcatcctggacatcaccgagatgaagaaggcctgcaactag

SEQ ID NO: 76237 - DNA, 1020 bp, Artificial Sequence
  Description of Artificial Sequence: Synthetic coding sequence
atggacgagaccgtggccgagttcatcaagagaaccatcctgaagatccccatgaacgagctgaccaccatcctgaaggcctgggacttcctgagcgagaaccagctgcagaccgtgaacttcagacagagaaaggagagcgtggtgcagcacctgatccacctgtgcgaggagaagagagccagcatcagcgacgccgccctgctggacatcatctacatgcagttccaccagcaccagaaggtgtgggaggtgttccagatgagcaagggccccggcgaggacgtggacctgttcgacatgaagcagttcaagaacagcttcaagaagatcctgcagagagccctgaagaacgtgaccgtgagcttcagagagaccgaggagaacgccgtgtggatcagaatcgcctggggcacccagtacaccaagcccaaccagtacaagcccacctacgtggtgtactacagccagaccccctacgccttcaccagcagcagcatgctgagaagaaacacccccctgctgggccaggccctgaccatcgccagcaagcaccaccagatcgtgaagatggacctgagaagcagatacctggacagcctgaaggccatcgtgttcaagcagtacaaccagaccttcgagacccacaacagcaccacccccctgcaggagagaagcctgggcctggacatcaacatggacagcagaatcatccacgagaacatcgtggagaaggagagagtgcagagaatcacccaggagaccttcggcgactacccccagccccagctggagttcgcccagtacaagctggagaccaagttcaagagcggcctgaacggcagcatcctggccgagagagaggagcccctgagatgcctgatcaagttcagcagcccccacctgctggaggccctgaagagcctggcccccgccggcatcgccgacgcccccctgagccccctgctgacctgcatccccaacaagagaatgaactacttcaagatcagagacaagtag

SEQ ID NO: 76238 - DNA, 918 bp, Artificial Sequence
  Description of Artificial Sequence: Synthetic coding sequence
atggacgagaccgtggccgagttcatcaagagaaccatcctgaagatccccatgaacgagctgaccaccatcctgaaggcctgggacttcctgagcgagaaccagctgcagaccgtgaacttcagacagagaaaggagagcgtggtgcagcacctgatccacctgtgcgaggagaagagagccagcatcagcgacgccgccctgctggacatcatctacatgcagttccaccagcaccagaaggtgtgggaggtgttccagatgagcaagggccccggcgaggacgtggacctgttcgacatgaagcagttcaagaacagcttcaagaagatcctgcagagagccctgaagaacgtgaccgtgagcttcagagagaccgaggagaacgccgtgtggatcagaatcgcctggggcacccagtacaccaagcccaaccagtacaagcccacctacgtggtgtactacagccagaccccctacgccttcaccagcagcagcatgctgagaagaaacacccccctgctgggccagaccttcgagacccacaacagcaccacccccctgcaggagagaagcctgggcctggacatcaacatggacagcagaatcatccacgagaacatcgtggagaaggagagagtgcagagaatcacccaggagaccttcggcgactacccccagccccagctggagttcgcccagtacaagctggagaccaagttcaagagcggcctgaacggcagcatcctggccgagagagaggagcccctgagatgcctgatcaagttcagcagcccccacctgctggaggccctgaagagcctggcccccgccggcatcgccgacgcccccctgagccccctgctgacctgcatccccaacaagagaatgaactacttcaagatcagagacaagtag

SEQ ID NO: 76239 - DNA, 960 bp, Artificial Sequence
  Description of Artificial Sequence: Synthetic coding sequence
atggacgagaccgtggccgagttcatcaagagaaccatcctgaagatccccatgaacgagctgaccaccatcctgaaggcctgggacttcctgagcgagaaccagctgcagaccgtgaacttcagacagagaaaggagagcgtggtgcagcacctgatccacctgtgcgaggagaagagagccagcatcagcgacgccgccctgctggacatcatctgcgaggacgtggacctgttcgacatgaagcagttcaagaacagcttcaagaagatcctgcagagagccctgaagaacgtgaccgtgagcttcagagagaccgaggagaacgccgtgtggatcagaatcgcctggggcacccagtacaccaagcccaaccagtacaagcccacctacgtggtgtactacagccagaccccctacgccttcaccagcagcagcatgctgagaagaaacacccccctgctgggccaggccctgaccatcgccagcaagcaccaccagatcgtgaagatggacctgagaagcagatacctggacagcctgaaggccatcgtgttcaagcagtacaaccagaccttcgagacccacaacagcaccacccccctgcaggagagaagcctgggcctggacatcaacatggacagcagaatcatccacgagaacatcgtggagaaggagagagtgcagagaatcacccaggagaccttcggcgactacccccagccccagctggagttcgcccagtacaagctggagaccaagttcaagagcggcctgaacggcagcatcctggccgagagagaggagcccctgagatgcctgatcaagttcagcagcccccacctgctggaggccctgaagagcctggcccccgccggcatcgccgacgcccccctgagccccctgctgacctgcatccccaacaagagaatgaactacttcaagatcagagacaagtag

SEQ ID NO: 76240 - DNA, 1062 bp, Artificial Sequence
  Description of Artificial Sequence: Synthetic coding sequence
atggacgagaccgtggccgagttcatcaagagaaccatcctgaagatccccatgaacgagctgaccaccatcctgaaggcctgggacttcctgagcgagaaccagctgcagaccgtgaacttcagacagagaaaggagagcgtggtgcagcacctgatccacctgtgcgaggagaagagagccagcatcagcgacgccgccctgctggacatcatctacatgcagttccaccagcaccagaaggtgtgggaggtgttccagatgagcaagggccccggcgaggacgtggacctgttcgacatgaagcagttcaagaacagcttcaagaagatcctgcagagagccctgaagaacgtgaccgtgagcttcagagagaccgaggagaacgccgtgtggatcagaatcgcctggggcacccagtacaccaagcccaaccagtacaagcccacctacgtggtgtactacagccagaccccctacgccttcaccagcagcagcatgctgagaagaaacacccccctgctgggccaggccctgaccatcgccagcaagcaccaccagatcgtgaagatggacctgagaagcagatacctggacagcctgaaggccatcgtgttcaagcagtacaaccagaccttcgagacccacaacagcaccacccccctgcaggagagaagcctgggcctggacatcaacatggacagcagaatcatccacgagaacatcgtggagaaggagagagtgcagagaatcacccaggagaccttcggcgactacccccagccccagctggagttcgcccagtacaagctggagaccaagttcaagagcggcctgaacggcagcatcctggccgagagagaggagcccctgagatgcctgatcaagttcagcagcccccacctgctggaggccctgaagagcctggcccccgccgccctggtgtgcagaatccagaagctgctgtgctacagcggcagccacagccagggcacccaggaccccagcagctggcagaaggacctgtacctgctgttcgtgcccctgtaccccagatgctag

SEQ ID NO: 76241 - DNA, 903 bp, Artificial Sequence
  Description of Artificial Sequence: Synthetic coding sequence
atggagcaggccaaccccctgagacccgacggcgagagcaagggcggcgtgctggcccacctggagagactggagacccaggtgagcagaagcagaaagcagagcgaggagctgcagagcgtgcaggcccaggagggcgccctgggcaccaagatccacaagctgagaagactgagagacgagctgagagccgtggtgagacacagaagagccagcgtgaaggcctgcatcgccaacgtggagcccaaccagaccgtggagatcaacgagcaggaggccctggaggagaagctggagaacgtgaaggccatcctgcaggcctaccacttcaccggcctgagcggcaagctgaccagcagaggcgtgtgcgtgtgcatcagcaccgccttcgagggcaacctgctggacagctacttcgtggacctggtgatccagaagcccctgagaatccaccaccacagcgtgcccgtgttcatccccctggaggagatcgccgccaagtacctgcagaccaacatccagcacttcctgttcagcctgtgcgagtacctgaacgcctacagcggcagaaagtaccaggccgacagactgcagagcgacttcgccgccctgctgaccggccccctgcagagaaaccccctgtgcaacctgctgagcttcacctacaagctggaccccggcggccagagcttccccttctgcgccagactgctgtacaaggacctgaccgccaccctgcccaccgacgtgaccgtgacctgccagggcgtggaggtgctgagcaccagctgggaggagcagagagccagccacgagaccctgttctgcaccaagcccctgcaccaggtgttcgccagcttcaccagaaagggcgagaagctggacatgagcctggtgagctag

SEQ ID NO: 76242 - DNA, 903 bp, Artificial Sequence; identical to SEQ ID NO: 76241
  Description of Artificial Sequence: Synthetic coding sequence

SEQ ID NO: 76243 - DNA, 885 bp, Artificial Sequence
  Description of Artificial Sequence: Synthetic coding sequence
atggccggcatcctggccagcggcctgggcgtgctggcccacctggagagactggagacccaggtgagcagaagcagaaagcagagcgaggagctgcagagcgtgcaggcccaggagggcgccctgggcaccaagatccacaagctgagaagactgagagacgagctgagagccgtggtgagacacagaagagccagcgtgaaggcctgcatcgccaacgtggagcccaaccagaccgtggagatcaacgagcaggaggccctggaggagaagctggagaacgtgaaggccatcctgcaggcctaccacttcaccggcctgagcggcaagctgaccagcagaggcgtgtgcgtgtgcatcagcaccgccttcgagggcaacctgctggacagctacttcgtggacctggtgatccagaagcccctgagaatccaccaccacagcgtgcccgtgttcatccccctggaggagatcgccgccaagtacctgcagaccaacatccagcacttcctgttcagcctgtgcgagtacctgaacgcctacagcggcagaaagtaccaggccgacagactgcagagcgacttcgccgccctgctgaccggccccctgcagagaaaccccctgtgcaacctgctgagcttcacctacaagctggaccccggcggccagagcttccccttctgcgccagactgctgtacaaggacctgaccgccaccctgcccaccgacgtgaccgtgacctgccagggcgtggaggtgctgagcaccagctgggaggagcagagagccagccacgagaccctgttctgcaccaagcccctgcaccaggtgttcgccagcttcaccagaaagggcgagaagctggacatgagcctggtgagctag

SEQ ID NO: 76244 - DNA, 309 bp, Artificial Sequence
  Description of Artificial Sequence: Synthetic coding sequence
atgcaggagaagtaccccgacgccgtgtacctgagcgagggccccagcagctgcagcatgggcatcagaagcgccagcagacccggcttcgagctggtgatcgtgtggagaatccagatcgacgaggacggcaaggtgttccccaagctggacctgctgaccaaggtgccccagagagccctggagctggacaagaacagagccatcgagaccgcccccctgagcttcagaaccctggtgggcctgctgggcatcgaggccgccctggagagcctgatcaagagcctgtgcgccgaggagaacaactag

SEQ ID NO: 76245 - DNA, 348 bp, Artificial Sequence
  Description of Artificial Sequence: Synthetic coding sequence
atggaggcccccagctggagcgtgctgcagagaagcggcgacgaggagaagtaccccgacgccgtgtacctgagcgagggccccagcagctgcagcatgggcatcagaagcgccagcagacccggcttcgagctggtgatcgtgtggagaatccagatcgacgaggacggcaaggtgttccccaagctggacctgctgaccaaggtgccccagagagccctggagctggacaagaacagagccatcgagaccgcccccctgagcttcagaaccctggtgggcctgctgggcatcgaggccgccctggagagcctgatcaagagcctgtgcgccgaggagaacaactag

SEQ ID NO: 76246 - DNA, 867 bp, Artificial Sequence
  Description of Artificial Sequence: Synthetic coding sequence
atggacgccgagctggccgaggtgagagccctgcaggccgagatcgccgccctgagaagagcctgcgaggacccccccgccccctgggaggagaagagcagagtgcagaagagcttccaggccatccaccagttcaacctggagggctggaagagcagcaaggacctgaagaaccagctgggccacctggagagcgagctgagcttcctgagcaccctgaccggcatcaacatcagaaaccacagcaagcagaccgaggacctgaccagcaccgagatgaccgagaagagcatcagaaaggtgctgcagagacacagactgagcggcaactgccacatggtgaccttccagctggagttccagatcctggagatccagaacaaggagagactgagcagcgccgtgaccgacctgaacatcatcatggagcccaccgagtgcagcgagctgagcgagttcgtgagcagagccgaggagagaaaggacctgttcatgttcttcagaagcctgcacttcttcgtggagtggttcgagtacagaaagagaaccttcaagcacctgaaggagaagtaccccgacgccgtgtacctgagcgagggccccagcagctgcagcatgggcatcagaagcgccagcagacccggcttcgagctggtgatcgtgtggagaatccagatcgacgaggacggcaaggtgttccccaagctggacctgctgaccaaggtgccccagagagccctggagctggacaagaacagagccatcgagaccgcccccctgagcttcagaaccctggtgggcctgctgggcatcgaggccgccctggagagcctgatcaagagcctgtgcgccgaggagaacaactag

SEQ ID NO: 76247 - DNA, 744 bp, Artificial Sequence
  Description of Artificial Sequence: Synthetic coding sequence
aagagagccggcagaagcgacagctgcgccgccggccccgccgccgtgagcaacgccccctggacccagagctggcagagatgcgccccctgcaagctgagaagcagaccctgcggcgagagagtgagaacccacagaagacccggcaagagaagccccgagagcagcatcagaaaggtgctgcagagacacagactgagcggcaactgccacatggtgaccttccagctggagttccagatcctggagatccagaacaaggagagactgagcagcgccgtgaccgacctgaacatcatcatggagcccaccgagtgcagcgagctgagcgagttcgtgagcagagccgaggagagaaaggacctgttcatgttcttcagaagcctgcacttcttcgtggagtggttcgagtacagaaagagaaccttcaagcacctgaaggagaagtaccccgacgccgtgtacctgagcgagggccccagcagctgcagcatgggcatcagaagcgccagcagacccggcttcgagctggtgatcgtgtggagaatccagatcgacgaggacggcaaggtgttccccaagctggacctgctgaccaaggtgccccagagagccctggagctggacaagaacagagccatcgagaccgcccccctgagcttcagaaccctggtgggcctgctgggcatcgaggccgccctggagagcctgatcaagagcctgtgcgccgaggagaacaactag

SEQ ID NO: 76248 - DNA, 807 bp, Artificial Sequence
  Description of Artificial Sequence: Synthetic coding sequence
atgagcggcaaggccaacgccagcaagaagaacgcccagcagctgaagagaaaccccaagagaaagaaggacaacgaggaggtggtgctgagcgagaacaaggtgagaaacaccgtgaagaagaacaagaaccacctgaaggacctgagcagcgagggccagaccaagcacaccaacctgaagcacggcaagaccgccgccagcaagagaaagacctggcagcccctgagcaagagcaccagagaccacctgcagaccatgatggagagcgtgatcatgaccatcctgagcaacagcatcaaggagaaggaggagatccagtaccacctgaacttcctgaagaagagactgctgcagcagtgcgagaccctgaaggtgccccccaagaagatggaggacctgaccaacgtgagcagcctgctgaacatggagagagccagagacaaggccaacgaggagggcctggccctgctgcaggaggagatcgacaagatggtggagaccaccgagctgatgaccggcaacatccagagcctgaagaacaagatccagatcctggccagcgaggtggaggaggaggaggagagagtgaagcagatgcaccagatcaacagcagcggcgtgctgagcctgcccgagctgagccagaagaccctgaaggcccccaccctgcagaaggagatcctggccctgatccccaaccagaacgccctgctgaaggacctggacatcctgcacaacagcagccagatgaagagcatgagcaccttcatcgaggaggcctacaagaagctggacgccagctag

SEQ ID NO: 76249 - DNA, 807 bp, Artificial Sequence; identical to SEQ ID NO: 76248
  Description of Artificial Sequence: Synthetic coding sequence

SEQ ID NO: 76250 - DNA, 384 bp, Artificial Sequence
  Description of Artificial Sequence: Synthetic coding sequence
atgggcgacaagcccatctgggagcagatcggcagcagcttcatccagcactactaccagctgttcgacaacgacagaacccagctgggcgccatctacatcgacgccagctgcctgacctgggagggccagcagttccagggcaaggccgccatcgtggagaagctgagcagcctgcccttccagaagatccagcacagcatcaccgcccaggaccaccagcccacccccgacagctgcatcatcagcatggtggtgggccagctgaaggccgacgaggaccccatcatgggcttccaccagatgttcctgctgaagaacatcaacgacgcctgggtgtgcaccaacgacatgttcagactggccctgcacaacttcggctag

SEQ ID NO: 76251 - DNA, 786 bp, Artificial Sequence
  Description of Artificial Sequence: Synthetic coding sequence
atgagctggtgctgcctgtggctgtgcctgagcagcgtgggcagaaccggcagcgccggccccagcctgcccttcagcgagctgtgcagcctgggcctgctgagactgagacccgtgttcagccccctgcacagcggccccggcaagcccgcccagttcctggccggcgaggccgaggaggtgaacgccttcgccctgggcttcctgagcaccagcagcggcgtgagcggcgaggacgaggtggagcccctgcacgacggcgtggaggaggccgagaagaagatggaggaggagggcgtgagcgtgagcgagatggaggccaccggcgcccagggccccagcagagtggaggaggccgagggccacaccgaggtgaccgaggccgagggcagccagggcaccgccgaggccgacggccccggcgccagcagcggcgacgaggacgccagcggcagagccgccagccccgagagcgccagcagcacccccgagagcctgcaggccagaagacaccaccagttcctggagcccgcccccgcccccggcgccgccgtgctgagcagcgagcccgccgagcccctgctggtgagacacccccccagacccagaaccaccggccccagacccagacaggacccccacaaggccggcctgagccactacgtgaagctgttcagcttctacgccaagatgcccatggagagaaaggccctggagatggtggagaagtgcatcttcgtgatgatctggagatacctgctgctgatgctggccgccagactgtag

SEQ ID NO: 76252 - DNA, 1686 bp, Artificial Sequence
  Description of Artificial Sequence: Synthetic coding sequence
atggccgaccacaaccccgacagcgacagcacccccagaaccctgctgagaagagtgctggacaccgccgaccccagaacccccagaagacccagaagcgccagagccggcgccagaagagccctgctggagaccgccagccccagaaagctgagcggccagaccagaaccatcgccagaggcagaagccacggcgccagaagcgtgggcagaagcgcccacatccaggccagcggccacctggaggagcagacccccagaaccctgctgaagaacatcctgctgaccgcccccgagagcagcatcctgatgcccgagagcgtggtgaagcccgtgcccgccccccaggccgtgcagcccagcagacaggagagcagctgcggcagcctggagctgcagctgcccgagctggagccccccaccaccctggcccccggcctgctggcccccggcagaagaaagcagagactgagactgagcgtgttccagcagggcgtggaccagggcctgagcctgagccaggagccccagggcaacgccgacgccagcagcctgaccagaagcctgaacctgaccttcgccacccccctgcagccccagagcgtgcagagacccggcctggccagaagaccccccgccagaagagccgtggacgtgggcgccttcctgagagacctgagagacaccagcctggccccccccaacatcgtgctggaggacacccagcccttcagccagcccatggtgggcagccccaacgtgtaccacagcctgccctgcaccccccacaccggcgccgaggacgccgagcaggccgccggcagaaagacccagagcagcggccccggcctgcagaagaacagccccggcaagcccgcccagttcctggccggcgaggccgaggaggtgaacgccttcgccctgggcttcctgagcaccagcagcggcgtgagcggcgaggacgaggtggagcccctgcacgacggcgtggaggaggccgagaagaagatggaggaggagggcgtgagcgtgagcgagatggaggccaccggcgcccagggccccagcagagtggaggaggccgagggccacaccgaggtgaccgaggccgagggcagccagggcaccgccgaggccgacggccccggcgccagcagcggcgacgaggacgccagcggcagagccgccagccccgagagcgccagcagcacccccgagagcctgcaggccagaagacaccaccagttcctggagcccgcccccgcccccggcgccgccgtgctgagcagcgagcccgccgagcccctgctggtgagacacccccccagacccagaaccaccggccccagacccagacaggacccccacaaggccggcctgagccactacgtgaagctgttcagcttctacgccaagatgcccatggagagaaaggccctggagatggtggagaagtgcctggacaagtacttccagcacctgtgcgacgacctggaggtgttcgccgcccacgccggcagaaagaccgtgaagcccgaggacctggagctgctgatgagaagacagggcctggtgaccgaccaggtgagcctgcacgtgctggtggagagacacctgcccctggagtacagacagctgctgatcccctgcgcctacagcggcaacagcgtgttccccgcccagtag

SEQ ID NO: 76253 - DNA, 447 bp, Artificial Sequence
  Description of Artificial Sequence: Synthetic coding sequence
atgcccgagagcgtggtgaagcccgtgcccgccccccaggccgtgcagcccagcagacaggagagcagctgcggcagcctggagctgcagctgcccgagctggagccccccaccaccctggcccccggcctgctggcccccggcagaagaaagcagagactgagactgagcgtgttccagcagggcgtggaccagggcctgagcctgagccaggagccccagggcaacgccgacgccagcagcctgaccagaagcctgaacctgaccttcgccacccccctgcagccccagagcgtgcagagacccggcctggccagaagaccccccgccagaagagccgtggacgtgggcgccttcctgagagacctgagagacaccagcctggccccccccagcaaggtgggcttcagccccgccggcctgtggggcaagctgagccccctgtag

SEQ ID NO: 76254 - DNA, 1686 bp, Artificial Sequence; identical to SEQ ID NO: 76252
  Description of Artificial Sequence: Synthetic coding sequence

SEQ ID NO: 76255 - DNA, 819 bp, Artificial Sequence
  Description of Artificial Sequence: Synthetic coding sequence
atgagaagaagcagaagcagcgccgccgccaagctgagaggccagaagagaagcggcgccagcgccgcccccgccgccagcgccgccgccgccctggcccccagcgccaccagaaccagaagaagcgccagccaggccggcagcaagagccaggccgtggagaagccccccagcgagaagcccagactgagaagaagcagccccagagcccaggaggagggccccggcgagccccccccccccgagctggccctgctgccccccccccccccccccccccccacccccgccacccccaccagcagcgccagcaacctggacctgggcgagcagagagagagatgggagaccttccagaagagacagaagctgaccagcgagggcgccgccaagctgctgctggacaccttcgagtaccagggcctggtgaagcacaccggcggctgccactgcggcgccgtgagattcgaggtgtgggccagcgccgacctgcacatcttcgactgcaactgcagcatctgcaagaagaagcagaacagacacttcatcgtgcccgccagcagattcaagctgctgaagggcgccgagcacatcaccacctacaccttcaacacccacaaggcccagcacaccttctgcaagagatgcggcgtgcagagcttctacacccccagaagcaaccccggcggcttcggcatcgccccccactgcctggacgagggcaccgtgagaagcatggtgaccgaggagttcaacggcagcgactgggagaaggccatgaaggagcacaagaccatcaagaacatgagcaaggagtag

SEQ ID NO: 76256 - DNA, 2961 bp, Artificial Sequence
  Description of Artificial Sequence: Synthetic coding sequence
atggtgagcaagagcgaccagctgctgatcgtggtgagcatcctggagggcagacacttccccaagagacccaagcacatgctggtggtggaggccaagttcgacggcgagcagctggccaccgaccccgtggaccacaccgaccagcccgagttcgccaccgagctggcctgggagatcgacagaaaggccctgcaccagcacagactgcagagaacccccatcaagctgcagtgcttcgccctggaccccgtgaccagcgccaaggagaccatcggctacatcgtgctggacctgagaaccgcccaggagaccaagcaggcccccaagtggtaccagctgctgagcaacaagtacaccaagttcaagagcgagatccagatcagcatcgccctggagaccgacaccaagccccccgtggacagcttcaaggccaagggcgccccccccagagacggcaaggtgcccgccatcctggccggcctggaccccagagacatcgtggccgtgctgaacgaggagggcggctaccaccagatcggccccgccgagtactgcaccgacagcttcatcatgagcgtgaccatcgccttcgccacccagctggagcagctgatcccctgcaccatgaagctgcccgagagacagcccgagttcttcttctactacagcctgctgggcaacgacgtgaccaacgagcccttcaacgacctgatcaaccccaacttcgagcccgagagagccagcgtgagaatcagaagcagcgtggagatcctgagagtgtacctggccctgcagagcaagctgcagatccacctgtgctgcggcgaccagagcctgggcagcaccgagatccccctgaccggcctgctgaagaagggcagcaccgagatcaaccagcaccccgtgaccgtggagggcgccttcaccctggacccccccaacagagccaagcagaagctggcccccatccccgtggagctggcccccaccgtgggcgtgagcgtggccctgcagagagagggcatcgacagccagagcctgatcgagctgaagacccagaacgagcacgagcccgagcacagcaagaagaaggtgctgacccccatcaaggagaagaccctgaccggccccaagagccccaccgtgagccccgtgcccagccacaaccagagcccccccaccaaggacgacgccaccgagagcgaggtggagagcctgcagtacgacaaggacaccaagcccaaccccaaggccagcagcagcgtgcccgccagcctggcccagctggtgaccaccagcaacgccagcgaggtggccagcggccagaagatcgccgtgcccgccaccagccaccacttctgcttcagcatcgacctgagaagcatccacgccctggagatcggcttccccatcaactgcatcctgagatacagctaccccttcttcggcagcgccgcccccatcatgaccaacccccccgtggaggtgagaaagaacatggaggtgttcctgccccagagctactgcgccttcgacttcgccaccatgccccaccagctgcaggacaccttcctgagaatccccctgctggtggagctgtggcacaaggacaagatgagcaaggacctgctgctgggcatcgccagaatccagctgagcaacatcctgagcagcgagaagaccagattcctgggcagcaacggcgagcagtgctggagacagacctacagcgagagcgtgcccgtgatcgccgcccagggcagcaacaacagaatcgccgacctgagctacaccgtgaccctggaggactacggcctggtgaagatgagagagatcttcatcagcgacagcagccagggcgtgagcgccgtgcagcagaagcccagcagcctgccccccgccccctgccccagcgagatccagaccgagcccagagagaccctggagtacaaggccgccctggagctggagatgtggaaggagatgcaggaggacatcttcgagaaccagctgaagcagaaggagctggcccacatgcaggccctggccgaggagtggaagaagagagacagagagagagagagcctggtgaagaagaaggtggccgagtacaccatcctggagggcaagctgcagaagaccctgatcgacctggagaagagagagcagcagctggccagcgtggagagcgagctgcagagagagaagaaggagctgcagagcgagagacagagaaacctgcaggagctgcaggacagcatcagaagagccaaggaggactgcatccaccaggtggagctggagagactgaagatcaagcagctggaggaggacaagcacagactgcagcagcagctgaacgacgccgagaacaagtacaagatcctggagaaggagttccagcagttcaaggaccagcagaacaacaagcccgagatcagactgcagagcgagatcaacctgctgaccctggagaaggtggagctggagagaaagctggagagcgccaccaagagcaagctgcactacaagcagcagtggggcagagccctgaaggagctggccagactgaagcagagagagcaggagagccagatggccagactgaagaagcagcaggaggagctggagcagatgagactgagatacctggccgccgaggagaaggacaccgtgaagaccgagagacaggagctgctggacatcagaaacgagctgaacagactgagacagcaggagcagaagcagtaccaggacagcaccgagatcgccagcggcaagaaggacggcccccacggcagcgtgctggaggagggcctggacgactacctgaccagactgatcgaggagagagacaccctgatgagaaccggcgtgtacaaccacgaggacagaatcatcagcgagctggacagacagatcagagagatcctggccaagagcaacgccagcaactag

SEQ ID NO: 76257 - DNA, 2883 bp, Artificial Sequence
  Description of Artificial Sequence: Synthetic coding sequence
atgctggtggtggaggccaagttcgacggcgagcagctggccaccgaccccgtggaccacaccgaccagcccgagttcgccaccgagctggcctgggagatcgacagaaaggccctgcaccagcacagactgcagagaacccccatcaagctgcagtgcttcgccctggaccccgtgaccagcgccaaggagaccatcggctacatcgtgctggacctgagaaccgcccaggagaccaagcaggcccccaagtggtaccagctgctgagcaacaagtacaccaagttcaagagcgagatccagatcagcatcgccctggagaccgacaccaagccccccgtggacagcttcaaggccaagggcgccccccccagagacggcaaggtgcccgccatcctggccggcctggaccccagagacatcgtggccgtgctgaacgaggagggcggctaccaccagatcggccccgccgagtactgcaccgacagcttcatcatgagcgtgaccatcgccttcgccacccagctggagcagctgatcccctgcaccatgaagctgcccgagagacagcccgagttcttcttctactacagcctgctgggcaacgacgtgaccaacgagcccttcaacgacctgatcaaccccaacttcgagcccgagagagccagcgtgagaatcagaagcagcgtggagatcctgagagtgtacctggccctgcagagcaagctgcagatccacctgtgctgcggcgaccagagcctgggcagcaccgagatccccctgaccggcctgctgaagaagggcagcaccgagatcaaccagcaccccgtgaccgtggagggcgccttcaccctggacccccccaacagagccaagcagaagctggcccccatccccgtggagctggcccccaccgtgggcgtgagcgtggccctgcagagagagggcatcgacagccagagcctgatcgagctgaagacccagaacgagcacgagcccgagcacagcaagaagaaggtgctgacccccatcaaggagaagaccctgaccggccccaagagccccaccgtgagccccgtgcccagccacaaccagagcccccccaccaaggacgacgccaccgagagcgaggtggagagcctgcagtacgacaaggacaccaagcccaaccccaaggccagcagcagcgtgcccgccagcctggcccagctggtgaccaccagcaacgccagcgaggtggccagcggccagaagatcgccgtgcccgccaccagccaccacttctgcttcagcatcgacctgagaagcatccacgccctggagatcggcttccccatcaactgcatcctgagatacagctaccccttcttcggcagcgccgcccccatcatgaccaacccccccgtggaggtgagaaagaacatggaggtgttcctgccccagagctactgcgccttcgacttcgccaccatgccccaccagctgcaggacaccttcctgagaatccccctgctggtggagctgtggcacaaggacaagatgagcaaggacctgctgctgggcatcgccagaatccagctgagcaacatcctgagcagcgagaagaccagattcctgggcagcaacggcgagcagtgctggagacagacctacagcgagagcgtgcccgtgatcgccgcccagggcagcaacaacagaatcgccgacctgagctacaccgtgaccctggaggactacggcctggtgaagatgagagagatcttcatcagcgacagcagccagggcgtgagcgccgtgcagcagaagcccagcagcctgccccccgccccctgccccagcgagatccagaccgagcccagagagaccctggagtacaaggccgccctggagctggagatgtggaaggagatgcaggaggacatcttcgagaaccagctgaagcagaaggagctggcccacatgcaggccctggccgaggagtggaagaagagagacagagagagagagagcctggtgaagaagaaggtggccgagtacaccatcctggagggcaagctgcagaagaccctgatcgacctggagaagagagagcagcagctggccagcgtggagagcgagctgcagagagagaagaaggagctgcagagcgagagacagagaaacctgcaggagctgcaggacagcatcagaagagccaaggaggactgcatccaccaggtggagctggagagactgaagatcaagcagctggaggaggacaagcacagactgcagcagcagctgaacgacgccgagaacaagtacaagatcctggagaaggagttccagcagttcaaggaccagcagaacaacaagcccgagatcagactgcagagcgagatcaacctgctgaccctggagaaggtggagctggagagaaagctggagagcgccaccaagagcaagctgcactacaagcagcagtggggcagagccctgaaggagctggccagactgaagcagagagagcaggagagccagatggccagactgaagaagcagcaggaggagctggagcagatgagactgagatacctggccgccgaggagaaggacaccgtgaagaccgagagacaggagctgctggacatcagaaacgagctgaacagactgagacagcaggagcagaagcagtaccaggacagcaccgagatcgccagcggcaagaaggacggcccccacggcagcgtgctggaggagggcctggacgactacctgaccagactgatcgaggagagagacaccctgatgagaaccggcgtgtacaaccacgaggacagaatcatcagcgagctggacagacagatcagagagatcctggccaagagcaacgccagcaactag

SEQ ID NO: 76258 - DNA, 2961 bp, Artificial Sequence; identical to SEQ ID NO: 76256
  Description of Artificial Sequence: Synthetic coding sequence

SEQ ID NO: 76259 - DNA, 1143 bp, Artificial Sequence
  Description of Artificial Sequence: Synthetic coding sequence
atggtgagcaagagcgaccagctgctgatcgtggtgagcatcctggagggcagacacttccccaagagacccaagcacatgctggtggtggaggccaagttcgacggcgagcagctggccaccgaccccgtggaccacaccgaccagcccgagttcgccaccgagctggcctgggagatcgacagaaaggccctgcaccagcacagactgcagagaacccccatcaagctgcagtgcttcgccctggaccccgtgaccagcgccaaggagaccatcggctacatcgtgctggacctgagaaccgcccaggagaccaagcaggcccccaagtggtaccagctgctgagcaacaagtacaccaagttcaagagcgagatccagatcagcatcgccctggagaccgacaccaagccccccgtggacagcttcaaggccaagggcgccccccccagagacggcaaggtgcccgccatcctggccggcctggaccccagagacatcgtggccgtgctgaacgaggagggcggctaccaccagatcggccccgccgagtactgcaccgacagcttcatcatgagcgtgaccatcgccttcgccacccagctggagcagctgatcccctgcaccatgaagctgcccgagagacagcccgagttcttcttctactacagcctgctgggcaacgacgtgaccaacgagcccttcaacgacctgatcaaccccaacttcgagcccgagagagccagcgtgagaatcagaagcagcgtggagatcctgagagtgtacctggccctgcagagcaagctgcagatccacctgtgctgcggcgaccagagcctgggcagcaccgagatccccctgaccggcctgctgaagaagggcagcaccgagatcaaccagcaccccgtgaccgtggagggcgccttcaccctggacccccccaacagagccaagcagaagctggcccccatccccgtggagctggcccccaccgtgggcgtgagcgtggccctgcagagagagggcatcgacagccaggacgccttctggtacagcgccctggacatcatcttccccctgttcatcttcctgttcctggtgctggacgccatcagaaagttcgccaactacgaggagaagtag

SEQ ID NO: 76260 - DNA, 3828 bp, Artificial Sequence
  Description of Artificial Sequence: Synthetic coding sequence
atgagcctggacttcggcagcgtggccctgcccgtgcagaacgaggacgaggagtacgacgaggaggactacgagagagagaaggagctgcagcagctgctgaccgacctgccccacgacatgctggacgacgacctgagcagccccgagctgcagtacagcgactgcagcgaggacggcaccgacggccagccccaccaccccgagcagctggagatgagctggaacgagcagatgctgcccaagagccagagcgtgaacggccccagctgccagggcctggagccctacaacaaggtgacctacaagccctaccagagcagcgcccagaacaacggcagccccgcccaggagatcaccggcagcgacaccttcgagggcctgcagcagcagttcctgggcgccaacgagaacagcgccgagaacatgcagatcatccagctgcaggtgctgaacaaggccaaggagagacagctggagaacctgatcgagaagctgaacgagagcgagagacagatcagatacctgaaccaccagctggtgatcatcaaggacgagaaggacggcctgaccctgagcctgagagagagccagaagctgttccagaacggcaaggagagagagatccagctggaggcccagatcaaggccctggagacccagatccaggccctgaaggtgaacgaggagcagatgatcaagaagagcagaaccaccgagatggccctggagagcctgaagcagcagctggtggacctgcaccacagcgagagcctgcagagagccagagagcagcacgagagcatcgtgatgggcctgaccaagaagtacgaggagcaggtgctgagcctgcagaagaacctggacgccaccgtgaccgccctgaaggagcaggaggacatctgcagcagactgaaggaccacgtgaagcagctggagagaaaccaggaggccatcaagctggagaagaccgagatcatcaacaagctgaccagaagcctggaggagagccagaagcagtgcgcccacctgctgcagagcggcagcgtgcaggaggtggcccagctgcagttccagctgcagcaggcccagaaggcccacgccatgagcgccaacatgaacaaggccctgcaggaggagctgaccgagctgaaggacgagatcagcctgtacgagagcgccgccaagctgggcatccaccccagcgacagcgagggcgagctgaacatcgagctgaccgagagctacgtggacctgggcatcaagaaggtgaactggaagaagagcaaggtgaccagcatcgtgcaggaggaggaccccaacgaggagctgagcaaggacgagttcatcctgaagctgaaggccgaggtgcagagactgctgggcagcaacagcatgaagagacacctggtgagccagctgcagaacgacctgaaggactgccacaagaagatcgaggacctgcaccaggtgaagaaggacgagaagagcatcgaggtggagaccaagaccgacaccagcgagaagcccaagaaccagctgtggcccgagagcagcaccagcgacgtggtgagagacgacatcctgctgctgaagaacgagatccaggtgctgcagcagcagaaccaggagctgaaggagaccgagggcaagctgagaaacaccaaccaggacctgtgcaaccagatgagacagatggtgcaggacttcgaccacgacaagcaggaggccgtggacagatgcgagagaacctaccagcagcaccacgaggccatgaagacccagatcagagagagcctgctggccaagcacgccctggagaagcagcagctgttcgaggcctacgagagaacccacctgcagctgagaagcgagctggacaagctgaacaaggaggtgaccgccgtgcaggagtgctacctggaggtgtgcagagagaaggacaacctggagctgaccctgagaaagaccaccgagaaggagcagcagacccaggagaagatcaaggagaagctgatccagcagctggagaaggagtggcagagcaagctggaccagaccatcaaggccatgaagaagaagaccctggactgcggcagccagaccgaccaggtgaccaccagcgacgtgatcagcaagaaggagatggccatcatgatcgaggagcagaagtgcaccatccagcagaacctggagcaggagaaggacatcgccatcaagggcgccatgaagaagctggagatcgagctggagctgaagcactgcgagaacatcaccaagcaggtggagatcgccgtgcagaacgcccaccagagatggctgggcgagctgcccgagctggccgagtaccaggccctggtgaaggccgagcagaagaagtgggaggagcagcacgaggtgagcgtgaacaagagaatcagcttcgccgtgagcgaggccaaggagaagtggaagagcgagctggagaacatgagaaagaacatcctgcccggcaaggagctggaggagaagatccacagcctgcagaaggagctggagctgaagaacgaggaggtgcccgtggtgatcagagccgagctggccaaggccagaagcgagtggaacaaggagaagcaggaggagatccacagaatccaggagcagaacgagcaggactacagacagttcctggacgaccacagaaacaagatcaacgaggtgctggccgccgccaaggaggacttcatgaagcagaagaccgagctgctgctgcagaaggagaccgagctgcagacctgcctggaccagagcagaagagagtggaccatgcaggaggccaagagaatccagctggagatctaccagtacgaggaggacatcctgaccgtgctgggcgtgctgctgagcgacacccagaaggagcacatcagcgacagcgaggacaagcagctgctggagatcatgagcacctgcagcagcaagtggatgagcgtgcagtacttcgagaagctgaagggctgcatccagaaggccttccaggacaccctgcccctgctggtggagaacgccgaccccgagtggaagaagagaaacatggccgagctgagcaaggacagcgccagccagggcaccggccagggcgaccccggccccgccgccggccaccacgcccagcccctggccctgcaggccaccgaggccgaggccgacaagaagaaggtgctggagatcaaggacctgtgctgcggccactgcttccaggagctggagaaggccaagcaggagtgccaggacctgaagggcaagctggagaagtgctgcagacacctgcagcacctggagagaaagcacaaggccgtggtggagaagatcggcgaggagaacaacaaggtggtggaggagctgatcgaggagaacaacgacatgaagaacaagctggaggagctgcagaccctgtgcaagaccccccccagaagcctgagcgccggcgccatcgagaacgcctgcctgccctgcagcggcggcgccctggaggagctgagaggccagtacatcaaggccgtgaagaagatcaagtgcgacatgctgagatacatccaggagagcaaggagagagccgccgagatggtgaaggccgaggtgctgagagagagacaggagaccgccagaaagatgagaaagtactacctgatctgcctgcagcagatcctgcaggacgacggcaaggagggcgccgagaagaagatcatgaacgccgccagcaagctggccaccatggccaagctgctggagacccccatcagcagcaagagccagagcaagaccacccagagcggcatgagcaagtag

SEQ ID NO: 76261 - DNA, 5133 bp, Artificial Sequence
  Description of Artificial Sequence: Synthetic coding sequence
atgagcctggacttcggcagcgtggccctgcccgtgcagaacgaggacgaggagtacgacgaggaggactacgagagagagaaggagctgcagcagctgctgaccgacctgccccacgacatgctggacgacgacctgagcagccccgagctgcagtacagcgactgcagcgaggacggcaccgacggccagccccaccaccccgagcagctggagatgagctggaacgagcagatgctgcccaagagccagagcgtgaacggctacaacgagatccagagcctgtacgccggcgagaagtgcggcaacgtgtgggaggagaacagaagcaagaccgaggacagacaccccgtgtaccaccccgaggagggcggcgacgagggcggcagcggctacagcccccccagcaagtgcgagcagaccgacctgtaccacctgcccgagaacttcagaccctacaccaacggccagaagcaggagttcaacaaccaggccaccaacgtgatcaagttcagcgacccccagtggaaccacttccagggccccagctgccagggcctggagccctacaacaaggtgacctacaagccctaccagagcagcgcccagaacaacggcagccccgcccaggagatcaccggcagcgacaccttcgagggcctgcagcagcagttcctgggcgccaacgagaacagcgccgagaacatgcagatcatccagctgcaggtgctgaacaaggccaaggagagacagctggagaacctgatcgagaagctgaacgagagcgagagacagatcagatacctgaaccaccagctggtgatcatcaaggacgagaaggacggcctgaccctgagcctgagagagagccagaagctgttccagaacggcaaggagagagagatccagctggaggcccagatcaaggccctggagacccagatccaggccctgaaggtgaacgaggagcagatgatcaagaagagcagaaccaccgagatggccctggagagcctgaagcagcagctggtggacctgcaccacagcgagagcctgcagagagccagagagcagcacgagagcatcgtgatgggcctgaccaagaagtacgaggagcaggtgctgagcctgcagaagaacctggacgccaccgtgaccgccctgaaggagcaggaggacatctgcagcagactgaaggaccacgtgaagcagctggagagaaaccaggaggccatcaagctggagaagaccgagatcatcaacaagctgaccagaagcctggaggagagccagaagcagtgcgcccacctgctgcagagcggcagcgtgcaggaggtggcccagctgcagttccagctgcagcaggcccagaaggcccacgccatgagcgccaacatgaacaaggccctgcaggaggagctgaccgagctgaaggacgagatcagcctgtacgagagcgccgccaagctgggcatccaccccagcgacagcgagggcgagctgaacatcgagctgaccgagagctacgtggacctgggcatcaagaaggtgaactggaagaagagcaaggtgaccagcatcgtgcaggaggaggaccccaacgaggagctgagcaaggacgagttcatcctgaagctgaaggccgaggtgcagagactgctgggcagcaacagcatgaagagacacctggtgagccagctgcagaacgacctgaaggactgccacaagaagatcgaggacctgcaccaggtgaagaaggacgagaagagcatcgaggtggagaccaagaccgacaccagcgagaagcccaagaaccagctgtggcccgagagcagcaccagcgacgtggtgagagacgacatcctgctgctgaagaacgagatccaggtgctgcagcagcagaaccaggagctgaaggagaccgagggcaagctgagaaacaccaaccaggacctgtgcaaccagatgagacagatggtgcaggacttcgaccacgacaagcaggaggccgtggacagatgcgagagaacctaccagcagcaccacgaggccatgaagacccagatcagagagagcctgctggccaagcacgccctggagaagcagcagctgttcgaggcctacgagagaacccacctgcagctgagaagcgagctggacaagctgaacaaggaggtgaccgccgtgcaggagtgctacctggaggtgtgcagagagaaggacaacctggagctgaccctgagaaagaccaccgagaaggagcagcagacccaggagaagatcaaggagaagctgatccagcagctggagaaggagtggcagagcaagctggaccagaccatcaaggccatgaagaagaagaccctggactgcggcagccagaccgaccaggtgaccaccagcgacgtgatcagcaagaaggagatggccatcatgatcgaggagcagaagtgcaccatccagcagaacctggagcaggagaaggacatcgccatcaagggcgccatgaagaagctggagatcgagctggagctgaagcactgcgagaacatcaccaagcaggtggagatcgccgtgcagaacgcccaccagagatggctgggcgagctgcccgagctggccgagtaccaggccctggtgaaggccgagcagaagaagtgggaggagcagcacgaggtgagcgtgaacaagagaatcagcttcgccgtgagcgaggccaaggagaagtggaagagcgagctggagaacatgagaaagaacatcctgcccggcaaggagctggaggagaagatccacagcctgcagaaggagctggagctgaagaacgaggaggtgcccgtggtgatcagagccgagctggccaaggccagaagcgagtggaacaaggagaagcaggaggagatccacagaatccaggagcagaacgagcaggactacagacagttcctggacgaccacagaaacaagatcaacgaggtgctggccgccgccaaggaggacttcatgaagcagaagaccgagctgctgctgcagaaggagaccgagctgcagacctgcctggaccagagcagaagagagtggaccatgcaggaggccaagagaatccagctggagatctaccagtacgaggaggacatcctgaccgtgctgggcgtgctgctgagcgacacccagaaggagcacatcagcgacagcgaggacaagcagctgctggagatcatgagcacctgcagcagcaagtggatgagcgtgcagtacttcgagaagctgaagggctgcatccagaaggccttccaggacaccctgcccctgctggtggagaacgccgaccccgagtggaagaagagaaacatggccgagctgagcaaggacagcgccagccagggcaccggccagggcgaccccggccccgccgccggccaccacgcccagcccctggccctgcaggccaccgaggccgaggccgacaagaagaaggtgctggagatcaaggacctgtgctgcggccactgcttccaggagctggagaaggccaagcaggagtgccaggacctgaagggcaagctggagaagtgctgcagacacctgcagcacctggagagaaagcacaaggccgtggtggagaagatcggcgaggagaacaacaaggtggtggaggagctgatcgaggagaacaacgacatgaagaacaagctggaggagctgcagaccctgtgcaagaccccccccagaagcctgagcgccggcgccatcgagaacgcctgcctgccctgcagcggcggcgccctggaggagctgagaggccagtacatcaaggccgtgaagaagatcaagtgcgacatgctgagatacatccaggagagcaaggagagagccgccgagatggtgaaggccgaggtgctgagagagagacaggagaccgccagaaagatgagaaagtactacctgatctgcctgcagcagatcctgcaggacgacggcaaggagggcgccgagaagaagatcatgaacgccgccagcaagctggccaccatggccaagctgctggagacccccatcagcagcaagagccagagcaagaccacccagagcgccctgcccctgaccagcgagatgctgatcgccgtgaagaagagcaagagaaacgacgtgaaccagaagatcccctgctgcatcgagagcaagagcaacagcgtgaacaccatcaccagaaccctgtgcgagcaggcccccaagagaagagccgcctgcaacctgcagagactgctggagaacagcgagcaccagagcatcaagcacgtgggcagcaaggagacccacctggagttccagttcggcgacggcagctgcaagcacctgaacagcctgcccagaaacgtgagccccgagttcgtgccctgcgagggcgagggcggcttcggcctgcacaagaagaaggacctgctgagcgacaacggcagcgagagcctgccccacagcgccgcctaccccttcctgggcaccctgggcaacaagcccagccccagatgcacccccggccccagcgagagcggctgcatgcacatcaccttcagagacagcaacgagagactgggcctgaaggtgtacaagtgcaaccccctgatggagagcgagaacgccgccagcgagaagagccagggcctggacgtgcaggagccccccgtgaaggacggcggcgacctgagcgactgcctgggctggcccagcagcagcgccaccctgagcttcgacagcagagaggccagcttcgtgcacggcagaccccagggcaccctggagatccccagcgagagcgtgaagagcaagcagttcagccccagcggctacctgagcgacaccgaggagagcaacatgatctgccagaccatgaagtgccagagataccagaccccctacctgagcgaggagaccacctacctggagcccggcaagatcagcgtgaactgcggccaccccagcagacacaaggccgacagactgaagagcgacttcaagaagctgagcagcaccctgcccagcagcgtgtgccagcagcccagcagaaagctgatcgtgcccctgagcagccagcaggacagcggcttcgacagccccttcgtgaacctggactag

SEQ ID NO: 76262 - DNA, 4965 bp, Artificial Sequence
  Description of Artificial Sequence: Synthetic coding sequence
atgagcctggacttcggcagcgtggccctgcccgtgcagaacgaggacgaggagtacgacgaggaggactacgagagagagaaggagctgcagcagctgctgaccgacctgccccacgacatgctggacgacgacctgagcagccccgagctgcagtacagcgactgcagcgaggacggcaccgacggccagccccaccaccccgagcagctggagatgagctggaacgagcagatgctgcccaagagccagagcgtgaacggctacaacgagatccagagcctgtacgccggcgagaagtgcggcaacgtgtgggaggagaacagaagcaagaccgaggacagacaccccgtgtaccaccccgaggagggcggcgacgagggcggcagcggctacagcccccccagcaagtgcgagcagaccgacctgtaccacctgcccgagaacttcagaccctacaccaacggccagaagcaggagttcaacaaccaggccaccaacgtgatcaagttcagcgacccccagtggaaccacttccagggccccagctgccagggcctggagccctacaacaaggtgacctacaagccctaccagagcagcgcccagaacaacggcagccccgcccaggagatcaccggcagcgacaccttcgagggcctgcagcagcagttcctgggcgccaacgagaacagcgccgagaacatgcagatcatccagctgcaggtgctgaacaaggccaaggagagacagctggagaacctgatcgagaagctgaacgagagcgagagacagatcagatacctgaaccaccagctggtgatcatcaaggacgagaaggacggcctgaccctgagcctgagagagagccagaagctgttccagaacggcaaggagagagagatccagctggaggcccagatcaaggccctggagacccagatccaggccctgaaggtgaacgaggagcagatgatcaagaagagcagaaccaccgagatggccctggagagcctgaagcagcagctggtggacctgcaccacagcgagagcctgcagagagccagagagcagcacgagagcatcgtgatgggcctgaccaagaagtacgaggagcaggtgctgagcctgcagaagaacctggacgccaccgtgaccgccctgaaggagcaggaggacatctgcagcagactgaaggaccacgtgaagcagctggagagaaaccaggaggccatcaagctggagaagaccgagatcatcaacaagctgaccagaagcctggaggagagccagaagcagtgcgcccacctgctgcagagcggcagcgtgcaggaggtggcccagctgcagttccagctgcagcaggcccagaaggcccacgccatgagcgccaacatgaacaaggccctgcaggaggagctgaccgagctgaaggacgagatcagcctgtacgagagcgccgccaagctgggcatccaccccagcgacagcgagggcgagctgaacatcgagctgaccgagagctacgtggacctgggcatcaagaaggtgaactggaagaagagcaaggtgaccagcatcgtgcaggaggaggaccccaacgaggagctgagcaaggacgagttcatcctgaagctgaaggccgaggtgcagagactgctgggcagcaacagcatgaagagacacctggtgagccagctgcagaacgacctgaaggactgccacaagaagatcgaggacctgcaccaggtgaagaaggacgagaagagcatcgaggtggagaccaagaccgacaccagcgagaagcccaagaaccagctgtggcccgagagcagcaccagcgacgtggtgagagacgacatcctgctgctgaagaacgagatccaggtgctgcagcagcagaaccaggagctgaaggagaccgagggcaagctgagaaacaccaaccaggacctgtgcaaccagatgagacagatggtgcaggacttcgaccacgacaagcaggaggccgtggacagatgcgagagaacctaccagcagcaccacgaggccatgaagacccagatcagagagagcctgctggccaagcacgccctggagaagcagcagctgttcgaggcctacgagagaacccacctgcagctgagaagcgagctggacaagctgaacaaggaggtgaccgccgtgcaggagtgctacctggaggtgtgcagagagaaggacaacctggagctgaccctgagaaagaccaccgagaaggagcagcagacccaggagaagatcaaggagaagctgatccagcagctggagaaggagtggcagagcaagctggaccagaccatcaaggccatgaagaagaagaccctggactgcggcagccagaccgaccaggtgaccaccagcgacgtgatcagcaagaaggagatggccatcatgatcgaggagcagaagtgcaccatccagcagaacctggagcaggagaaggacatcgccatcaagggcgccatgaagaagctggagatcgagctggagctgaagcactgcgagaacatcaccaagcaggtggagatcgccgtgcagaacgcccaccagagatggctgggcgagctgcccgagctggccgagtaccaggccctggtgaaggccgagcagaagaagtgggaggagcagcacgaggtgagcgtgaacaagagaatcagcttcgccgtgagcgaggccaaggagaagtggaagagcgagctggagaacatgagaaagaacatcctgcccggcaaggagctggaggagaagatccacagcctgcagaaggagctggagctgaagaacgaggaggtgcccgtggtgatcagagccgagctggccaaggccagaagcgagtggaacaaggagaagcaggaggagatccacagaatccaggagcagaacgagcaggactacagacagttcctggacgaccacagaaacaagatcaacgaggtgctggccgccgccaaggaggacttcatgaagcagaagaccgagctgctgctgcagaaggagaccgagctgcagacctgcctggaccagagcagaagagagtggaccatgcaggaggccaagagaatccagctggagatctaccagtacgaggaggacatcctgaccgtgctgggcgtgctgctgagcgacacccagaaggagcacatcagcgacagcgaggacaagcagctgctggagatcatgagcacctgcagcagcaagtggatgagcgtgcagtacttcgagaagctgaagggctgcatccagaaggccttccaggacaccctgcccctgctggtggagaacgccgaccccgagtggaagaagagaaacatggccgagctgagcaaggacagcgccagccagggcaccggccagggcgaccccggccccgccgccggccaccacgcccagcccctggccctgcaggccaccgaggccgaggccgaggagaacaacaaggtggtggaggagctgatcgaggagaacaacgacatgaagaacaagctggaggagctgcagaccctgtgcaagaccccccccagaagcctgagcgccggcgccatcgagaacgcctgcctgccctgcagcggcggcgccctggaggagctgagaggccagtacatcaaggccgtgaagaagatcaagtgcgacatgctgagatacatccaggagagcaaggagagagccgccgagatggtgaaggccgaggtgctgagagagagacaggagaccgccagaaagatgagaaagtactacctgatctgcctgcagcagatcctgcaggacgacggcaaggagggcgccgagaagaagatcatgaacgccgccagcaagctggccaccatggccaagctgctggagacccccatcagcagcaagagccagagcaagaccacccagagcgccctgcccctgaccagcgagatgctgatcgccgtgaagaagagcaagagaaacgacgtgaaccagaagatcccctgctgcatcgagagcaagagcaacagcgtgaacaccatcaccagaaccctgtgcgagcaggcccccaagagaagagccgcctgcaacctgcagagactgctggagaacagcgagcaccagagcatcaagcacgtgggcagcaaggagacccacctggagttccagttcggcgacggcagctgcaagcacctgaacagcctgcccagaaacgtgagccccgagttcgtgccctgcgagggcgagggcggcttcggcctgcacaagaagaaggacctgctgagcgacaacggcagcgagagcctgccccacagcgccgcctaccccttcctgggcaccctgggcaacaagcccagccccagatgcacccccggccccagcgagagcggctgcatgcacatcaccttcagagacagcaacgagagactgggcctgaaggtgtacaagtgcaaccccctgatggagagcgagaacgccgccagcgagaagagccagggcctggacgtgcaggagccccccgtgaaggacggcggcgacctgagcgactgcctgggctggcccagcagcagcgccaccctgagcttcgacagcagagaggccagcttcgtgcacggcagaccccagggcaccctggagatccccagcgagagcgtgaagagcaagcagttcagccccagcggctacctgagcgacaccgaggagagcaacatgatctgccagaccatgaagtgccagagataccagaccccctacctgagcgaggagaccacctacctggagcccggcaagatcagcgtgaactgcggccaccccagcagacacaaggccgacagactgaagagcgacttcaagaagctgagcagcaccctgcccagcagcgtgtgccagcagcccagcagaaagctgatcgtgcccctgagcagccagcaggacagcggcttcgacagccccttcgtgaacctggactag

SEQ ID NO: 76263 - DNA, 1779 bp, Artificial Sequence
  Description of Artificial Sequence: Synthetic coding sequence
atgagcctggacttcggcagcgtggccctgcccgtgcagaacgaggacgaggagtacgacgaggaggactacgagagagagaaggagctgcagcagctgctgaccgacctgccccacgacatgctggacgacgacctgagcagccccgagctgcagtacagcgactgcagcgaggacggcaccgacggccagccccaccaccccgagcagctggagatgagctggaacgagcagatgctgcccaagagccagagcgtgaacggctacaacgagatccagagcctgtacgccggcgagaagtgcggcaacgtgtgggaggagaacagaagcaagaccgaggacagacaccccgtgtaccaccccgaggagggcggcgacgagggcggcagcggctacagcccccccagcaagtgcgagcagaccgacctgtaccacctgcccgagaacttcagaccctacaccaacggccagaagcaggagttcaacaaccaggccaccaacgtgatcaagttcagcgacccccagtggaaccacttccagggccccagctgccagggcctggagccctacaacaaggtgacctacaagccctaccagagcagcgcccagaacaacggcagccccgcccaggagatcaccggcagcgacaccttcgagggcctgcagcagcagttcctgggcgccaacgagaacagcgccgagaacatgcagatcatccagctgcaggtgctgaacaaggccaaggagagacagctggagaacctgatcgagaagctgaacgagagcgagagacagatcagatacctgaaccaccagctggtgatcatcaaggacgagaaggacggcctgaccctgagcctgagagagagccagaagctgttccagaacggcaaggagagagagatccagctggaggcccagatcaaggccctggagacccagatccaggccctgaaggtgaacgaggagcagatgatcaagaagagcagaaccaccgagatggccctggagagcctgaagcagcagctggtggacctgcaccacagcgagagcctgcagagagccagagagcagcacgagagcatcgtgatgggcctgaccaagaagtacgaggagcaggtgctgagcctgcagaagaacctggacgccaccgtgaccgccctgaaggagcaggaggacatctgcagcagactgaaggaccacgtgaagcagctggagagaaaccaggaggccatcaagctggagaagaccgagatcatcaacaagctgaccagaagcctggaggagagccagaagcagtgcgcccacctgctgcagagcggcagcgtgcaggaggtggcccagctgcagttccagctgcagcaggcccagaaggcccacgccatgagcgccaacatgaacaaggccctgcaggaggagctgaccgagctgaaggacgagatcagcctgtacgagagcgccgccaagctgggcatccaccccagcgacagcgagggcgagctgaacatcgagctgaccgagagctacgtggacctgggcatcaagaaggtgaactggaagaagagcaaggtgaccagcatcgtgcaggaggaggaccccaacgaggagctgagcaaggacgagttcatcctgaagctgaaggccgaggtgcagagactgctgggcagcaacagcatgaagagacacctggtgagccagctgcagaacgacctgaaggactgccacaagaagatcgaggacctgcaccaggtgaagaagaagaagaagaagaagaagtag

SEQ ID NO: 76264 - DNA, 207 bp, Artificial Sequence
  Description of Artificial Sequence: Synthetic coding sequence
atgagcctggacttcggcagcgtggccctgcccgtgcagaacgaggacgaggagtacgacgaggaggactacgagagagagaaggagctgcagcagctgctgaccgacctgccccacgacatgctggacgacgacctgagcagccccgagctgcagtacagcgactgcagcgaggacggcaccgacggccagccccaccacccctag

SEQ ID NO: 76265 - DNA, 4755 bp, Artificial Sequence
  Description of Artificial Sequence: Synthetic coding sequence
atgagcctgaccagctggttcctggtgagcagcggcggcaccagacacagactgcccagagagatgatcttcgtgggcagagacgactgcgagctgatgctgcagagcagaagcgtggacaagcagcacgccgtgatcaactacgacgccagcaccgacgagcacctggtgaaggacctgggcagcctgaacggcaccttcgtgaacgacgtgagaatccccgagcagacctacatcaccctgaagctggaggacaagctgagattcggctacgacaccaacctgttcaccgtggtgcagggcgagatgagagtgcccgaggaggccctgaagcacgagaagttcaccatccagctgcagctgagccagaagagcagcgagagcgagctgagcaagagcgccagcgccaagagcatcgacagcaaggtggccgacgccgccaccgaggtgcagcacaagaccaccgaggccctgaagagcgaggagaaggccatggacatcagcgccatgcccagaggcacccccctgtacggccagcccagctggtggggcgacgacgaggtggacgagaagagagccttcaagaccaacggcaagcccgaggagaagaaccacgaggccggcaccagcggctgcggcatcgacgccaagcaggtggaggagcagagcgccgccgccaacgaggaggtgctgttccccttctgcagagagcccagctacttcgagatccccaccaaggagttccagcagcccagccagatcaccgagagcaccatccacgagatccccaccaaggacacccccagcagccacatcaccggcgccggccacgccagcttcaccatcgagttcgacgacagcacccccggcaaggtgaccatcagagaccacgtgaccaagttcaccagcgaccagagacacaagagcaagaagagcagccccggcacccaggacctgctgggcatccagaccggcatgatggcccccgagaacaaggtggccgactggctggcccagaacaaccccccccagatgctgtgggagagaaccgaggaggacagcaagagcatcaagagcgacgtgcccgtgtacctgaagagactgaagggcaacaagcacgacgacggcacccagagcgacagcgagaacgccggcgcccacagaagatgcagcaagagagccaccctggaggagcacctgagaagacaccacagcgagcacaagaagctgcagaaggtgcaggccaccgagaagcaccaggaccaggccgtgaccagcagcgcccaccacagaggcggccacggcgtgccccacggcaagctgctgaagcagaagagcgaggagcccagcgtgagcatccccttcctgcagaccgccctgctgagaagcagcggcagcctgggccacagacccagccaggagatggacaagatgctgaagaaccaggccaccagcgccaccagcgagaaggacaacgacgacgaccagagcgacaagggcacctacaccatcgagctggagaaccccaacagcgaggaggtggaggccagaaagatgatcgacaaggtgttcggcgtggacgacaaccaggactacaacagacccgtgatcaacgagaagcacaaggacctgatcaaggactgggccctgagcagcgccgccgccgtgatggaggagagaaagcccctgaccaccagcggcttccaccacagcgaggagggcaccagcagcagcggcagcaagagatgggtgagccagtgggccagcctggccgccaaccacaccagacacgaccaggaggagagaatcatggagttcagcgcccccctgcccctggagaacgagaccgagatcagcgagagcggcatgaccgtgagaagcaccggcagcgccaccagcctggccagccagggcgagagaagaagaagaaccctgccccagctgcccaacgaggagaagagcctggagagccacagagccaaggtggtgacccagagaagcgagatcggcgagaagcaggacaccgagctgcaggagaaggagacccccacccaggtgtaccagaaggacaagcaggacgccgacagacccctgagcaagatgaacagagccgtgaacggcgagaccctgaagaccggcggcgacaacaagaccctgctgcacctgggcagcagcgcccccggcaaggagaagagcgagaccgacaaggagaccagcctggtgaagcagaccctggccaagctgcagcagcaggagcagagagaggaggcccagtggacccccaccaagctgagcagcaagaacgtgagcggccagaccgacaagtgcagagaggagaccttcaagcaggagagccagccccccgagaagaacagcggccacagcaccagcaagggcgacagagtggcccagagcgagagcaagagaagaaaggccgaggagatcctgaagagccagacccccaagggcggcgacaagaaggagagcagcaagagcctggtgagacagggcagcttcaccatcgagaagcccagccccaacatccccatcgagctgatcccccacatcaacaagcagaccagcagcacccccagcagcctggccctgaccagcgccagcagaatcagagagagaagcgagagcctggaccccgacagcagcatggacaccaccctgatcctgaaggacaccgaggccgtgatggccttcctggaggccaagctgagagaggacaacaagaccgacgagggccccgacacccccagctacaacagagacaacagcatcagccccgagagcgacgtggacaccgccagcaccatcagcctggtgaccggcgagaccgagagaaagagcacccagaagagaaagagcttcaccagcctgtacaaggacagatgcagcaccggcagccccagcaaggacgtgaccaagagcagcagcagcggcgccagagagaagatggagaagaagaccaagagcagaagcaccgacgtgggcagcagagccgacggcagaaagttcgtgcagagcagcggcagaatcagacagcccagcgtggacctgaccgacgacgaccagaccagcagcgtgccccacagcgccatcagcgacatcatgagcagcgaccaggagacctacagctgcaagccccacggcagaacccccctgaccagcgccgacgagcacgtgcacagcaagctggagggcagcaaggtgaccaagagcaagaccagccccgtggtgagcggcagcagcagcaagagcaccaccctgcccagacccagacccaccagaaccagcctgctgagaagagccagactgggcgaggccagcgacagcgagctggccgacgccgacaaggccagcgtggccagcgaggtgagcaccaccagcagcaccagcaagccccccaccggcagaagaaacatcagcagaatcgacctgctggcccagcccagaagaaccagactgggcagcctgagcgccagaagcgacagcgaggccaccatcagcagaagcagcgccagcagcagaaccgccgaggccatcatcagaagcggcgccagactggtgcccagcgacaagttcagccccagaatcagagccaacagcatcagcagactgagcgacagcaaggtgaagagcatgaccagcgcccacggcagcgccagcgtgaacagcagatggagaagattccccaccgactacgccagcaccagcgaggacgagttcggcagcaacagaaacagccccaagcacaccagactgagaaccagccccgccctgaagaccaccagactgcagagcgccggcagcgccatgcccaccagcagcagcttcaagcacagaatcaaggagcaggaggactacatcagagactggaccgcccacagagaggagatcgccagaatcagccaggacctggccctgatcgccagagagatcaacgacgtggccggcgagatcgacagcgtgaccagcagcggcaccgcccccagcaccaccgtgagcaccgccgccaccacccccggcagcgccatcgacaccagagaggagctggtggacagagtgttcgacgagagcctgaacttcagaaagatcccccccctggtgcacagcaagacccccgagggcaacaacggcagaagcggcgaccccagaccccaggccgccgagccccccgaccacctgaccatcaccagaagaagaacctggagcagagacgaggtgatgggcgacaacctgctgctgagcagcgtgttccagttcagcaagaagatcagacagagcatcgacaagaccgccggcaagatcagaatcctgttcaaggacaaggacagaaactgggacgacatcgagagcaagctgagagccgagagcgaggtgcccatcgtgaagaccagcagcatggagatcagcagcatcctgcaggagctgaagagagtggagaagcagctgcaggccatcaacgccatgatcgaccccgacggcaccctggaggccctgaacaacatgggcttccccagcgccatgctgcccagcccccccaagcagaagagcagccccgtgaacaaccaccacagccccggccagacccccaccctgggccagcccgaggccagagccctgcaccccgccgccgtgagcgccgccgccgagttcgagaacgccgagagcgaggccgacttcagcatccacttcaacagattcaaccccgacggcgaggaggaggacgtgaccgtgcaggagtag

SEQ ID NO: 76266 - DNA, 4383 bp, Artificial Sequence
  Description of Artificial Sequence: Synthetic coding sequence
atgagcctgaccagctggttcctggtgagcagcggcggcaccagacacagactgcccagagagatgatcttcgtgggcagagacgactgcgagctgatgctgcagagcagaagcgtggacaagcagcacgccgtgatcaactacgacgccagcaccgacgagcacctggtgaaggacctgggcagcctgaacggcaccttcgtgaacgacgtgagaatccccgagcagacctacatcaccctgaagctggaggacaagctgagattcggctacgacaccaacctgttcaccgtggtgcagggcgagatgagagtgcccgaggaggccctgaagcacgagaagttcaccatccagctgcagctgagccagaagagcagcgagagcgagctgagcaagagcgccagcgccaagagcatcgacagcaaggtggccgacgccgccaccgaggtgcagcacaagaccaccgaggccctgaagagcgaggagaaggccatggacatcagcgccatgcccagaggcacccccctgtacggccagcccagctggtggggcgacgacgaggtggacgagaagagagccttcaagaccaacggcaagcccgaggagaagaaccacgaggccggcaccagcggctgcggcatcgacgccaagcaggtggaggagcagagcgccgccgccaacgaggaggtgctgttccccttctgcagagagcccagctacttcgagatccccaccaaggagttccagcagcccagccagatcaccgagagcaccatccacgagatccccaccaaggacacccccagcagccacatcaccggcgccggccacgccagcttcaccatcgagttcgacgacagcacccccggcaaggtgaccatcagagaccacgtgaccaagttcaccagcgaccagagacacaagagcaagaagagcagccccggcacccaggacctgctgggcatccagaccggcatgatggcccccgagaacaaggtggccgactggctggcccagaacaaccccccccagatgctgtgggagagaaccgaggaggacagcaagagcatcaagagcgacgtgcccgtgtacctgaagagactgaagggcaacaagcacgacgacggcacccagagcgacagcgagaacgccggcgcccacagaagatgcagcaagagagccaccctggaggagcacctgagaagacaccacagcgagcacaagaagctgcagaaggtgcaggccaccgagaagcaccaggaccaggccgtggtgttcggcgtggacgacaaccaggactacaacagacccgtgatcaacgagaagcacaaggacctgatcaaggactgggccctgagcagcgccgccgccgtgatggaggagagaaagcccctgaccaccagcggcttccaccacagcgaggagggcaccagcagcagcggcagcaagagatgggtgagccagtgggccagcctggccgccaaccacaccagacacgaccaggaggagagaatcatggagttcagcgcccccctgcccctggagaacgagaccgagatcagcgagagcggcatgaccgtgagaagcaccggcagcgccaccagcctggccagccagggcgagagaagaagaagaaccctgccccagctgcccaacgaggagaagagcctggagagccacagagccaaggtggtgacccagagaagcgagatcggcgagaagcaggacaccgagctgcaggagaaggagacccccacccaggtgtaccagaaggacaagcaggacgccgacagacccctgagcaagatgaacagagccgtgaacggcgagaccctgaagaccggcggcgacaacaagaccctgctgcacctgggcagcagcgcccccggcaaggagaagagcgagaccgacaaggagaccagcctggtgaagcagaccctggccaagctgcagcagcaggagcagagagaggaggcccagtggacccccaccaagctgagcagcaagaacgtgagcggccagaccgacaagtgcagagaggagaccttcaagcaggagagccagccccccgagaagaacagcggccacagcaccagcaagggcgacagagtggcccagagcgagagcaagagaagaaaggccgaggagatcctgaagagccagacccccaagggcggcgacaagaaggagagcagcaagagcctggtgagacagggcagcttcaccatcgagaagcccagccccaacatccccatcgagctgatcccccacatcaacaagcagaccagcagcacccccagcagcctggccctgaccagcgccagcagaatcagagagagaagcgagagcctggaccccgacagcagcatggacaccaccctgatcctgaaggacaccgaggccgtgatggccttcctggaggccaagctgagagaggacaacaagaccgacgagggccccgacacccccagctacaacagagacaacagcatcagccccgagagcgacgtggacaccgccagcaccatcagcctggtgaccggcgagaccgagagaaagagcacccagaagagaaagagcttcaccagcctgtacaaggacagatgcagcaccggcagccccagcaaggacgtgaccaagagcagcagcagcggcgccagagagaagatggagaagaagaccaagagcagaagcaccgacgtgggcagcagagccgacggcagaaagttcgtgcagagcagcggcagaatcagacagcccagcgtggacctgaccgacgacgaccagaccagcagcgtgccccacagcgccatcagcgacatcatgagcagcgaccaggagacctacagctgcaagccccacggcagaacccccctgaccagcgccgacgagcacgtgcacagcaagctggagggcagcaaggtgaccaagagcaagaccagccccgtggtgagcggcagcagcagcaagagcaccaccctgcccagacccagacccaccagaaccagcctgctgagaagagccagactgggcgaggccagcgacagcgagctggccgacgccgacaaggccagcgtggccagcgaggtgagcaccaccagcagcaccagcaagccccccaccggcagaagaaacatcagcagaatcgacctgctggcccagcccagaagaaccagactgggcagcctgagcgccagaagcgacagcgaggccaccatcagcagaagcagcgccagcagcagaaccgccgaggccatcatcagaagcggcgccagactggtgcccagcgacaagttcagccccagaatcagagccaacagcatcagcagactgagcgacagcaaggtgaagagcatgaccagcgcccacggcagcgccagcgccctgaagaccaccagactgcagagcgccggcagcgccatgcccaccagcagcagcttcaagcacagaatcaaggagcaggaggactacatcagagactggaccgcccacagagaggagatcgccagaatcagccaggacctggccctgatcgccagagagatcaacgacgtggccggcgagatcgacagcgtgaccagcagcggcaccgcccccagcaccaccgtgagcaccgccgccaccacccccggcagcgccatcgacaccagagaggaggtgggcgacctgcacggcgagatgcacaagctggtggacagagtgttcgacgagagcctgaacttcagaaagatcccccccctggtgcacagcaagacccccgagggcaacaacggcagaagcggcgaccccagaccccaggccgccgagccccccgaccacctgaccatcaccagaagaagaacctggagcagagacgaggtgatgggcgacaacctgctgctgagcagcgtgttccagttcagcaagaagatcagacagagcatcgacaagaccgccggcaagatcagaatcctgttcaaggacaaggacagaaactgggacgacatcgagagcaagctgagagccgagagcgaggtgcccatcgtgaagaccagcagcatggagatcagcagcatcctgcaggagctgaagagagtggagaagcagctgcaggccatcaacgccatgatcgaccccgacggcaccctggaggccctgaacaacatgggcttccccagcgccatgctgcccagcccccccaagcagaagagcagccccgtgaacaaccaccacagccccggccagacccccaccctgggccagcccgaggccagagccctgcaccccgccgccgtgagcgccgccgccgagttcgagaacgccgagagcgaggccgacttcagcatccacttcaacagattcaaccccgacggcgaggaggaggacgtgaccgtgcaggagtag

SEQ ID NO: 76267 - DNA, 4461 bp, Artificial Sequence
  Description of Artificial Sequence: Synthetic coding sequence
atgagcctgaccagctggttcctggtgagcagcggcggcaccagacacagactgcccagagagatgatcttcgtgggcagagacgactgcgagctgatgctgcagagcagaagcgtggacaagcagcacgccgtgatcaactacgacgccagcaccgacgagcacctggtgaaggacctgggcagcctgaacggcaccttcgtgaacgacgtgagaatccccgagcagacctacatcaccctgaagctggaggacaagctgagattcggctacgacaccaacctgttcaccgtggtgcagggcgagatgagagtgcccgaggaggccctgaagcacgagaagttcaccatccagctgcagctgagccagaagagcagcgagagcgagctgagcaagagcgccagcgccaagagcatcgacagcaaggtggccgacgccgccaccgaggtgcagcacaagaccaccgaggccctgaagagcgaggagaaggccatggacatcagcgccatgcccagaggcacccccctgtacggccagcccagctggtggggcgacgacgaggtggacgagaagagagccttcaagaccaacggcaagcccgaggagaagaaccacgaggccggcaccagcggctgcggcatcgacgccaagcaggtggaggagcagagcgccgccgccaacgaggaggtgctgttccccttctgcagagagcccagctacttcgagatccccaccaaggagttccagcagcccagccagatcaccgagagcaccatccacgagatccccaccaaggacacccccagcagccacatcaccggcgccggccacgccagcttcaccatcgagttcgacgacagcacccccggcaaggtgaccatcagagaccacgtgaccaagttcaccagcgaccagagacacaagagcaagaagagcagccccggcacccaggacctgctgggcatccagaccggcatgatggcccccgagaacaaggtggccgactggctggcccagaacaaccccccccagatgctgtgggagagaaccgaggaggacagcaagagcatcaagagcgacgtgcccgtgtacctgaagagactgaagggcaacaagcacgacgacggcacccagagcgacagcgagaacgccggcgcccacagaagatgcagcaagagagccaccctggaggagcacctgagaagacaccacagcgagcacaagaagctgcagaaggtgcaggccaccgagaagcaccaggaccaggccgtggtgttcggcgtggacgacaaccaggactacaacagacccgtgatcaacgagaagcacaaggacctgatcaaggactgggccctgagcagcgccgccgccgtgatggaggagagaaagcccctgaccaccagcggcttccaccacagcgaggagggcaccagcagcagcggcagcaagagatgggtgagccagtgggccagcctggccgccaaccacaccagacacgaccaggaggagagaatcatggagttcagcgcccccctgcccctggagaacgagaccgagatcagcgagagcggcatgaccgtgagaagcaccggcagcgccaccagcctggccagccagggcgagagaagaagaagaaccctgccccagctgcccaacgaggagaagagcctggagagccacagagccaaggtggtgacccagagaagcgagatcggcgagaagcaggacaccgagctgcaggagaaggagacccccacccaggtgtaccagaaggacaagcaggacgccgacagacccctgagcaagatgaacagagccgtgaacggcgagaccctgaagaccggcggcgacaacaagaccctgctgcacctgggcagcagcgcccccggcaaggagaagagcgagaccgacaaggagaccagcctggtgaagcagaccctggccaagctgcagcagcaggagcagagagaggaggcccagtggacccccaccaagctgagcagcaagaacgtgagcggccagaccgacaagtgcagagaggagaccttcaagcaggagagccagccccccgagaagaacagcggccacagcaccagcaagggcgacagagtggcccagagcgagagcaagagaagaaaggccgaggagatcctgaagagccagacccccaagggcggcgacaagaaggagagcagcaagagcctggtgagacagggcagcttcaccatcgagaagcccagccccaacatccccatcgagctgatcccccacatcaacaagcagaccagcagcacccccagcagcctggccctgaccagcgccagcagaatcagagagagaagcgagagcctggaccccgacagcagcatggacaccaccctgatcctgaaggacaccgaggccgtgatggccttcctggaggccaagctgagagaggacaacaagaccgacgagggccccgacacccccagctacaacagagacaacagcatcagccccgagagcgacgtggacaccgccagcaccatcagcctggtgaccggcgagaccgagagaaagagcacccagaagagaaagagcttcaccagcctgtacaaggacagatgcagcaccggcagccccagcaaggacgtgaccaagagcagcagcagcggcgccagagagaagatggagaagaagaccaagagcagaagcaccgacgtgggcagcagagccgacggcagaaagttcgtgcagagcagcggcagaatcagacagcccagcgtggacctgaccgacgacgaccagaccagcagcgtgccccacagcgccatcagcgacatcatgagcagcgaccaggagacctacagctgcaagccccacggcagaacccccctgaccagcgccgacgagcacgtgcacagcaagctggagggcagcaaggtgaccaagagcaagaccagccccgtggtgagcggcagcagcagcaagagcaccaccctgcccagacccagacccaccagaaccagcctgctgagaagagccagactgggcgaggccagcgacagcgagctggccgacgccgacaaggccagcgtggccagcgaggtgagcaccaccagcagcaccagcaagccccccaccggcagaagaaacatcagcagaatcgacctgctggcccagcccagaagaaccagactgggcagcctgagcgccagaagcgacagcgaggccaccatcagcagaagcagcgccagcagcagaaccgccgaggccatcatcagaagcggcgccagactggtgcccagcgacaagttcagccccagaatcagagccaacagcatcagcagactgagcgacagcaaggtgaagagcatgaccagcgcccacggcagcgccagcgtgaacagcagatggagaagattccccaccgactacgccagcaccagcgaggacgagttcggcagcaacagaaacagccccaagcacaccagactgagaaccagccccgccctgaagaccaccagactgcagagcgccggcagcgccatgcccaccagcagcagcttcaagcacagaatcaaggagcaggaggactacatcagagactggaccgcccacagagaggagatcgccagaatcagccaggacctggccctgatcgccagagagatcaacgacgtggccggcgagatcgacagcgtgaccagcagcggcaccgcccccagcaccaccgtgagcaccgccgccaccacccccggcagcgccatcgacaccagagaggagctggtggacagagtgttcgacgagagcctgaacttcagaaagatcccccccctggtgcacagcaagacccccgagggcaacaacggcagaagcggcgaccccagaccccaggccgccgagccccccgaccacctgaccatcaccagaagaagaacctggagcagagacgaggtgatgggcgacaacctgctgctgagcagcgtgttccagttcagcaagaagatcagacagagcatcgacaagaccgccggcaagatcagaatcctgttcaaggacaaggacagaaactgggacgacatcgagagcaagctgagagccgagagcgaggtgcccatcgtgaagaccagcagcatggagatcagcagcatcctgcaggagctgaagagagtggagaagcagctgcaggccatcaacgccatgatcgaccccgacggcaccctggaggccctgaacaacatgggcttccccagcgccatgctgcccagcccccccaagcagaagagcagccccgtgaacaaccaccacagccccggccagacccccaccctgggccagcccgaggccagagccctgcaccccgccgccgtgagcgccgccgccgagttcgagaacgccgagagcgaggccgacttcagcatccacttcaacagattcaaccccgacggcgaggaggaggacgtgaccgtgcaggagtag

SEQ ID NO: 76268 - DNA, 1239 bp, Artificial Sequence
  Description of Artificial Sequence: Synthetic coding sequence
atgagagtgcccgaggaggccctgaagcacgagaagttcaccatccagctgcagctgagccagaagagcagcgagagcgagctgagcaagagcgccagcgccaagagcatcgacagcaaggtggccgacgccgccaccgaggtgcagcacaagaccaccgaggccctgaagagcgaggagaaggccatggacatcagcgccatgcccagaggcacccccctgtacggccagcccagctggtggggcgacgacgaggtggacgagaagagagccttcaagaccaacggcaagcccgaggagaagaaccacgaggccggcaccagcggctgcggcatcgacgccaagcaggtggaggagcagagcgccgccgccaacgaggaggtgctgttccccttctgcagagagcccagctacttcgagatccccaccaaggagttccagcagcccagccagatcaccgagagcaccatccacgagatccccaccaaggacacccccagcagccacatcaccggcgccggccacgccagcttcaccatcgagttcgacgacagcacccccggcaaggtgaccatcagagaccacgtgaccaagttcaccagcgaccagagacacaagagcaagaagagcagccccggcacccaggacctgctgggcatccagaccggcatgatggcccccgagaacaaggtggccgactggctggcccagaacaaccccccccagatgctgtgggagagaaccgaggaggacagcaagagcatcaagagcgacgtgcccgtgtacctgaagagactgaagggcaacaagcacgacgacggcacccagagcgacagcgagaacgccggcgcccacagaagatgcagcaagagagccaccctggaggagcacctgagaagacaccacagcgagcacaagaagctgcagaaggtgcaggccaccgagaagcaccaggaccaggccgtgaccagcagcgcccaccacagaggcggccacggcgtgccccacggcaagctgctgaagcagaagagcgaggagcccagcgtgagcatccccttcctgcagaccgccctgctgagaagcagcggcagcctgggccacagacccagccaggagatggacaagatgctgaagaaccaggccgactgcggcagcgtggccttctgcggcttcatgatcttcaagctgaacctgatgatcacccccttccccttcatcgacctgttcagcttcttctag

SEQ ID NO: 76269 - DNA, 402 bp, Artificial Sequence
  Description of Artificial Sequence: Synthetic coding sequence
atgagcctgaccagctggttcctggtgagcagcggcggcaccagacacagactgcccagagagatgatcttcgtgggcagagacgactgcgagctgatgctgcagagcagaagcgtggacaagcagcacgccgtgatcaactacgacgccagcaccgacgagcacctggtgaaggacctgggcagcctgaacggcaccttcgtgaacgacgtgagaatccccgagcagacctacatcaccctgaagctggaggacaagctgagattcggctacgacaccaacctgttcaccgtggtgcagggcgagatgagagtgcccgaggaggccctgaagcacgagaagttcaccatccagctgcagctgagccagaagagcagcgagagcgagctgagcaagagctag

SEQ ID NO: 76270 - DNA, 267 bp, Artificial Sequence
  Description of Artificial Sequence: Synthetic coding sequence
atgagcctgaccagctggttcctggtgagcagcggcggcaccagacacagactgcccagagagatgatcttcgtgggcagagacgactgcgagctgatgctgcagagcagaagcgtggacaagcagcacgccgtgatcaactacgacgccagcaccgacgagcacctggtgaaggacctgggcagcctgaacggcaccttcgtgaacgacgtgagaatccccgagcagacctacatcaccctgaagctggaggacaagctgagatag

SEQ ID NO: 76271 - DNA, 336 bp, Artificial Sequence
  Description of Artificial Sequence: Synthetic coding sequence
atgagcctgaccagctggttcctggtgagcagcggcggcaccagacacagactgcccagagagatgatcttcgtgggcagagacgactgcgagctgatgctgcagagcagaagcgtggacaagcagcacgccgtgatcaactacgacgccagcaccgacgagcacctggtgaaggacctgggcagcctgaacggcaccttcgtgaacgacgtgagaatccccgagcagacctacatcaccctgaagctggaggacaagctgagattcggctacgacaccaacctgttcaccgtggtgcagggcgagatgagagtgcccgaggaggccctgaagtag

SEQ ID NO: 76272 - DNA, 1407 bp, Artificial Sequence
  Description of Artificial Sequence: Synthetic coding sequence
atgagcagcgaccaggagacctacagctgcaagccccacggcagaacccccctgaccagcgccgacgagcacgtgcacagcaagctggagggcagcaaggtgaccaagagcaagaccagccccgtggtgagcggcagcagcagcaagagcaccaccctgcccagacccagacccaccagaaccagcctgctgagaagagccagactgggcgaggccagcgacagcgagctggccgacgccgacaaggccagcgtggccagcgaggtgagcaccaccagcagcaccagcaagccccccaccggcagaagaaacatcagcagaatcgacctgctggcccagcccagaagaaccagactgggcagcctgagcgccagaagcgacagcgaggccaccatcagcagaagcagcgccagcagcagaaccgccgaggccatcatcagaagcggcgccagactggtgcccagcgacaagttcagccccagaatcagagccaacagcatcagcagactgagcgacagcaaggtgaagagcatgaccagcgcccacggcagcgccagcgccctgaagaccaccagactgcagagcgccggcagcgccatgcccaccagcagcagcttcaagcacagaatcaaggagcaggaggactacatcagagactggaccgcccacagagaggagatcgccagaatcagccaggacctggccctgatcgccagagagatcaacgacgtggccggcgagatcgacagcgtgaccagcagcggcaccgcccccagcaccaccgtgagcaccgccgccaccacccccggcagcgccatcgacaccagagaggaggtgggcgacctgcacggcgagatgcacaagctggtggacagagtgttcgacgagagcctgaacttcagaaagatcccccccctggtgcacagcaagacccccgagggcaacaacggcagaagcggcgaccccagaccccaggccgccgagccccccgaccacctgaccatcaccagaagaagaacctggagcagagacgaggtgatgggcgacaacctgctgctgagcagcgtgttccagttcagcaagaagatcagacagagcatcgacaagaccgccggcaagatcagaatcctgttcaaggacaaggacagaaactgggacgacatcgagagcaagctgagagccgagagcgaggtgcccatcgtgaagaccagcagcatggagatcagcagcatcctgcaggagctgaagagagtggagaagcagctgcaggccatcaacgccatgatcgaccccgacggcaccctggaggccctgaacaacatgggcttccccagcgccatgctgcccagcccccccaagcagaagagcagccccgtgaacaaccaccacagccccgccatgctgtag

SEQ ID NO: 76273 - DNA, 7161 bp, Artificial Sequence
  Description of Artificial Sequence: Synthetic coding sequence
atggagaccagaagccccggcctgaacaacatgaagccccagagcctgcagctggtgctggaggagcaggtgctggccctgcagcagcagatggccgagaaccaggccgccagctggagaaagctgaagaacagccaggaggcccagcagagacaggccaccctggtgagaaagctgcaggccaaggtgctgcagtacagaagctggtgccaggagctggagaagagactggaggccaccggcggccccatcccccagagatgggagaacgtggaggagcccaacctggacgagctgctggtgagactggaggaggagcagcagagatgcgagagcctggccgaggtgaacacccagctgagactgcacatggagaaggccgacgtggtgaacaaggccctgagagaggacgtggagaagctgaccgtggactggagcagagccagagacgagctgatgagaaaggagagccagtggcagatggagcaggagttcttcaagggctacctgaagggcgagcacggcagactgctgagcctgtggagagaggtggtgaccttcagaagacacttcctggagatgaagagcgccaccgacagagacctgatggagctgaaggccgagcacgtgagactgagcggcagcctgctgacctgctgcctgagactgaccgtgggcgcccagagcagagagcccaacggcagcggcagaatggacggcagagagcccgcccagctgctgctgctgctggccaagacccaggagctggagaaggaggcccacgagagaagccaggagctgatccagctgaagagccagggcgacctggagaaggccgagctgcaggacagagtgaccgagctgagcgccctgctgacccagagccagaagcagaacgaggactacgagaagatgatcaaggccctgagagagaccgtggagatcctggagaccaaccacaccgagctgatggagcacgaggccagcctgagcagaaacgcccaggaggagaagctgagcctgcagcaggtgatcaaggacatcacccaggtgatggtggaggagggcgacaacatcgcccagggcagcggccacgagaacagcctggagctggacagcagcatcttcagccagttcgactaccaggacgccgacaaggccctgaccctggtgagaagcgtgctgaccagaagaagacaggccgtgcaggacctgagacagcagctggccggctgccaggaggccgtgaacctgctgcagcagcagcacgaccagtgggaggaggagggcaaggccctgagacagagactgcagaagctgaccggcgagagagacaccctggccggccagaccgtggacctgcagggcgaggtggacagcctgagcaaggagagagagctgctgcagaaggccagagaggagctgagacagcagctggaggtgctggagcaggaggcctggagactgagaagagtgaacgtggagctgcagctgcagggcgacagcgcccagggccagaaggaggagcagcaggaggagctgcacctggccgtgagagagagagagagactgcaggagatgctgatgggcctggaggccaagcagagcgagagcctgagcgagctgatcaccctgagagaggccctggagagcagccacctggagggcgagctgctgagacaggagcagaccgaggtgaccgccgccctggccagagccgagcagagcatcgccgagctgagcagcagcgagaacaccctgaagaccgaggtggccgacctgagagccgccgccgtgaagctgagcgccctgaacgaggccctggccctggacaaggtgggcctgaaccagcagctgctgcagctggaggaggagaaccagagcgtgtgcagcagaatggaggccgccgagcaggccagaaacgccctgcaggtggacctggccgaggccgagaagagaagagaggccctgtgggagaagaacacccacctggaggcccagctgcagaaggccgaggaggccggcgccgagctgcaggccgacctgagagacatccaggaggagaaggaggagatccagaagaagctgagcgagagcagacaccagcaggaggccgccaccacccagctggagcagctgcaccaggaggccaagagacaggaggaggtgctggccagagccgtgcaggagaaggaggccctggtgagagagaaggccgccctggaggtgagactgcaggccgtggagagagacagacaggacctggccgagcagctgcagggcctgagcagcgccaaggagctgctggagagcagcctgttcgaggcccagcagcagaacagcgtgatcgaggtgaccaagggccagctggaggtgcagatccagaccgtgacccaggccaaggaggtgatccagggcgaggtgagatgcctgaagctggagctggacaccgagagaagccaggccgagcaggagagagacgccgccgccagacagctggcccaggccgagcaggagggcaagaccgccctggagcagcagaaggccgcccacgagaaggaggtgaaccagctgagagagaagtggatgcagctggagaccgagaaggagagagtgagcctgctggagaccctgctgcagacccagaaggagctggccgacgccagccagcagctggagagactgagacaggacatgaaggtgcagaagctgaaggagcaggagaccaccggcatcctgcagacccagctgcaggaggcccagagagagctgaaggaggccgccagacagcacagagacgacctggccgccctgcaggaggagagcagcagcctgctgcaggacaagatggacctgcagaagcaggtggaggacctgaagagccagctggtggcccaggacgacagccagagactggtggagcaggaggtgcaggagaagctgagagagacccaggagtacaacagaatccagaaggagctggagagagagaaggccagcctgaccctgagcctgatggagaaggagcagagactgctggtgctgcaggaggccgacagcatcagacagcaggagctgagcgccctgagacaggacatgcaggaggcccagggcgagcagaaggagctgagcgcccagatggagctgctgagacaggaggtgaaggagaaggaggccgacttcctggcccaggaggcccagctgctggaggagctggaggccagccacatcaccgagcagcagctgagagccagcctgtgggcccaggaggccaaggccgcccagctgcagctgagactgagaagcaccgagagccagctggaggccctggccgccgagcagcagcccggcaaccaggcccaggcccaggcccagctggccagcctgtacagcgccctgcagcaggccctgggcagcgtgtgcgagagcagacccgagctgagcggcggcggcgacagcgcccccagcgtgtggggcctggagcccgaccagaacggcgccagaagcctgttcaagagaggccccctgctgaccgccctgagcgccgaggccgtggccagcgccctgcacaagctgcaccaggacctgtggaagacccagcagaccagagacgtgctgagagaccaggtgcagaagctggaggagagactgaccgacaccgaggccgagaagagccaggtgcacaccgagctgcaggacctgcagagacagctgagccagaaccaggaggagaagagcaagtgggagggcaagcagaacagcctggagagcgagctgatggagctgcacgagaccatggccagcctgcagagcagactgagaagagccgagctgcagagaatggaggcccagggcgagagagagctgctgcaggccgccaaggagaacctgaccgcccaggtggagcacctgcaggccgccgtggtggaggccagagcccaggccagcgccgccggcatcctggaggaggacctgagaaccgccagaagcgccctgaagctgaagaacgaggaggtggagagcgagagagagagagcccaggccctgcaggagcagggcgagctgaaggtggcccagggcaaggccctgcaggagaacctggccctgctgacccagaccctggccgagagagaggaggaggtggagaccctgagaggccagatccaggagctggagaagcagagagagatgcagaaggccgccctggagctgctgagcctggacctgaagaagagaaaccaggaggtggacctgcagcaggagcagatccaggagctggagaagtgcagaagcgtgctggagcacctgcccatggccgtgcaggagagagagcagaagctgaccgtgcagagagagcagatcagagagctggagaaggacagagagacccagagaaacgtgctggagcaccagctgctggagctggagaagaaggaccagatgatcgagagccagagaggccaggtgcaggacctgaagaagcagctggtgaccctggagtgcctggccctggagctggaggagaaccaccacaagatggagtgccagcagaagctgatcaaggagctggagggccagagagagacccagagagtggccctgacccacctgaccctggacctggaggagagaagccaggagctgcaggcccagagcagccagatccacgacctggagagccacagcaccgtgctggccagagagctgcaggagagagaccaggaggtgaagagccagagagagcagatcgaggagctgcagagacagaaggagcacctgacccaggacctggagagaagagaccaggagctgatgctgcagaaggagagaatccaggtgctggaggaccagagaaccagacagaccaagatcctggaggaggacctggagcagatcaagctgagcctgagagagagaggcagagagctgaccacccagagacagctgatgcaggagagagccgaggagggcaagggccccagcaaggcccagagaggcagcctggagcacatgaagctgatcctgagagacaaggagaaggaggtggagtgccagcaggagcacatccacgagctgcaggagctgaaggaccagctggagcagcagctgcagggcctgcacagaaaggtgggcgagaccagcctgctgctgagccagagagagcaggagatcgtggtgctgcagcagcagctgcaggaggccagagagcagggcgagctgaaggagcagagcctgcagagccagctggacgaggcccagagagccctggcccagagagaccaggagctggaggccctgcagcaggagcagcagcaggcccagggccaggaggagagagtgaaggagaaggccgacgccctgcagggcgccctggagcaggcccacatgaccctgaaggagagacacggcgagctgcaggaccacaaggagcaggccagaagactggaggaggagctggccgtggagggcagaagagtgcaggccctggaggaggtgctgggcgacctgagagccgagagcagagagcaggagaaggccctgctggccctgcagcagcagtgcgccgagcaggcccaggagcacgaggtggagaccagagccctgcaggacagctggctgcaggcccaggccgtgctgaaggagagagaccaggagctggaggccctgagagccgagagccagagcagcagacaccaggaggaggccgccagagccagagccgaggccctgcaggaggccctgggcaaggcccacgccgccctgcagggcaaggagcagcacctgctggagcaggccgagctgagcagaagcctggaggccagcaccgccaccctgcaggccagcctggacgcctgccaggcccacagcagacagctggaggaggccctgagaatccaggagggcgagatccaggaccaggacctgagataccaggaggacgtgcagcagctgcagcaggccctggcccagagagacgaggagctgagacaccagcaggagagagagcagctgctggagaagagcctggcccagagagtgcaggagaacatgatccaggagaagcagaacctgggccaggagagagaggaggaggagatcagaggcctgcaccagagcgtgagagagctgcagctgaccctggcccagaaggagcaggagatcctggagctgagagagacccagcagagaaacaacctggaggccctgccccacagccacaagaccagccccatggaggagcagagcctgaagctggacagcctggagcccagactgcagagagagctggagagactgcaggccgccctgagacagaccgaggccagagagatcgagtggagagagaaggcccaggacctggccctgagcctggcccagaccaaggccagcgtgagcagcctgcaggaggtggccatgttcctgcaggccagcgtgctggagagagacagcgagcagcagagactgcaggacgagctggagctgaccagaagagccctggagaaggagagactgcacagccccggcgccaccagcaccgccgagctgggcagcagaggcgagcagggcgtgcagctgggcgaggtgagcggcgtggaggccgagcccagccccgacggcatggagaagcagagctggagacagagactggagcacctgcagcaggccgtggccagactggagatcgacagaagcagactgcagagacacaacgtgcagctgagaagcaccctggagcaggtggagagagagagaagaaagctgaagagagaggccatgagagccgcccaggccggcagcctggagatcagcaaggccaccgccagcagccccacccagcaggacggcagaggccagaagaacagcgacgccaagtgcgtggccgagctgcagaaggaggtggtgctgctgcaggcccagctgaccctggagagaaagcagaagcaggactacatcaccagaagcgcccagaccagcagagagctggccggcctgcaccacagcctgagccacagcctgctggccgtggcccaggcccccgaggccaccgtgctggaggccgagaccagaagactggacgagagcctgacccagagcctgaccagccccggccccgtgctgctgcaccccagccccagcaccacccaggccgccagcagatag

SEQ ID NO: 76274 - DNA, 1020 bp, Artificial Sequence
  Description of Artificial Sequence: Synthetic coding sequence
atggagaccagaagccccggcctgaacaacatgaagccccagagcctgcagctggtgctggaggagcaggtgctggccctgcagcagcagatggccgagaaccaggccgccagctggagaaagctgaagaacagccaggaggcccagcagagacaggccaccctggtgagaaagctgcaggccaaggtgctgcagtacagaagctggtgccaggagctggagaagagactggaggccaccggcggccccatcccccagagatgggagaacgtggaggagcccaacctggacgagctgctggtgagactggaggaggagcagcagagatgcgagagcctggccgaggtgaacacccagctgagactgcacatggagaaggccgacgtggtgaacaaggccctgagagaggacgtggagaagctgaccgtggactggagcagagccagagacgagctgatgagaaaggagagccagtggcagatggagcaggagttcttcaagggctacctgaagggcgagcacggcagactgctgagcctgtggagagaggtggtgaccttcagaagacacttcctggagatgaagagcgccaccgacagagacctgatggagctgaaggccgagcacgtgagactgagcggcagcctgctgacctgctgcctgagactgaccgtgggcgcccagagcagagagcccaacggcagcggcagaatggacggcagagagcccgcccagctgctgctgctgctggccaagacccaggagctggagaaggaggcccacgagagaagccaggagctgatccagctgaagagccagggcgacctggagaaggccgagctgcaggacagagtgaccgagctgagcgccctgctgacccagagccagaagcagaacgaggactacgagaagatgatcaaggccctgagagagaccgtggagatcctggtgcacgaccccctgctgtggaagggcgtgggcagaggcctggtgggcagcctgtgcttcatggacagatag

SEQ ID NO: 76275 - DNA, 7329 bp, Artificial Sequence
  Description of Artificial Sequence: Synthetic coding sequence
atggagaccagaagccccggcctgaacaacatgaagccccagagcctgcagctggtgctggaggagcaggtgctggccctgcagcagcagatggccgagaaccaggccgccagctggagaaagctgaagaacagccaggaggcccagcagagacaggccaccctggtgagaaagctgcaggccaaggtgctgcagtacagaagctggtgccaggagctggagaagagactggaggccaccggcggccccatcccccagagatgggagaacgtggaggagcccaacctggacgagctgctggtgagactggaggaggagcagcagagatgcgagagcctggccgaggtgaacacccagctgagactgcacatggagaaggccgacgtggtgaacaaggccctgagagaggacgtggagaagctgaccgtggactggagcagagccagagacgagctgatgagaaaggagagccagtggcagatggagcaggagttcttcaagggctacctgaagggcgagcacggcagactgctgagcctgtggagagaggtggtgaccttcagaagacacttcctggagatgaagagcgccaccgacagagacctgatggagctgaaggccgagcacgtgagactgagcggcagcctgctgacctgctgcctgagactgaccgtgggcgcccagagcagagagcccaacggcagcggcagaatggacggcagagagcccgcccagctgctgctgctgctggccaagacccaggagctggagaaggaggcccacgagagaagccaggagctgatccagctgaagagccagggcgacctggagaaggccgagctgcaggacagagtgaccgagctgagcgccctgctgacccagagccagaagcagaacgaggactacgagaagatgatcaaggccctgagagagaccgtggagatcctggagaccaaccacaccgagctgatggagcacgaggccagcctgagcagaaacgcccaggaggagaagctgagcctgcagcaggtgatcaaggacatcacccaggtgatggtggaggagggcgacaacatcgcccagggcagcggccacgagaacagcctggagctggacagcagcatcttcagccagttcgactaccaggacgccgacaaggccctgaccctggtgagaagcgtgctgaccagaagaagacaggccgtgcaggacctgagacagcagctggccggctgccaggaggccgtgaacctgctgcagcagcagcacgaccagtgggaggaggagggcaaggccctgagacagagactgcagaagctgaccggcgagagagacaccctggccggccagaccgtggacctgcagggcgaggtggacagcctgagcaaggagagagagctgctgcagaaggccagagaggagctgagacagcagctggaggtgctggagcaggaggcctggagactgagaagagtgaacgtggagctgcagctgcagggcgacagcgcccagggccagaaggaggagcagcaggaggagctgcacctggccgtgagagagagagagagactgcaggagatgctgatgggcctggaggccaagcagagcgagagcctgagcgagctgatcaccctgagagaggccctggagagcagccacctggagggcgagctgctgagacaggagcagaccgaggtgaccgccgccctggccagagccgagcagagcatcgccgagctgagcagcagcgagaacaccctgaagaccgaggtggccgacctgagagccgccgccgtgaagctgagcgccctgaacgaggccctggccctggacaaggtgggcctgaaccagcagctgctgcagctggaggaggagaaccagagcgtgtgcagcagaatggaggccgccgagcaggccagaaacgccctgcaggtggacctggccgaggccgagaagagaagagaggccctgtgggagaagaacacccacctggaggcccagctgcagaaggccgaggaggccggcgccgagctgcaggccgacctgagagacatccaggaggagaaggaggagatccagaagaagctgagcgagagcagacaccagcaggaggccgccaccacccagctggagcagctgcaccaggaggccaagagacaggaggaggtgctggccagagccgtgcaggagaaggaggccctggtgagagagaaggccgccctggaggtgagactgcaggccgtggagagagacagacaggacctggccgagcagctgcagggcctgagcagcgccaaggagctgctggagagcagcctgttcgaggcccagcagcagaacagcgtgatcgaggtgaccaagggccagctggaggtgcagatccagaccgtgacccaggccaaggaggtgatccagggcgaggtgagatgcctgaagctggagctggacaccgagagaagccaggccgagcaggagagagacgccgccgccagacagctggcccaggccgagcaggagggcaagaccgccctggagcagcagaaggccgcccacgagaaggaggtgaaccagctgagagagaagtgggagaaggagagaagctggcaccagcaggagctggccaaggccctggagagcctggagagagagaagatggagctggagatgagactgaaggagcagcagaccgagatggaggccatccaggcccagagagaggaggagagaacccaggccgagagcgccctgtgccagatgcagctggagaccgagaaggagagagtgagcctgctggagaccctgctgcagacccagaaggagctggccgacgccagccagcagctggagagactgagacaggacatgaaggtgcagaagctgaaggagcaggagaccaccggcatcctgcagacccagctgcaggaggcccagagagagctgaaggaggccgccagacagcacagagacgacctggccgccctgcaggaggagagcagcagcctgctgcaggacaagatggacctgcagaagcaggtggaggacctgaagagccagctggtggcccaggacgacagccagagactggtggagcaggaggtgcaggagaagctgagagagacccaggagtacaacagaatccagaaggagctggagagagagaaggccagcctgaccctgagcctgatggagaaggagcagagactgctggtgctgcaggaggccgacagcatcagacagcaggagctgagcgccctgagacaggacatgcaggaggcccagggcgagcagaaggagctgagcgcccagatggagctgctgagacaggaggtgaaggagaaggaggccgacttcctggcccaggaggcccagctgctggaggagctggaggccagccacatcaccgagcagcagctgagagccagcctgtgggcccaggaggccaaggccgcccagctgcagctgagactgagaagcaccgagagccagctggaggccctggccgccgagcagcagcccggcaaccaggcccaggcccaggcccagctggccagcctgtacagcgccctgcagcaggccctgggcagcgtgtgcgagagcagacccgagctgagcggcggcggcgacagcgcccccagcgtgtggggcctggagcccgaccagaacggcgccagaagcctgttcaagagaggccccctgctgaccgccctgagcgccgaggccgtggccagcgccctgcacaagctgcaccaggacctgtggaagacccagcagaccagagacgtgctgagagaccaggtgcagaagctggaggagagactgaccgacaccgaggccgagaagagccaggtgcacaccgagctgcaggacctgcagagacagctgagccagaaccaggaggagaagagcaagtgggagggcaagcagaacagcctggagagcgagctgatggagctgcacgagaccatggccagcctgcagagcagactgagaagagccgagctgcagagaatggaggcccagggcgagagagagctgctgcaggccgccaaggagaacctgaccgcccaggtggagcacctgcaggccgccgtggtggaggccagagcccaggccagcgccgccggcatcctggaggaggacctgagaaccgccagaagcgccctgaagctgaagaacgaggaggtggagagcgagagagagagagcccaggccctgcaggagcagggcgagctgaaggtggcccagggcaaggccctgcaggagaacctggccctgctgacccagaccctggccgagagagaggaggaggtggagaccctgagaggccagatccaggagctggagaagcagagagagatgcagaaggccgccctggagctgctgagcctggacctgaagaagagaaaccaggaggtggacctgcagcaggagcagatccaggagctggagaagtgcagaagcgtgctggagcacctgcccatggccgtgcaggagagagagcagaagctgaccgtgcagagagagcagatcagagagctggagaaggacagagagacccagagaaacgtgctggagcaccagctgctggagctggagaagaaggaccagatgatcgagagccagagaggccaggtgcaggacctgaagaagcagctggtgaccctggagtgcctggccctggagctggaggagaaccaccacaagatggagtgccagcagaagctgatcaaggagctggagggccagagagagacccagagagtggccctgacccacctgaccctggacctggaggagagaagccaggagctgcaggcccagagcagccagatccacgacctggagagccacagcaccgtgctggccagagagctgcaggagagagaccaggaggtgaagagccagagagagcagatcgaggagctgcagagacagaaggagcacctgacccaggacctggagagaagagaccaggagctgatgctgcagaaggagagaatccaggtgctggaggaccagagaaccagacagaccaagatcctggaggaggacctggagcagatcaagctgagcctgagagagagaggcagagagctgaccacccagagacagctgatgcaggagagagccgaggagggcaagggccccagcaaggcccagagaggcagcctggagcacatgaagctgatcctgagagacaaggagaaggaggtggagtgccagcaggagcacatccacgagctgcaggagctgaaggaccagctggagcagcagctgcagggcctgcacagaaaggtgggcgagaccagcctgctgctgagccagagagagcaggagatcgtggtgctgcagcagcagctgcaggaggccagagagcagggcgagctgaaggagcagagcctgcagagccagctggacgaggcccagagagccctggcccagagagaccaggagctggaggccctgcagcaggagcagcagcaggcccagggccaggaggagagagtgaaggagaaggccgacgccctgcagggcgccctggagcaggcccacatgaccctgaaggagagacacggcgagctgcaggaccacaaggagcaggccagaagactggaggaggagctggccgtggagggcagaagagtgcaggccctggaggaggtgctgggcgacctgagagccgagagcagagagcaggagaaggccctgctggccctgcagcagcagtgcgccgagcaggcccaggagcacgaggtggagaccagagccctgcaggacagctggctgcaggcccaggccgtgctgaaggagagagaccaggagctggaggccctgagagccgagagccagagcagcagacaccaggaggaggccgccagagccagagccgaggccctgcaggaggccctgggcaaggcccacgccgccctgcagggcaaggagcagcacctgctggagcaggccgagctgagcagaagcctggaggccagcaccgccaccctgcaggccagcctggacgcctgccaggcccacagcagacagctggaggaggccctgagaatccaggagggcgagatccaggaccaggacctgagataccaggaggacgtgcagcagctgcagcaggccctggcccagagagacgaggagctgagacaccagcaggagagagagcagctgctggagaagagcctggcccagagagtgcaggagaacatgatccaggagaagcagaacctgggccaggagagagaggaggaggagatcagaggcctgcaccagagcgtgagagagctgcagctgaccctggcccagaaggagcaggagatcctggagctgagagagacccagcagagaaacaacctggaggccctgccccacagccacaagaccagccccatggaggagcagagcctgaagctggacagcctggagcccagactgcagagagagctggagagactgcaggccgccctgagacagaccgaggccagagagatcgagtggagagagaaggcccaggacctggccctgagcctggcccagaccaaggccagcgtgagcagcctgcaggaggtggccatgttcctgcaggccagcgtgctggagagagacagcgagcagcagagactgcaggacgagctggagctgaccagaagagccctggagaaggagagactgcacagccccggcgccaccagcaccgccgagctgggcagcagaggcgagcagggcgtgcagctgggcgaggtgagcggcgtggaggccgagcccagccccgacggcatggagaagcagagctggagacagagactggagcacctgcagcaggccgtggccagactggagatcgacagaagcagactgcagagacacaacgtgcagctgagaagcaccctggagcaggtggagagagagagaagaaagctgaagagagaggccatgagagccgcccaggccggcagcctggagatcagcaaggccaccgccagcagccccacccagcaggacggcagaggccagaagaacagcgacgccaagtgcgtggccgagctgcagaaggaggtggtgctgctgcaggcccagctgaccctggagagaaagcagaagcaggactacatcaccagaagcgcccagaccagcagagagctggccggcctgcaccacagcctgagccacagcctgctggccgtggcccaggcccccgaggccaccgtgctggaggccgagaccagaagactggacgagagcctgacccagagcctgaccagccccggccccgtgctgctgcaccccagccccagcaccacccaggccgccagcagatag

SEQ ID NO: 76276 - DNA, 345 bp, Artificial Sequence
  Description of Artificial Sequence: Synthetic coding sequence
atggagaccagaagccccggcctgaacaacatgaagccccagagcctgcagctggtgctggaggagcaggtgctggccctgcagcagcagatggccgagaaccaggccgccagctggagaaagctgaagaacagccaggaggcccagcagagacaggccaccctggtgagaaagctgcaggccaaggtgctgcagtacagaagctggtgccaggagctggagaagagactggaggccaccggcggccccatcccccagagatgggagaacgtggaggagcccaacctggacgagctgctggtgagactggaggaggagcagcagagatgcgagagcctggcctag

SEQ ID NO: 76277 - DNA, 2055 bp, Artificial Sequence
  Description of Artificial Sequence: Synthetic coding sequence
atggagaccagaagccccggcctgaacaacatgaagccccagagcctgcagctggtgctggaggagcaggtgctggccctgcagcagcagatggccgagaaccaggccgccagctggagaaagctgaagaacagccaggaggcccagcagagacaggccaccctggtgagaaagctgcaggccaaggtgctgcagtacagaagctggtgccaggagctggagaagagactggaggccaccggcggccccatcccccagagatgggagaacgtggaggagcccaacctggacgagctgctggtgagactggaggaggagcagcagagatgcgagagcctggccgaggtgaacacccagctgagactgcacatggagaaggccgacgtggtgaacaaggccctgagagaggacgtggagaagctgaccgtggactggagcagagccagagacgagctgatgagaaaggagagccagtggcagatggagcaggagttcttcaagggctacctgaagggcgagcacggcagactgctgagcctgtggagagaggtggtgaccttcagaagacacttcctggagatgaagagcgccaccgacagagacctgatggagctgaaggccgagcacgtgagactgagcggcagcctgctgacctgctgcctgagactgaccgtgggcgcccagagcagagagcccaacggcagcggcagaatggacggcagagagcccgcccagctgctgctgctgctggccaagacccaggagctggagaaggaggcccacgagagaagccaggagctgatccagctgaagagccagggcgacctggagaaggccgagctgcaggacagagtgaccgagctgagcgccctgctgacccagagccagaagcagaacgaggactacgagaagatgatcaaggccctgagagagaccgtggagatcctgaccaaccacaccgagctgatggagcacgaggccagcctgagcagaaacgcccaggaggagaagctgagcctgcagcaggtgatcaaggacatcacccaggtgatggtggaggagggcgacaacatcgcccagggcagcggccacgagaacagcctggagctggacagcagcatcttcagccagttcgactaccaggacgccgacaaggccctgaccctggtgagaagcgtgctgaccagaagaagacaggccgtgcaggacctgagacagcagctggccggctgccaggaggccgtgaacctgctgcagcagcagcacgaccagtgggaggaggagggcaaggccctgagacagagactgcagaagctgaccggcgagagagacaccctggccggccagaccgtggacctgcagggcgaggtggacagcctgagcaaggagagagagctgctgcagaaggccagagaggagctgagacagcagctggaggtgctggagcaggaggcctggagactgagaagagtgaacgtggagctgcagctgcagggcgacagcgcccagggccagaaggaggagcagcaggaggagctgcacctggccgtgagagagagagagagactgcaggagatgctgatgggcctggaggccaagcagagcgagagcctgagcgagctgatcaccctgagagaggccctggagagcagccacctggagggcgagctgctgagacaggagcagaccgaggtgaccgccgccctggccagagccgagcagagcatcgccgagctgagcagcagcgagaacaccctgaagaccgaggtggccgacctgagagccgccgccgtgaagctgagcgccctgaacgaggccctggccctggacaaggtgggcctgaaccagcagctgctgcagctggaggaggagaaccagagcgtgtgcagcagaatggaggccgccgagcaggccagaaacgccctgcaggtggacctggccgaggccgagaagagaagagaggccctgtgggagaagaacacccacctggaggcccagctgcagaaggccgaggaggccggcgccgagctgcaggccgacctgagagacatctag

SEQ ID NO: 76278 - DNA, 495 bp, Artificial Sequence
  Description of Artificial Sequence: Synthetic coding sequence
atggagaccagaagccccggcctgaacaacatgaagccccagagcctgcagctggtgctggaggagcaggtgctggccctgcagcagcagatggccgagaaccaggccgccagctggagaaagctgaagaacagccaggaggcccagcagagacaggccaccctggtgagaaagctgcaggccaaggtgctgcagtacagaagctggtgccaggagctggagaagagactggaggccaccggcggccccatcccccagagatgggagaacgtggaggagcccaacctggacgagctgctggtgagactggaggaggagcagcagagatgcgagagcctggccgaggtgaacacccagctgagactgcacatggagaaggccgacgtggtgaacaaggccctgagagaggacgtggagaagctgaccgtggactggagcagagccagagacgagctgatgagaaaggagagccagtggcagatggagcaggagtag

SEQ ID NO: 76279 - DNA, 1617 bp, Artificial Sequence
  Description of Artificial Sequence: Synthetic coding sequence
atggagaccagaagccccggcctgaacaacatgaagccccagagcctgcagctggtgctggaggagcaggtgctggccctgcagcagcagatggccgagaaccaggccgccagctggagaaagctgaagaacagccaggaggcccagcagagacaggccaccctggtgagaaagctgcaggccaaggtgctgcagtacagaagctggtgccaggagctggagaagagactggaggccaccggcggccccatcccccagagatgggagaacgtggaggagcccaacctggacgagctgctggtgagactggaggaggagcagcagagatgcgagagcctggccgaggtgaacacccagctgagactgcacatggagaaggccgacgtggtgaacaaggccctgagagaggacgtggagaagctgaccgtggactggagcagagccagagacgagctgatgagaaaggagagccagtggcagatggagcaggagttcttcaagggctacctgaagggcgagcacggcagactgctgagcctgtggagagaggtggtgaccttcagaagacacttcctggagatgaagagcgccaccgacagagacctgatggagctgaaggccgagcacgtgagactgagcggcagcctgctgacctgctgcctgagactgaccgtgggcgcccagagcagagagcccaacggcagcggcagaatggacggcagagagcccgcccagctgctgctgctgctggccaagacccaggagctggagaaggaggcccacgagagaagccaggagctgatccagctgaagagccagggcgacctggagaaggccgagctgcaggacagagtgaccgagctgagcgccctgctgacccagagccagaagcagaacgaggactacgagaagatgatcaaggccctgagagagaccgtggagatcctggagaccaaccacaccgagctgatggagcacgaggccagcctgagcagaaacgcccaggaggagaagctgagcctgcagcaggtgatcaaggacatcacccaggtgatggtggaggagggcgacaacatcgcccagggcagcggccacgagaacagcctggagctggacagcagcatcttcagccagttcgactaccaggacgccgacaaggccctgaccctggtgagaagcgtgctgaccagaagaagacaggccgtgcaggacctgagacagcagctggccggctgccaggaggccgtgaacctgctgcagcagcagcacgaccagtgggaggaggagggcaaggccctgagacagagactgcagaagctgaccggcgagagagacaccctggccggccagaccgtggacctgcagggcgaggtggacagcctgagcaaggagagagagctgctgcagaaggccagagaggagctgagacagcagctggaggtgctggagcaggaggcctggagactgagaagagtgaacgtggagctgcagctgcagggcgacagcgcccagggccagaaggaggagcagcaggaggagctgcacctggccgtgagagagagagagagactgcagagcagccagctgcagagctgcagagtgctgaagaccccctag

SEQ ID NO: 76280 - DNA, 7446 bp, Artificial Sequence
  Description of Artificial Sequence: Synthetic coding sequence
atgccccccaacatcaactggaaggagatcatgaaggtggaccccgacgacctgcccagacaggaggagctggccgacaacctgctgatcagcctgagcaaggtggaggtgaacgagctgaagagcgagaagcaggagaacgtgatccacctgttcagaatcacccagagcctgatgaagatgaaggcccaggaggtggagctggccctggaggaggtggagaaggccggcgaggagcaggccaagttcgagaaccagctgaagaccaaggtgatgaagctggagaacgagctggagatggcccagcagagcgccggcggcagagacaccagattcctgagaaacgagatctgccagctggagaagcagctggagcagaaggacagagagctggaggacatggagaaggagctggagaaggagaagaaggtgaacgagcagctggccctgagaaacgaggaggccgagaacgagaacagcaagctgagaagagagaacaagagactgaagaagaagaacgagcagctgtgccaggacatcatcgactaccagaagcagatcgacagccagaaggagaccctgctgagcagaagaggcgaggacagcgactacagaagccagctgagcaagaagaactacgagctgatccagtacctggacgagatccagaccctgaccgaggccaacgagaagatcgaggtgcagaaccaggagatgagaaagaacctggaggagagcgtgcaggagatggagaagatgaccgacgagtacaacagaatgaaggccatcgtgcaccagaccgacaacgtgatcgaccagctgaagaaggagaacgaccactaccagctgcaggtgcaggagctgaccgacctgctgaagagcaagaacgaggaggacgaccccatcatggtggccgtgaacgccaaggtggaggagtggaagctgatcctgagcagcaaggacgacgagatcatcgagtaccagcagatgctgcacaacctgagagagaagctgaagaacgcccagctggacgccgacaagagcaacgtgatggccctgcagcagggcatccaggagagagacagccagatcaagatgctgaccgagcaggtggagcagtacaccaaggagatggagaagaacacctgcatcatcgaggacctgaagaacgagctgcagagaaacaagggcgccagcaccctgagccagcagacccacatgaagatccagagcaccctggacatcctgaaggagaagaccaaggaggccgagagaaccgccgagctggccgaggccgacgccagagagaaggacaaggagctggtggaggccctgaagagactgaaggactacgagagcggcgtgtacggcctggaggacgccgtggtggagatcaagaactgcaagaaccagatcaagatcagagacagagagatcgagatcctgaccaaggagatcaacaagctggagctgaagatcagcgacttcctggacgagaacgaggccctgagagagagagtgggcctggagcccaagaccatgatcgacctgaccgagttcagaaacagcaagcacctgaagcagcagcagtacagagccgagaaccagatcctgctgaaggaggccagcatcgagagcctggaggaggagagactggacctgaagaagaagatcagacagatggcccaggagagaggcaagagaagcgccaccagcggcctgaccaccgaggacctgaacctgaccgagaacatcagccagggcgacagaatcagcgagagaaagctggacctgctgagcctgaagaacatgagcgaggcccagagcaagaacgagttcctgagcagagagctgatcgagaaggagagagacctggagagaagcagaaccgtgatcgccaagttccagaacaagctgaaggagctggtggaggagaacaagcagctggaggagggcatgaaggagatcctgcaggccatcaaggagatgcagaaggaccccgacgtgaagggcggcgagaccagcctgatcatccccagcctggagagactggtgaacgccatcgagagcaagaacgccgagggcatcttcgacgccagcctgcacctgaaggcccaggtggaccagctgaccggcagaaacgaggagctgagacaggagctgagagagagcagaaaggaggccatcaactacagccagcagctggccaaggccaacctgaagatcgaccacctggagaaggagaccagcctgctgagacagagcgagggcagcaacgtggtgttcaagggcatcgacctgcccgacggcatcgcccccagcagcgccagcatcatcaacagccagaacgagtacctgatccacctgctgcaggagctggagaacaaggagaagaagctgaagaacctggaggacagcctggaggactacaacagaaagttcgccgtgatcagacaccagcagagcctgctgtacaaggagtacctgagcgagaaggagacctggaagaccgagagcaagaccatcaaggaggagaagagaaagctggaggaccaggtgcagcaggacgccatcaaggtgaaggagtacaacaacctgctgaacgccctgcagatggacagcgacgagatgaagaagatcctggccgagaacagcagaaagatcaccgtgctgcaggtgaacgagaagagcctgatcagacagtacaccaccctggtggagctggagagacagctgagaaaggagaacgagaagcagaagaacgagctgctgagcatggaggccgaggtgtgcgagaagatcggctgcctgcagagattcaaggagatggccatcttcaagatcgccgccctgcagaaggtggtggacaacagcgtgagcctgagcgagctggagctggccaacaagcagtacaacgagctgaccgccaagtacagagacatcctgcagaaggacaacatgctggtgcagagaaccagcaacctggagcacctggagtgcgagaacatcagcctgaaggagcaggtggagagcatcaacaaggagctggagatcaccaaggagaagctgcacaccatcgagcaggcctgggagcaggagaccaagctgggcaacgagagcagcatggacaaggccaagaagagcatcaccaacagcgacatcgtgagcatcagcaagaagatcaccatgctggagatgaaggagctgaacgagagacagagagccgagcactgccagaagatgtacgagcacctgagaaccagcctgaagcagatggaggagagaaacttcgagctggagaccaagttcgccgagctgaccaagatcaacctggacgcccagaaggtggagcagatgctgagagacgagctggccgacagcgtgagcaaggccgtgagcgacgccgacagacagagaatcctggagctggagaagaacgagatggagctgaaggtggaggtgagcaagctgagagagatcagcgacatcgccagaagacaggtggagatcctgaacgcccagcagcagagcagagacaaggaggtggagagcctgagaatgcagctgctggactaccaggcccagagcgacgagaagagcctgatcgccaagctgcaccagcacaacgtgagcctgcagctgagcgaggccaccgccctgggcaagctggagagcatcaccagcaagctgcagaagatggaggcctacaacctgagactggagcagaagctggacgagaaggagcaggccctgtactacgccagactggagggcagaaacagagccaagcacctgagacagaccatccagagcctgagaagacagttcagcggcgccctgcccctggcccagcaggagaagttcagcaagaccatgatccagctgcagaacgacaagctgaagatcatgcaggagatgaagaacagccagcaggagcacagaaacatggagaacaagaccctggagatggagctgaagctgaagggcctggaggagctgatcagcaccctgaaggacaccaagggcgcccagaaggtgatcaactggcacatgaagatcgaggagctgagactgcaggagctgaagctgaacagagagctggtgaaggacaaggaggagatcaagtacctgaacaacatcatcagcgagtacgagagaaccatcagcagcctggaggaggagatcgtgcagcagaacaagttccacgaggagagacagatggcctgggaccagagagaggtggacctggagagacagctggacatcttcgacagacagcagaacgagatcctgaacgccgcccagaagttcgaggaggccaccggcagcatccccgaccccagcctgcccctgcccaaccagctggagatcgccctgagaaagatcaaggagaacatcagaatcatcctggagaccagagccacctgcaagagcctggaggagaagctgaaggagaaggagagcgccctgagactggccgagcagaacatcctgagcagagacaaggtgatcaacgagctgagactgagactgcccgccaccgccgagagagagaagctgatcgccgagctgggcagaaaggagatggagcccaagagccaccacaccctgaagatcgcccaccagaccatcgccaacatgcaggccagactgaaccagaaggaggaggtgctgaagaagtaccagagactgctggagaaggccagagaggagcagagagagatcgtgaagaagcacgaggaggacctgcacatcctgcaccacagactggagctgcaggccgacagcagcctgaacaagttcaagcagaccgcctgggacctgatgaagcagagccccacccccgtgcccaccaacaagcacttcatcagactggccgagatggagcagaccgtggccgagcaggacgacagcctgagcagcctgctggtgaagctgaagaaggtgagccaggacctggagagacagagagagatcaccgagctgaaggtgaaggagttcgagaacatcaagctgcagctgcaggagaaccacgaggacgaggtgaagaaggtgaaggccgaggtggaggacctgaagtacctgctggaccagagccagaaggagagccagtgcctgaagagcgagctgcaggcccagaaggaggccaacagcagagcccccaccaccaccatgagaaacctggtggagagactgaagagccagctggccctgaaggagaagcagcagaaggccctgagcagagccctgctggagctgagagccgagatgaccgccgccgccgaggagagaatcatcagcgccaccagccagaaggaggcccacctgaacgtgcagcagatcgtggacagacacaccagagagctgaagacccaggtggaggacctgaacgagaacctgctgaagctgaaggaggccctgaagaccagcaagaacagagagaacagcctgaccgacaacctgaacgacctgaacaacgagctgcagaagaagcagaaggcctacaacaagatcctgagagagaaggaggagatcgaccaggagaacgacgagctgaagagacagatcaagagactgaccagcggcctgcagggcaagcccctgaccgacaacaagcagagcctgatcgaggagctgcagagaaaggtgaagaagctggagaaccagctggagggcaaggtggaggaggtggacctgaagcccatgaaggagaagaacgccaaggaggagctgatcagatgggaggagggcaagaagtggcaggccaagatcgagggcatcagaaacaagctgaaggagaaggagggcgaggtgttcaccctgaccaagcagctgaacaccctgaaggacctgttcgccaaggccgacaaggagaagctgaccctgcagagaaagctgaagaccaccggcatgaccgtggaccaggtgctgggcatcagagccctggagagcgagaaggagctggaggagctgaagaagagaaacctggacctggagaacgacatcctgtacatgagagcccaccaggccctgcccagagacagcgtggtggaggacctgcacctgcagaacagatacctgcaggagaagctgcacgccctggagaagcagttcagcaaggacacctacagcaagcccagcatcagcggcatcgagagcgacgaccactgccagagagagcaggagctgcagaaggagaacctgaagctgagcagcgagaacatcgagctgaagttccagctggagcaggccaacaaggacctgcccagactgaagaaccaggtgagagacctgaaggagatgtgcgagttcctgaagaaggagaaggccgaggtgcagagaaagctgggccacgtgagaggcagcggcagaagcggcaagaccatccccgagctggagaagaccatcggcctgatgaagaaggtggtggagaaggtgcagagagagaacgagcagctgaagaaggccagcggcatcctgaccagcgagaagatggccaacatcgagcaggagaacgagaagctgaaggccgagctggagaagctgaaggcccacctgggccaccagctgagcatgcactacgagagcaagaccaagggcaccgagaagatcatcgccgagaacgagagactgagaaaggagctgaagaaggagaccgacgccgccgagaagctgagaatcgccaagaacaacctggagatcctgaacgagaagatgaccgtgcagctggaggagaccggcaagagactgcagttcgccgagagcagaggcccccagctggagggcgccgacagcaagagctggaagagcatcgtggtgaccagaatgtacgagaccaagctgaaggagctggagaccgacatcgccaagaagaaccagagcatcaccgacctgaagcagctggtgaaggaggccaccgagagagagcagaaggtgaacaagtacaacgaggacctggagcagcagatcaagatcctgaagcacgtgcccgagggcgccgagaccgagcagggcctgaagagagagctgcaggtgctgagactggccaaccaccagctggacaaggagaaggccgagctgatccaccagatcgaggccaacaaggaccagagcggcgccgagagcaccatccccgacgccgaccagctgaaggagaagatcaaggacctggagacccagctgaagatgagcgacctggagaagcagcacctgaaggaggagatcaagaagctgaagaaggagctggagaacttcgaccccagcttcttcgaggagatcgaggacctgaagtacaactacaaggaggaggtgaagaagaacatcctgctggaggagaaggtgaagaagctgagcgagcagctgggcgtggagctgaccagccccgtggccgccagcgaggagttcgaggacgaggaggagagccccgtgaacttccccatctactag

SEQ ID NO: 76281 - DNA, 4620 bp, Artificial Sequence
  Description of Artificial Sequence: Synthetic coding sequence
atggccatcttcaagatcgccgccctgcagaaggtggtggacaacagcgtgagcctgagcgagctggagctggccaacaagcagtacaacgagctgaccgccaagtacagagacatcctgcagaaggacaacatgctggtgcagagaaccagcaacctggagcacctggagtgcgagaacatcagcctgaaggagcaggtggagagcatcaacaaggagctggagatcaccaaggagaagctgcacaccatcgagcaggcctgggagcaggagaccaagctgggcaacgagagcagcatggacaaggccaagaagagcatcaccaacagcgacatcgtgagcatcagcaagaagatcaccatgctggagatgaaggagctgaacgagagacagagagccgagcactgccagaagatgtacgagcacctgagaaccagcctgaagcagatggaggagagaaacttcgagctggagaccaagttcgccgagctgaccaagatcaacctggacgcccagaaggtggagcagatgctgagagacgagctggccgacagcgtgagcaaggccgtgagcgacgccgacagacagagaatcctggagctggagaagaacgagatggagctgaaggtggaggtgagcaagctgagagagatcagcgacatcgccagaagacaggtggagatcctgaacgcccagcagcagagcagagacaaggaggtggagagcctgagaatgcagctgctggactaccaggcccagagcgacgagaagagcctgatcgccaagctgcaccagcacaacgtgagcctgcagctgagcgaggccaccgccctgggcaagctggagagcatcaccagcaagctgcagaagatggaggcctacaacctgagactggagcagaagctggacgagaaggagcaggccctgtactacgccagactggagggcagaaacagagccaagcacctgagacagaccatccagagcctgagaagacagttcagcggcgccctgcccctggcccagcaggagaagttcagcaagaccatgatccagctgcagaacgacaagctgaagatcatgcaggagatgaagaacagccagcaggagcacagaaacatggagaacaagaccctggagatggagctgaagctgaagggcctggaggagctgatcagcaccctgaaggacaccaagggcgcccagaaggtgatcaactggcacatgaagatcgaggagctgagactgcaggagctgaagctgaacagagagctggtgaaggacaaggaggagatcaagtacctgaacaacatcatcagcgagtacgagagaaccatcagcagcctggaggaggagatcgtgcagcagaacaagttccacgaggagagacagatggcctgggaccagagagaggtggacctggagagacagctggacatcttcgacagacagcagaacgagatcctgaacgccgcccagaagttcgaggaggccaccggcagcatccccgaccccagcctgcccctgcccaaccagctggagatcgccctgagaaagatcaaggagaacatcagaatcatcctggagaccagagccacctgcaagagcctggaggagaagctgaaggagaaggagagcgccctgagactggccgagcagaacatcctgagcagagacaaggtgatcaacgagctgagactgagactgcccgccaccgccgagagagagaagctgatcgccgagctgggcagaaaggagatggagcccaagagccaccacaccctgaagatcgcccaccagaccatcgccaacatgcaggccagactgaaccagaaggaggaggtgctgaagaagtaccagagactgctggagaaggccagagaggagcagagagagatcgtgaagaagcacgaggaggacctgcacatcctgcaccacagactggagctgcaggccgacagcagcctgaacaagttcaagcagaccgcctgggacctgatgaagcagagccccacccccgtgcccaccaacaagcacttcatcagactggccgagatggagcagaccgtggccgagcaggacgacagcctgagcagcctgctggtgaagctgaagaaggtgagccaggacctggagagacagagagagatcaccgagctgaaggtgaaggagttcgagaacatcaagctgcagctgcaggagaaccacgaggacgaggtgaagaaggtgaaggccgaggtggaggacctgaagtacctgctggaccagagccagaaggagagccagtgcctgaagagcgagctgcaggcccagaaggaggccaacagcagagcccccaccaccaccatgagaaacctggtggagagactgaagagccagctggccctgaaggagaagcagcagaaggccctgagcagagccctgctggagctgagagccgagatgaccgccgccgccgaggagagaatcatcagcgccaccagccagaaggaggcccacctgaacgtgcagcagatcgtggacagacacaccagagagctgaagacccaggtggaggacctgaacgagaacctgctgaagctgaaggaggccctgaagaccagcaagaacagagagaacagcctgaccgacaacctgaacgacctgaacaacgagctgcagaagaagcagaaggcctacaacaagatcctgagagagaaggaggagatcgaccaggagaacgacgagctgaagagacagatcaagagactgaccagcggcctgcagggcaagcccctgaccgacaacaagcagagcctgatcgaggagctgcagagaaaggtgaagaagctggagaaccagctggagggcaaggtggaggaggtggacctgaagcccatgaaggagaagaacgccaaggaggagctgatcagatgggaggagggcaagaagtggcaggccaagatcgagggcatcagaaacaagctgaaggagaaggagggcgaggtgttcaccctgaccaagcagctgaacaccctgaaggacctgttcgccaaggccgacaaggagaagctgaccctgcagagaaagctgaagaccaccggcatgaccgtggaccaggtgctgggcatcagagccctggagagcgagaaggagctggaggagctgaagaagagaaacctggacctggagaacgacatcctgtacatgagagcccaccaggccctgcccagagacagcgtggtggaggacctgcacctgcagaacagatacctgcaggagaagctgcacgccctggagaagcagttcagcaaggacacctacagcaagcccagcatcagcggcatcgagagcgacgaccactgccagagagagcaggagctgcagaaggagaacctgaagctgagcagcgagaacatcgagctgaagttccagctggagcaggccaacaaggacctgcccagactgaagaaccaggtgagagacctgaaggagatgtgcgagttcctgaagaaggagaaggccgaggtgcagagaaagctgggccacgtgagaggcagcggcagaagcggcaagaccatccccgagctggagaagaccatcggcctgatgaagaaggtggtggagaaggtgcagagagagaacgagcagctgaagaaggccagcggcatcctgaccagcgagaagatggccaacatcgagcaggagaacgagaagctgaaggccgagctggagaagctgaaggcccacctgggccaccagctgagcatgcactacgagagcaagaccaagggcaccgagaagatcatcgccgagaacgagagactgagaaaggagctgaagaaggagaccgacgccgccgagaagctgagaatcgccaagaacaacctggagatcctgaacgagaagatgaccgtgcagctggaggagaccggcaagagactgcagttcgccgagagcagaggcccccagctggagggcgccgacagcaagagctggaagagcatcgtggtgaccagaatgtacgagaccaagctgaaggagctggagaccgacatcgccaagaagaaccagagcatcaccgacctgaagcagctggtgaaggaggccaccgagagagagcagaaggtgaacaagtacaacgaggacctggagcagcagatcaagatcctgaagcacgtgcccgagggcgccgagaccgagcagggcctgaagagagagctgcaggtgctgagactggccaaccaccagctggacaaggagaaggccgagctgatccaccagatcgaggccaacaaggaccagagcggcgccgagagcaccatccccgacgccgaccagctgaaggagaagatcaaggacctggagacccagctgaagatgagcgacctggagaagcagcacctgaaggaggagatcaagaagctgaagaaggagctggagaacttcgaccccagcttcttcgaggagatcgaggacctgaagtacaactacaaggaggaggtgaagaagaacatcctgctggaggagaaggtgaagaagctgagcgagcagctgggcgtggagctgaccagccccgtggccgccagcgaggagttcgaggacgaggaggagagccccgtgaacttccccatctactag

SEQ ID NO: 76282 - DNA, 2415 bp, Artificial Sequence
  Description of Artificial Sequence: Synthetic coding sequence
atgccccccaacatcaactggaaggagatcatgaaggtggaccccgacgacctgcccagacaggaggagctggccgacaacctgctgatcagcctgagcaaggtggaggtgaacgagctgaagagcgagaagcaggagaacgtgatccacctgttcagaatcacccagagcctgatgaagatgaaggcccaggaggtggagctggccctggaggaggtggagaaggccggcgaggagcaggccaagttcgagaaccagctgaagaccaaggtgatgaagctggagaacgagctggagatggcccagcagagcgccggcggcagagacaccagattcctgagaaacgagatctgccagctggagaagcagctggagcagaaggacagagagctggaggacatggagaaggagctggagaaggagaagaaggtgaacgagcagctggccctgagaaacgaggaggccgagaacgagaacagcaagctgagaagagagaacaagagactgaagaagaagaacgagcagctgtgccaggacatcatcgactaccagaagcagatcgacagccagaaggagaccctgctgagcagaagaggcgaggacagcgactacagaagccagctgagcaagaagaactacgagctgatccagtacctggacgagatccagaccctgaccgaggccaacgagaagatcgaggtgcagaaccaggagatgagaaagaacctggaggagagcgtgcaggagatggagaagatgaccgacgagtacaacagaatgaaggccatcgtgcaccagaccgacaacgtgatcgaccagctgaagaaggagaacgaccactaccagctgcaggtgcaggagctgaccgacctgctgaagagcaagaacgaggaggacgaccccatcatggtggccgtgaacgccaaggtggaggagtggaagctgatcctgagcagcaaggacgacgagatcatcgagtaccagcagatgctgcacaacctgagagagaagctgaagaacgcccagctggacgccgacaagagcaacgtgatggccctgcagcagggcatccaggagagagacagccagatcaagatgctgaccgagcaggtggagcagtacaccaaggagatggagaagaacacctgcatcatcgaggacctgaagaacgagctgcagagaaacaagggcgccagcaccctgagccagcagacccacatgaagatccagagcaccctggacatcctgaaggagaagaccaaggaggccgagagaaccgccgagctggccgaggccgacgccagagagaaggacaaggagctggtggaggccctgaagagactgaaggactacgagagcggcgtgtacggcctggaggacgccgtggtggagatcaagaactgcaagaaccagatcaagatcagagacagagagatcgagatcctgaccaaggagatcaacaagctggagctgaagatcagcgacttcctggacgagaacgaggccctgagagagagagtgggcctggagcccaagaccatgatcgacctgaccgagttcagaaacagcaagcacctgaagcagcagcagtacagagccgagaaccagatcctgctgaaggagatcgagagcctggaggaggagagactggacctgaagaagaagatcagacagatggcccaggagagaggcaagagaagcgccaccagcggcctgaccaccgaggacctgaacctgaccgagaacatcagccagggcgacagaatcagcgagagaaagctggacctgctgagcctgaagaacatgagcgaggcccagagcaagaacgagttcctgagcagagagctgatcgagaaggagagagacctggagagaagcagaaccgtgatcgccaagttccagaacaagctgaaggagctggtggaggagaacaagcagctggaggagggcatgaaggagatcctgcaggccatcaaggagatgcagaaggaccccgacgtgaagggcggcgagaccagcctgatcatccccagcctggagagactggtgaacgccatcgagagcaagaacgccgagggcatcttcgacgccagcctgcacctgaaggcccaggtggaccagctgaccggcagaaacgaggagctgagacaggagctgagagagagcagaaaggaggccatcaactacagccagcagctggccaaggccaacctgaagatcgaccacctggagaaggagaccagcctgctgagacagagcgagggcagcaacgtggtgttcaagggcatcgacctgcccgacggcatcgcccccagcagcgccagcatcatcaacagccagaacgagtacctgatccacctgctgcaggagctggagaacaaggagaaggtgaaggagttcagaagattcagctag

SEQ ID NO: 76283 - DNA, 1650 bp, Artificial Sequence
  Description of Artificial Sequence: Synthetic coding sequence
aagatggcccagcagagcgccggcggcagagacaccagattcctgagaaacgagatctgccagctggagaagcagctggagcagaaggacagagagctggaggacatggagaaggagctggagaaggagaagaaggtgaacgagcagctggccctgagaaacgaggaggccgagaacgagaacagcaagctgagaagagagaacaagagactgaagaagaagaacgagcagctgtgccaggacatcatcgactaccagaagcagatcgacagccagaaggagaccctgctgagcagaagaggcgaggacagcgactacagaagccagctgagcaagaagaactacgagctgatccagtacctggacgagatccagaccctgaccgaggccaacgagaagatcgaggtgcagaaccaggagatgagaaagaacctggaggagagcgtgcaggagatggagaagatgaccgacgagtacaacagaatgaaggccatcgtgcaccagaccgacaacgtgatcgaccagctgaagaaggagaacgaccactaccagctgcaggtgcaggagctgaccgacctgctgaagagcaagaacgaggaggacgaccccatcatggtggccgtgaacgccaaggtggaggagtggaagctgatcctgagcagcaaggacgacgagatcatcgagtaccagcagatgctgcacaacctgagagagaagctgaagaacgcccagctggacgccgacaagagcaacgtgatggccctgcagcagggcatccaggagagagacagccagatcaagatgctgaccgagcaggtggagcagtacaccaaggagatggagaagaacacctgcatcatcgaggacctgaagaacgagctgcagagaaacaagggcgccagcaccctgagccagcagacccacatgaagatccagagcaccctggacatcctgaaggagaagaccaaggaggccgagagaaccgccgagctggccgaggccgacgccagagagaaggacaaggagctggtggaggccctgaagagactgaaggactacgagagcggcgtgtacggcctggaggacgccgtggtggagatcaagaactgcaagaaccagatcaagatcagagacagagagatcgagatcctgaccaaggagatcaacaagctggagctgaagatcagcgacttcctggacgagaacgaggccctgagagagagagtgggcctggagcccaagaccatgatcgacctgaccgagttcagaaacagcaagcacctgaagcagcagcagtacagagccgagaaccagatcctgctgaaggagatcgagagcctggaggaggagagactggacctgaagaagaagatcagacagatggcccaggagagaggcaagagaagcgccaccagcggcctgaccaccgaggacctgaacctgaccgagaacatcagccagggcgacagaatcagcgagagaaagctggacctgctgagcctgaagaacatgagcgaggcccagagcaagaacgagttcctgagcagagagctgatcgagaaggagagagacctggagagaagcagaaccgtgatcgccaagttccagaacaagtgctacagaatcaaggagtgcagaagaaacctgtag

SEQ ID NO: 76284 - DNA, 4620 bp, Artificial Sequence; identical to SEQ ID NO: 76281
  Description of Artificial Sequence: Synthetic coding sequence

SEQ ID NO: 76285 - DNA, 7440 bp, Artificial Sequence
  Description of Artificial Sequence: Synthetic coding sequence
atgccccccaacatcaactggaaggagatcatgaaggtggaccccgacgacctgcccagacaggaggagctggccgacaacctgctgatcagcctgagcaaggtggaggtgaacgagctgaagagcgagaagcaggagaacgtgatccacctgttcagaatcacccagagcctgatgaagatgaaggcccaggaggtggagctggccctggaggaggtggagaaggccggcgaggagcaggccaagttcgagaaccagctgaagaccaaggtgatgaagctggagaacgagctggagatggcccagcagagcgccggcggcagagacaccagattcctgagaaacgagatctgccagctggagaagcagctggagcagaaggacagagagctggaggacatggagaaggagctggagaaggagaagaaggtgaacgagcagctggccctgagaaacgaggaggccgagaacgagaacagcaagctgagaagagagaacaagagactgaagaagaagaacgagcagctgtgccaggacatcatcgactaccagaagcagatcgacagccagaaggagaccctgctgagcagaagaggcgaggacagcgactacagaagccagctgagcaagaagaactacgagctgatccagtacctggacgagatccagaccctgaccgaggccaacgagaagatcgaggtgcagaaccaggagatgagaaagaacctggaggagagcgtgcaggagatggagaagatgaccgacgagtacaacagaatgaaggccatcgtgcaccagaccgacaacgtgatcgaccagctgaagaaggagaacgaccactaccagctgcaggtgcaggagctgaccgacctgctgaagagcaagaacgaggaggacgaccccatcatggtggccgtgaacgccaaggtggaggagtggaagctgatcctgagcagcaaggacgacgagatcatcgagtaccagcagatgctgcacaacctgagagagaagctgaagaacgcccagctggacgccgacaagagcaacgtgatggccctgcagcagggcatccaggagagagacagccagatcaagatgctgaccgagcaggtggagcagtacaccaaggagatggagaagaacacctgcatcatcgaggacctgaagaacgagctgcagagaaacaagggcgccagcaccctgagccagcagacccacatgaagatccagagcaccctggacatcctgaaggagaagaccaaggaggccgagagaaccgccgagctggccgaggccgacgccagagagaaggacaaggagctggtggaggccctgaagagactgaaggactacgagagcggcgtgtacggcctggaggacgccgtggtggagatcaagaactgcaagaaccagatcaagatcagagacagagagatcgagatcctgaccaaggagatcaacaagctggagctgaagatcagcgacttcctggacgagaacgaggccctgagagagagagtgggcctggagcccaagaccatgatcgacctgaccgagttcagaaacagcaagcacctgaagcagcagcagtacagagccgagaaccagatcctgctgaaggagatcgagagcctggaggaggagagactggacctgaagaagaagatcagacagatggcccaggagagaggcaagagaagcgccaccagcggcctgaccaccgaggacctgaacctgaccgagaacatcagccagggcgacagaatcagcgagagaaagctggacctgctgagcctgaagaacatgagcgaggcccagagcaagaacgagttcctgagcagagagctgatcgagaaggagagagacctggagagaagcagaaccgtgatcgccaagttccagaacaagctgaaggagctggtggaggagaacaagcagctggaggagggcatgaaggagatcctgcaggccatcaaggagatgcagaaggaccccgacgtgaagggcggcgagaccagcctgatcatccccagcctggagagactggtgaacgccatcgagagcaagaacgccgagggcatcttcgacgccagcctgcacctgaaggcccaggtggaccagctgaccggcagaaacgaggagctgagacaggagctgagagagagcagaaaggaggccatcaactacagccagcagctggccaaggccaacctgaagatcgaccacctggagaaggagaccagcctgctgagacagagcgagggcagcaacgtggtgttcaagggcatcgacctgcccgacggcatcgcccccagcagcgccagcatcatcaacagccagaacgagtacctgatccacctgctgcaggagctggagaacaaggagaagaagctgaagaacctggaggacagcctggaggactacaacagaaagttcgccgtgatcagacaccagcagagcctgctgtacaaggagtacctgagcgagaaggagacctggaagaccgagagcaagaccatcaaggaggagaagagaaagctggaggaccaggtgcagcaggacgccatcaaggtgaaggagtacaacaacctgctgaacgccctgcagatggacagcgacgagatgaagaagatcctggccgagaacagcagaaagatcaccgtgctgcaggtgaacgagaagagcctgatcagacagtacaccaccctggtggagctggagagacagctgagaaaggagaacgagaagcagaagaacgagctgctgagcatggaggccgaggtgtgcgagaagatcggctgcctgcagagattcaaggagatggccatcttcaagatcgccgccctgcagaaggtggtggacaacagcgtgagcctgagcgagctggagctggccaacaagcagtacaacgagctgaccgccaagtacagagacatcctgcagaaggacaacatgctggtgcagagaaccagcaacctggagcacctggagtgcgagaacatcagcctgaaggagcaggtggagagcatcaacaaggagctggagatcaccaaggagaagctgcacaccatcgagcaggcctgggagcaggagaccaagctgggcaacgagagcagcatggacaaggccaagaagagcatcaccaacagcgacatcgtgagcatcagcaagaagatcaccatgctggagatgaaggagctgaacgagagacagagagccgagcactgccagaagatgtacgagcacctgagaaccagcctgaagcagatggaggagagaaacttcgagctggagaccaagttcgccgagctgaccaagatcaacctggacgcccagaaggtggagcagatgctgagagacgagctggccgacagcgtgagcaaggccgtgagcgacgccgacagacagagaatcctggagctggagaagaacgagatggagctgaaggtggaggtgagcaagctgagagagatcagcgacatcgccagaagacaggtggagatcctgaacgcccagcagcagagcagagacaaggaggtggagagcctgagaatgcagctgctggactaccaggcccagagcgacgagaagagcctgatcgccaagctgcaccagcacaacgtgagcctgcagctgagcgaggccaccgccctgggcaagctggagagcatcaccagcaagctgcagaagatggaggcctacaacctgagactggagcagaagctggacgagaaggagcaggccctgtactacgccagactggagggcagaaacagagccaagcacctgagacagaccatccagagcctgagaagacagttcagcggcgccctgcccctggcccagcaggagaagttcagcaagaccatgatccagctgcagaacgacaagctgaagatcatgcaggagatgaagaacagccagcaggagcacagaaacatggagaacaagaccctggagatggagctgaagctgaagggcctggaggagctgatcagcaccctgaaggacaccaagggcgcccagaaggtgatcaactggcacatgaagatcgaggagctgagactgcaggagctgaagctgaacagagagctggtgaaggacaaggaggagatcaagtacctgaacaacatcatcagcgagtacgagagaaccatcagcagcctggaggaggagatcgtgcagcagaacaagttccacgaggagagacagatggcctgggaccagagagaggtggacctggagagacagctggacatcttcgacagacagcagaacgagatcctgaacgccgcccagaagttcgaggaggccaccggcagcatccccgaccccagcctgcccctgcccaaccagctggagatcgccctgagaaagatcaaggagaacatcagaatcatcctggagaccagagccacctgcaagagcctggaggagaagctgaaggagaaggagagcgccctgagactggccgagcagaacatcctgagcagagacaaggtgatcaacgagctgagactgagactgcccgccaccgccgagagagagaagctgatcgccgagctgggcagaaaggagatggagcccaagagccaccacaccctgaagatcgcccaccagaccatcgccaacatgcaggccagactgaaccagaaggaggaggtgctgaagaagtaccagagactgctggagaaggccagagaggagcagagagagatcgtgaagaagcacgaggaggacctgcacatcctgcaccacagactggagctgcaggccgacagcagcctgaacaagttcaagcagaccgcctgggacctgatgaagcagagccccacccccgtgcccaccaacaagcacttcatcagactggccgagatggagcagaccgtggccgagcaggacgacagcctgagcagcctgctggtgaagctgaagaaggtgagccaggacctggagagacagagagagatcaccgagctgaaggtgaaggagttcgagaacatcaagctgcagctgcaggagaaccacgaggacgaggtgaagaaggtgaaggccgaggtggaggacctgaagtacctgctggaccagagccagaaggagagccagtgcctgaagagcgagctgcaggcccagaaggaggccaacagcagagcccccaccaccaccatgagaaacctggtggagagactgaagagccagctggccctgaaggagaagcagcagaaggccctgagcagagccctgctggagctgagagccgagatgaccgccgccgccgaggagagaatcatcagcgccaccagccagaaggaggcccacctgaacgtgcagcagatcgtggacagacacaccagagagctgaagacccaggtggaggacctgaacgagaacctgctgaagctgaaggaggccctgaagaccagcaagaacagagagaacagcctgaccgacaacctgaacgacctgaacaacgagctgcagaagaagcagaaggcctacaacaagatcctgagagagaaggaggagatcgaccaggagaacgacgagctgaagagacagatcaagagactgaccagcggcctgcagggcaagcccctgaccgacaacaagcagagcctgatcgaggagctgcagagaaaggtgaagaagctggagaaccagctggagggcaaggtggaggaggtggacctgaagcccatgaaggagaagaacgccaaggaggagctgatcagatgggaggagggcaagaagtggcaggccaagatcgagggcatcagaaacaagctgaaggagaaggagggcgaggtgttcaccctgaccaagcagctgaacaccctgaaggacctgttcgccaaggccgacaaggagaagctgaccctgcagagaaagctgaagaccaccggcatgaccgtggaccaggtgctgggcatcagagccctggagagcgagaaggagctggaggagctgaagaagagaaacctggacctggagaacgacatcctgtacatgagagcccaccaggccctgcccagagacagcgtggtggaggacctgcacctgcagaacagatacctgcaggagaagctgcacgccctggagaagcagttcagcaaggacacctacagcaagcccagcatcagcggcatcgagagcgacgaccactgccagagagagcaggagctgcagaaggagaacctgaagctgagcagcgagaacatcgagctgaagttccagctggagcaggccaacaaggacctgcccagactgaagaaccaggtgagagacctgaaggagatgtgcgagttcctgaagaaggagaaggccgaggtgcagagaaagctgggccacgtgagaggcagcggcagaagcggcaagaccatccccgagctggagaagaccatcggcctgatgaagaaggtggtggagaaggtgcagagagagaacgagcagctgaagaaggccagcggcatcctgaccagcgagaagatggccaacatcgagcaggagaacgagaagctgaaggccgagctggagaagctgaaggcccacctgggccaccagctgagcatgcactacgagagcaagaccaagggcaccgagaagatcatcgccgagaacgagagactgagaaaggagctgaagaaggagaccgacgccgccgagaagctgagaatcgccaagaacaacctggagatcctgaacgagaagatgaccgtgcagctggaggagaccggcaagagactgcagttcgccgagagcagaggcccccagctggagggcgccgacagcaagagctggaagagcatcgtggtgaccagaatgtacgagaccaagctgaaggagctggagaccgacatcgccaagaagaaccagagcatcaccgacctgaagcagctggtgaaggaggccaccgagagagagcagaaggtgaacaagtacaacgaggacctggagcagcagatcaagatcctgaagcacgtgcccgagggcgccgagaccgagcagggcctgaagagagagctgcaggtgctgagactggccaaccaccagctggacaaggagaaggccgagctgatccaccagatcgaggccaacaaggaccagagcggcgccgagagcaccatccccgacgccgaccagctgaaggagaagatcaaggacctggagacccagctgaagatgagcgacctggagaagcagcacctgaaggaggagatcaagaagctgaagaaggagctggagaacttcgaccccagcttcttcgaggagatcgaggacctgaagtacaactacaaggaggaggtgaagaagaacatcctgctggaggagaaggtgaagaagctgagcgagcagctgggcgtggagctgaccagccccgtggccgccagcgaggagttcgaggacgaggaggagagccccgtgaacttccccatctactag

SEQ ID NO: 76286 - DNA, 1512 bp, Artificial Sequence
  Description of Artificial Sequence: Synthetic coding sequence
atggaggagcacggcgtgacccagaccgagcacatggccaccatcgaggcccacgccgtggcccagcaggtgcagcaggtgcacgtggccacctacaccgagcacagcatgctgagcgccgacgaggacagccccagcagccccgaggacaccagctacgacgacagcgacatcctgaacagcaccgccgccgacgaggtgaccgcccacctggccgccgccggccccgtgggcatggccgccgccgccgccgtggccaccggcaagaagagaaagagaccccacgtgttcgagagcaaccccagcatcagaaagagacagcagaccagactgctgagaaagctgagagccaccctggacgagtacaccaccagagtgggccagcaggccatcgtgctgtgcatcagccccagcaagcccaaccccgtgttcaaggtgttcggcgccgcccccctggagaacgtggtgagaaagtacaagagcatgatcctggaggacctggagagcgccctggccgagcacgcccccgccccccaggaggtgaacagcgagctgccccccctgaccatcgacggcatccccgtgagcgtggacaagatgacccaggcccagctgagagccttcatccccgagatgctgaagtacagcaccggcagaggcaagcccggctggggcaaggagagctgcaagcccatctggtggcccgaggacatcccctgggccaacgtgagaagcgacgtgagaaccgaggagcagaagcagagagtgagctggacccaggccctgagaaccatcgtgaagaactgctacaagcagcacggcagagaggacctgctgtacgccttcgaggaccagcagacccagacccaggccaccgccacccacagcatcgcccacctggtgcccagccagaccgtggtgcagaccttcagcaaccccgacggcaccgtgagcctgatccaggtgggcaccggcgccaccgtggccaccctggccgacgccagcgagctgcccaccaccgtgaccgtggcccaggtgaactacagcgccgtggccgacggcgaggtggagcagaactgggccaccctgcagggcggcgagatgaccatccagaccacccaggccagcgaggccacccaggccgtggccagcctggccgaggccgccgtggccgccagccaggagatgcagcagggcgccaccgtgaccatggccctgaacagcgaggccgccgcccacgccgtggccaccctggccgaggccaccctgcagggcggcggccagatcgtgctgagcggcgagaccgccgccgccgtgggcgccctgaccggcgtgcaggacgccaacggcctggtgcagatccccgtgagcatgtaccagaccgtggtgaccagcctggcccagggcaacggccccgtgcaggtggccatggcccccgtgaccaccagaatcagcgacagcgccgtgaccatggacggccaggccgtggaggtggtgaccctggagcagtag

SEQ ID NO: 76287 - DNA, 906 bp, Artificial Sequence
  Description of Artificial Sequence: Synthetic coding sequence
atgagcctgagaagacacatcggcaaccccgagtacctgatgaagagaatcccccagaaccccagataccagcacatcaagagcagactggacaccggcaacagcatgaccaagtacaccgagaagctggaggagatcaagaagaactacagatacaagaaggacgagctgttcaagagactgaaggtgaccaccttcgcccagctgatcatccaggtggccagcctgagcgaccagaccctggaggtgaccgccgaggagatccagagactggaggacaacgacagcgccgccagcgaccccgacgccgagaccaccgccagaaccaacggcaagggcaaccccggcgagcagagccccagccccgagcagttcatcaacaacgccggcgccggcgacagcagcagaagcaccctgcagagcgtgatcagcggcgtgggcgagctggacctggacaagggccccgtgaagaaggccgagccccacaccaaggacaagccctaccccgactgccccttcctgctgctggacgtgagagacagagacagctaccagcagtgccacatcgtgggcgcctacagctaccccatcgccaccctgagcagaaccatgaacccctacagcaacgacatcctggagtacaagaacgcccacggcaagatcatcatcctgtacgacgacgacgagagactggccagccaggccgccaccaccatgtgcgagagaggcttcgagaacctgttcatgctgagcggcggcagactgaaccaggccaacagcagcggcagagagagcaaggtgcccggcgccagaagcgcccagaacctgcccggcggcggccccgccagccacagcaaccccagaagcctgagcagcggccacctgcagggcaagccctggaagtag

SEQ ID NO: 76288 - DNA, 165 bp, Artificial Sequence
  Description of Artificial Sequence: Synthetic coding sequence
atgagcctgagaagacacatcggcaaccccgagtacctgatgaagagaatcccccagaaccccagataccagcacatcaagagcagactggacaccggcgcctgcgtgtacctgaccagcagccccgccctgcccgactgcgccatgaacggcctgtgcttctag

SEQ ID NO: 76289 - DNA, 858 bp, Artificial Sequence
  Description of Artificial Sequence: Synthetic coding sequence
atgagcctgagaagacacatcggcaaccccgagtacctgatgaagagaatcccccagaaccccagataccagcacatcaagagcagactggacaccgactacagatacaagaaggacgagctgttcaagagactgaaggtgaccaccttcgcccagctgatcatccaggtggccagcctgagcgaccagaccctggaggtgaccgccgaggagatccagagactggaggacaacgacagcgccgccagcgaccccgacgccgagaccaccgccagaaccaacggcaagggcaaccccggcgagcagagccccagccccgagcagttcatcaacaacgccggcgccggcgacagcagcagaagcaccctgcagagcgtgatcagcggcgtgggcgagctggacctggacaagggccccgtgaagaaggccgagccccacaccaaggacaagccctaccccgactgccccttcctgctgctggacgtgagagacagagacagctaccagcagtgccacatcgtgggcgcctacagctaccccatcgccaccctgagcagaaccatgaacccctacagcaacgacatcctggagtacaagaacgcccacggcaagatcatcatcctgtacgacgacgacgagagactggccagccaggccgccaccaccatgtgcgagagaggcttcgagaacctgttcatgctgagcggcggcagactgaaccaggccaacagcagcggcagagagagcaaggtgcccggcgccagaagcgcccagaacctgcccggcggcggccccgccagccacagcaaccccagaagcctgagcagcggccacctgcagggcaagccctggaagtag

SEQ ID NO: 76290 - DNA, 1200 bp, Artificial Sequence
  Description of Artificial Sequence: Synthetic coding sequence
atgagcagcagaagcaccaaggacctgatcaagagcaagtggggcagcaagcccagcaacagcaagagcgagaccaccctggagaagctgaagggcgagatcgcccacctgaagaccagcgtggacgagatcaccagcggcaagggcaagctgaccgacaaggagagacacagactgctggagaagatcagagtgctggaggccgagaaggagaagaacgcctaccagctgaccgagaaggacaaggagatccagagactgagagaccagctgaaggccagatacagcaccaccaccctgctggagcagctggaggagaccaccagagagggcgagagaagagagcaggtgctgaaggccctgagcgaggagaaggacgtgctgaagcagcagctgagcgccgccaccagcagaatcgccgagctggagagcaagaccaacaccctgagactgagccagaccgtggcccccaactgcttcaacagcagcatcaacaacatccacgagatggagatccagctgaaggacgccctggagaagaaccagcagtggctggtgtacgaccagcagagagaggtgtacgtgaagggcctgctggccaagatcttcgagctggagaagaagaccgagaccgccgcccacagcctgccccagcagaccaagaagcccgagagcgagggctacctgcaggaggagaagcagaagtgctacaacgacctgctggccagcgccaagaaggacctggaggtggagagacagaccatcacccagctgagcttcgagctgagcgagttcagaagaaagtacgaggagacccagaaggaggtgcacaacctgaaccagctgctgtacagccagagaagagccgacgtgcagcacctggaggacgacagacacaagaccgagaagatccagaagctgagagaggagaacgacatcgccagaggcaagctggaggaggagaagaagagaagcgaggagctgctgagccaggtgcagttcctgtacaccagcctgctgaagcagcaggaggagcagaccagagtggccctgctggagcagcagatgcaggcctgcaccctggacttcgagaacgagaagctggacagacagcacgtgcagcaccagctgcacgtgatcctgaaggagctgagaaaggccagaaacaacaccgtgggcatcctggacaccaagagctag

SEQ ID NO: 76291 - DNA, 1395 bp, Artificial Sequence
  Description of Artificial Sequence: Synthetic coding sequence
atgagcagcagaagcaccaaggacctgatcaagagcaagtggggcagcaagcccagcaacagcaagagcgagaccaccctggagaagctgaagggcgagatcgcccacctgaagaccagcgtggacgagatcaccagcggcaagggcaagctgaccgacaaggagagacacagactgctggagaagatcagagtgctggaggccgagaaggagaagaacgcctaccagctgaccgagaaggacaaggagatccagagactgagagaccagctgaaggccagatacagcaccaccaccctgctggagcagctggaggagaccaccagagagggcgagagaagagagcaggtgctgaaggccctgagcgaggagaaggacgtgctgaagcagcagctgagcgccgccaccagcagaatcgccgagctggagagcaagaccaacaccctgagactgagccagaccgtggcccccaactgcttcaacagcagcatcaacaacatccacgagatggagatccagctgaaggacgccctggagaagaaccagcagtggctggtgtacgaccagcagagagaggtgtacgtgaagggcctgctggccaagatcttcgagctggagaagaagaccgagaccgccgcccacagcctgccccagcagaccaagaagcccgagagcgagggctacctgcaggaggagaagcagaagtgctacaacgacctgctggccagcgccaagaaggacctggaggtggagagacagaccatcacccagctgagcttcgagctgagcgagttcagaagaaagtacgaggagacccagaaggaggtgcacaacctgaaccagctgctgtacagccagagaagagccgacgtgcagcacctggaggacgacagacacaagaccgagaagatccagaagctgagagaggagaacgacatcgccagaggcaagctggaggaggagaagaagagaagcgaggagctgctgagccaggtgcagttcctgtacaccagcctgctgaagcagcaggaggagcagaccagagtggccctgctggagcagcagatgcaggcctgcaccctggacttcgagaacgagaagctggacagacagcacgtgcagcaccagctgcacgtgatcctgaaggagctgagaaaggccagaaaccagatcacccagctggagagcctgaagcagctgcacgagttcgccatcaccgagcccctggtgaccttccagggcgagaccgagaacagagagaaggtggccgccagccccaagagccccaccgccgccctgaacgagagcctggtggagtgccccaagtgcaacatccagtaccccgccaccgagcacagagacctgctggtgcacgtggagtactgcagcaagtag

SEQ ID NO: 76292 - DNA, 627 bp, Artificial Sequence
  Description of Artificial Sequence: Synthetic coding sequence
tgaagcagcatcaacaacatccacgagatggagatccagctgaaggacgccctggagaagaaccagcagtggctggtgtacgaccagcagagagaggtgtacgtgaagggcctgctggccaagatcttcgagctggagaagaagaccgagaccgccgcccacagcctgccccagcagaccaagaagcccgagagcgagggctacctgcaggaggagaagcagaagtgctacaacgacctgctggccagcgccaagaaggacctggaggtggagagacagaccatcacccagctgagcttcgagctgagcgagttcagaagaaagtacgaggagacccagaaggaggtgcacaacctgaaccagctgctgtacagccagagaagagccgacgtgcagcacctggaggacgacagacacaagaccgagaagatccagaagctgagagaggagaacgacatcgccagaggcaagctggaggaggagaagaagagaagcgaggagctgctgagccaggtgcagttcctgtacaccagcctgctgaagcagcaggaggagcagaccagagtggccctgctggagcagcaggtgctgatcagagtggccagcaagttcaacagcgcctgctag

SEQ ID NO: 76293 - DNA, 1425 bp, Artificial Sequence
  Description of Artificial Sequence: Synthetic coding sequence
atggccgccgccagcgtgagcgccgccagcggcagccacctgagcaacagcttcgccgagcccagcagaagcaacggcagcatggtgagacacagcagcagcccctacgtggtgtaccccagcgacaagcccttcctgaacagcgacctgagaagaagccccagcaagcccaccctggcctaccccgagagcaacagcagagccatcttcagcgccctgaagaacctgcaggacaagatcagaagactggagctggagagaatccaggccgaggagagcgtgaagaccctgagcagagagaccatcgagtacaagaaggtgctggacgagcagatccaggagagagagaacagcaagaacgaggagagcaagcacaaccaggagctgaccagccagctgctggccgccgagaacaagtgcaacctgctggagaagcagctggagtacatgagaaacatgatcaagcacgccgagatggagagaaccagcgtgctggagaagcaggtgagcctggagagagagagacagcacgaccagacccacgtgcagagccagctggagaagctggacctgctggagcaggagtacaacaagctgaccaccatgcaggccctggccgagaagaagatgcaggagctggaggccaagctgcacgaggaggagcaggagagaaagagaatgcaggccaaggccgccgagctgcagaccggcctggagaccaacagactgatcttcgaggacaaggccaccccctgcgtgcccaacgccagaagaatcaagaagaagaagagcaagccccccgagaagagcaccagccccagccacgccgtggtggccaacgtgcagctggtgctgcacctgatgaagcagcacagcaaggccctgtgcaacgacagagtgatcaacagcatccccctggccaagcaggtgagcagcagaggcggcaagagcaagaagctgagcgtgaccccccccagcagcaacggcatcaacgaggagctgagcgaggtgctgcagaccctgcaggacgagttcggccagatgagcttcgaccaccagcagctggccaagctgatccaggagagccccaccgtggagctgaaggacaagctggagtgcgagctggaggccctggtgggcagaatggaggccaaggccaaccagatcaccaaggtgagaaagtaccaggcccagctggagaagcagaagctggagaagcagaagaaggagctgaaggccaccaagaagaccctggacgaggagagaaacagcagcagcagaagcggcatcaccggcaccaccaacaagaaggacttcatgaagctgagacccggcgagaagagaagaaagaacctgcagctgctgaaggacatgcagagcatccagaacagcctgcagagcagcagcctgtgctgggactactag

SEQ ID NO: 76294 - DNA, 1503 bp, Artificial Sequence
  Description of Artificial Sequence: Synthetic coding sequence
atggccgccgccagcgtgagcgccgccagcggcagccacctgagcaacagcttcgccgagcccagcagaagcaacggcagcatggtgagacacagcagcagcccctacgtggtgtaccccagcgacaagcccttcctgaacagcgacctgagaagaagccccagcaagcccaccctggcctaccccgagagcaacagcagagccatcttcagcgccctgaagaacctgcaggacaagatcagaagactggagctggagagaatccaggccgaggagagcgtgaagaccctgagcagagagaccatcgagtacaagaaggtgctggacgagcagatccaggagagagagaacagcaagaacgaggagagcaagcacaaccaggagctgaccagccagctgctggccgccgagaacaagtgcaacctgctggagaagcagctggagtacatgagaaacatgatcaagcacgccgagatggagagaaccagcgtgctggagaagcaggtgagcctggagagagagagacagcacgaccagacccacgtgcagagccagctggagaagctggacctgctggagcaggagtacaacaagctgaccaccatgcaggccctggccgagaagaagatgcaggagctggaggccaagctgcacgaggaggagcaggagagaaagagaatgcaggccaaggccgccgagctgcagaccggcctggagaccaacagactgatcttcgaggacaaggccaccccctgcgtgcccaacgccagaagaatcaagaagaagaagagcaagccccccgagaagaagagcagcagaaactacttcggcgcccagccccactacagactgtgcctgggcgacatgcccttcgtggccggcaagagcaccagccccagccacgccgtggtggccaacgtgcagctggtgctgcacctgatgaagcagcacagcaaggccctgtgcaacgacagagtgatcaacagcatccccctggccaagcaggtgagcagcagaggcggcaagagcaagaagctgagcgtgaccccccccagcagcaacggcatcaacgaggagctgagcgaggtgctgcagaccctgcaggacgagttcggccagatgagcttcgaccaccagcagctggccaagctgatccaggagagccccaccgtggagctgaaggacaagctggagtgcgagctggaggccctggtgggcagaatggaggccaaggccaaccagatcaccaaggtgagaaagtaccaggcccagctggagaagcagaagctggagaagcagaagaaggagctgaaggccaccaagaagaccctggacgaggagagaaacagcagcagcagaagcggcatcaccggcaccaccaacaagaaggacttcatgaagctgagacccggcgagaagagaagaaagaacctgcagctgctgaaggacatgcagagcatccagaacagcctgcagagcagcagcctgtgctgggactactag

SEQ ID NO: 76295 - DNA, 813 bp, Artificial Sequence
  Description of Artificial Sequence: Synthetic coding sequence
atggccgccgccagcgtgagcgccgccagcggcagccacctgagcaacagcttcgccgagcccagcagaagcaacggcagcatggtgagacacagcagcagcccctacgtggtgtaccccagcgacaagcccttcctgaacagcgacctgagaagaagccccagcaagcccaccctggcctaccccgagagcaacagcagagccatcttcagcgccctgaagaacctgcaggacaagatcagaagactggagctggagagaatccaggccgaggagagcgtgaagaccctgagcagagagaccatcgagtacaagaaggtgctggacgagcagatccaggagagagagaacagcaagaacgaggagagcaagcacaaccaggagctgaccagccagctgctggccgccgagaacaagtgcaacctgctggagaagcagctggagtacatgagaaacatgatcaagcacgccgagatggagagaaccagcgtgctggagaagcaggtgagcctggagagagagagacagcacgaccagacccacgtgcagagccagctggagaagctggacctgctggagcaggagtacaacaagctgaccaccatgcaggccctggccgagaagaagatgcaggagctggaggccaagctgcacgaggaggagcaggagagaaagagaatgcaggccaaggccgccgagctgcagaccggcctggagaccaacagactgatcttcgaggacaaggccaccccctgcgtgcccaacgccagaagaatcaagaagaagaagagcaagccccccgagaaggtgtag

SEQ ID NO: 76296 - DNA, 1476 bp, Artificial Sequence
  Description of Artificial Sequence: Synthetic coding sequence
atgctgaccagaatcgacaacagcttcgccgagcccagcagaagcaacggcagcatggtgagacacagcagcagcccctacgtggtgtaccccagcgacaagcccttcctgaacagcgacctgagaagaagccccagcaagcccaccctggcctaccccgagagcaacagcagagccatcttcagcgccctgaagaacctgcaggacaagatcagaagactggagctggagagaatccaggccgaggagagcgtgaagaccctgagcagagagaccatcgagtacaagaaggtgctggacgagcagatccaggagagagagaacagcaagaacgaggagagcaagcacaaccaggagctgaccagccagctgctggccgccgagaacaagtgcaacctgctggagaagcagctggagtacatgagaaacatgatcaagcacgccgagatggagagaaccagcgtgctggagaagcaggtgagcctggagagagagagacagcacgaccagacccacgtgcagagccagctggagaagctggacctgctggagcaggagtacaacaagctgaccaccatgcaggccctggccgagaagaagatgcaggagctggaggccaagctgcacgaggaggagcaggagagaaagagaatgcaggccaaggccgccgagctgcagaccggcctggagaccaacagactgatcttcgaggacaaggccaccccctgcgtgcccaacgccagaagaatcaagaagaagaagagcaagccccccgagaagaagagcagcagaaactacttcggcgcccagccccactacagactgtgcctgggcgacatgcccttcgtggccggcaagagcaccagccccagccacgccgtggtggccaacgtgcagctggtgctgcacctgatgaagcagcacagcaaggccctgtgcaacgacagagtgatcaacagcatccccctggccaagcaggtgagcagcagaggcggcaagagcaagaagctgagcgtgaccccccccagcagcaacggcatcaacgaggagctgagcgaggtgctgcagaccctgcaggacgagttcggccagatgagcttcgaccaccagcagctggccaagctgatccaggagagccccaccgtggagctgaaggacaagctggagtgcgagctggaggccctggtgggcagaatggaggccaaggccaaccagatcaccaaggtgagaaagtaccaggcccagctggagaagcagaagctggagaagcagaagaaggagctgaaggccaccaagaagaccctggacgaggagagaaacagcagcagcagaagcggcatcaccggcaccaccaacaagaaggacttcatgaagctgagacccggcgagaagagaagaaagaacctgcagctgctgaaggacatgcagagcatccagaacagcctgcagagcagcagcctgtgctgggactactag

SEQ ID NO: 76297 - DNA, 1794 bp, Artificial Sequence
  Description of Artificial Sequence: Synthetic coding sequence
atgttccccgtggcccccaagccccaggacagcagccagcccagcgacagactgatgaccgagaagcagcaggaggaggccgagtgggagagcatcaacgtgctgctgatgatgcacggcctgaagcccctgagcctggtgaagagaaccgacctgaaggacctgatcatcttcgacaagcagagcagccagagaatgagacagaacctgaagctgctggtggaggagaccagctgccagcagaacatgatccaggagctgatcgagaccaaccagcagctgagaaacgagctgcagctggagcagagcagagccgccaaccaggagcagagagccaacgacctggagcagatcatggagagcgtgaagagcaagatcggcgagctggaggacgagagcctgagcagagcctgccaccagcagaacaagatcaaggacctgcagaaggagcagaagaccctgcaggtgaagtgccagcactacaagaagaagagaaccgagcaggaggagaccatcgccagcctgcagatggaggtgtgcagactgaagaaggaggaggaggacagaatcgtgacccagaacagagtgttcgcctacctgtgcaagagagtgccccacaccgtgctggacagacagctgctgtgcctgatcgactactacgagagcaagatcagaaagatccacacccagagacagtacaaggaggacgagagccagagcgaggaggagaacgactacagaaacctggacgccagccccacctacaagggcctgctgatgagcctgcagaaccagctgaaggagagcaagagcaagatcgacgccctgagcagcgagaagctgaacctgcagaaggacctggagaccagacccacccagcacgagctgagactgtacaagcagcaggtgaagaagctggagaaggccctgaagaagaacgtgaagctgcaggagctgatcaaccacaagaaggccgaggacaccgagaagaaggacgagcccagcaagtacaaccagcagcaggccctgatcgaccagagatacttccaggtgctgtgcagcatcaacagcatcatccacaaccccagagcccccgtgatcatctacaagcagaccaagggcggcgtgcagaacttcaacaaggacctggtgcaggactgcggcttcgagcacctggtgcccgtgatcgagatgtgggccgaccagctgaccagcctgaaggacctgtacaagagcctgaagaccctgagcgccgagctggtgccctggctgaacctgaagaagcaggacgagaacgagggcatcaaggtggaggacctgctgttcatcgtggacaccatgctggaggaggtggagaacaaggagaaggacagcaacatgccccacttccagaccctgcaggccatcgtgagccacttccagaagctgttcgacgtgcccagcctgaacggcgtgtaccccagaatgaacgaggtgtacaccagactgggcgagatgaacaacgccgtgagaaacctgcaggagctgctggagctggacagcagcagcagcctgtgcgtgctggtgagcaccgtgggcaagctgtgcagactgatcaacgaggacgtgaacgagcaggtgatgcaggtgctgggccccgaggacctgcagagcatcatctacaagctggaggagcacgaggagttcttccccgccttccaggccttcaccaacgacctgctggagatcctggagatcgacgacctggacgccatcgtgcccgccgtgaagaagctgaaggtgctgagctactag

SEQ ID NO: 76298 - DNA, 639 bp, Artificial Sequence
  Description of Artificial Sequence: Synthetic coding sequence
atgttccccgtggcccccaagccccaggacagcagccagcccagcgacagactgatgaccgagaagcagcaggaggaggccgagtgggagagcatcaacgtgctgctgatgatgcacggcctgaagcccctgagcctggtgaagagaaccgacctgaaggacctgatcatcttcgacaagcagagcagccagagaatgagacagaacctgaagctgctggtggaggagaccagctgccagcagaacatgatccaggagctgatcgagaccaaccagcagctgagaaacgagctgcagctggagcagagcagagccgccaaccaggagcagagagccaacgacctggagcagatcatggagagcgtgaagagcaagatcggcgagctggaggacgagagcctgagcagagcctgccaccagcagaacaagatcaaggacctgcagaaggagcagaagaccctgcaggtgaagtgccagcactacaagaagaagagaaccgagcaggaggagaccatcgccagcctgcagatggaggtgtgcagactgaagaaggaggaggaggacagaatcgtgacccagaacagagtgttcgcctacctgtgcaagagagtgccccacaccgtgctggacagacagtag

SEQ ID NO: 76299 - DNA, 351 bp, Artificial Sequence
  Description of Artificial Sequence: Synthetic coding sequence
atgttccccgtggcccccaagccccaggacagcagccagcccagcgacagactgatgaccgagaagcagcaggaggaggccgagtgggagagcatcaacgtgctgctgatgatgcacggcctgaagcccctgagcctggtgaagagaaccgacctgaaggacctgatcatcttcgacaagcagagcagccagagaatgagacagaacctgaagctgctggtggaggagaccagctgccagcagaacatgatccaggagctgatcgagaccaaccagcagctgagaaacgagctgcagctggagcagagcagagccgccaaccaggagcagagagccaacgacctggagtag

SEQ ID NO: 76300 - DNA, 1665 bp, Artificial Sequence
  Description of Artificial Sequence: Synthetic coding sequence
atgttccccgtggcccccaagccccaggacagcagccagcccagcgacagactgatgaccgagaagcagcaggaggaggccgagtgggagagcatcaacgtgctgctgatgatgcacggcctgaagcccctgagcctggtgaagagaaccgacctgaaggacctgatcatcttcgacaagcagagcagccagagaatgagacagaacctgaagctgctggtggaggagaccagctgccagcagaacatgatccaggagctgatcgagaccaaccagcagctgagaaacgagctgcagctggagcagagcagagccgccaaccaggagcagagagccaacgacctggagcagatcatggagagcgtgaagagcaagatcggcgagctggaggacgagagcctgagcagagcctgccaccagcagaacaagatcaaggacctgcagaaggagcagaagaccctgcaggtgaagtgccagcactacaagaagaagagaaccgagcaggaggagaccatcgccagcctgcagatggaggtgtgcagactgaagaaggaggaggaggacagaatcgtgacccagaacagagtgttcgcctacctgtgcaagagagtgccccacaccgtgctggacagacagctgctgtgcctgatcgactactacgagagcaagatcagaaagatccacacccagagacagtacaaggaggacgagagccagagcgaggaggagaacgactacagaaacctggacgccagccccacctacaagggcctgctgatgagcctgcagaaccagctgaaggagagcaagagcaagatcgacgccctgagcagcgagaagctgaacctgcagaaggacctggagaccagacccacccagcacgagctgagactgtacaagcagcaggtgaagaagctggagaaggccctgaagaagaacgtgaagctgcaggagctgatcaaccacaagaaggccgaggacaccgagaagaaggacgagcccagcaagtacaaccagcagcaggccctgatcgaccagagatacttccaggtgctgtgcagcatcaacagcatcatccacaaccccagagcccccgtgatcatctacaagcagaccaagggcggcgtgcagaacttcaacaaggacctggtgcaggactgcggcttcgagcacctggtgcccgtgatcgagatgtgggccgaccagctgaccagcctgaaggacctgtacaagagcctgaagaccctgagcgccgagctggtgccctggctgaacctgaagaagcaggacgagaacgagggcatcaaggtggaggacctgctgttcatcgtggacaccatgctggaggaggtggagaacaaggagaaggacagcaacatgccccacttccagaccctgcaggccatcgtgagccacttccagaagctgttcgacgtgcccagcctgaacggcgtgtaccccagaatgaacgaggtgtacaccagactgggcgagatgaacaacgccgtgagaaacctgcaggagctgctggagctggacagcagcagcagcctgtgcgtgctggtgagcaccgtgggcaagctgtgcagactgatcaacgaggacgtgaacgagcaggtgatgcaggtgctgggccccgaggacctgcagagatacctgttctag

SEQ ID NO: 76301 - DNA, 1794 bp, Artificial Sequence; identical to SEQ ID NO: 76297
  Description of Artificial Sequence: Synthetic coding sequence

SEQ ID NO: 76302 - DNA, 72 bp, Artificial Sequence
  Description of Artificial Sequence: Synthetic coding sequence
atgttccccgtggcccccaagccccaggacagcagccagcccagcgacagactgatgaccgagaagcagtag

SEQ ID NO: 76303 - DNA, 1734 bp, Artificial Sequence
  Description of Artificial Sequence: Synthetic coding sequence
atgaccgagcaggaggaggccgagtgggagagcatcaacgtgctgctgatgatgcacggcctgaagcccctgagcctggtgaagagaaccgacctgaaggacctgatcatcttcgacaagcagagcagccagagaatgagacagaacctgaagctgctggtggaggagaccagctgccagcagaacatgatccaggagctgatcgagaccaaccagcagctgagaaacgagctgcagctggagcagagcagagccgccaaccaggagcagagagccaacgacctggagcagatcatggagagcgtgaagagcaagatcggcgagctggaggacgagagcctgagcagagcctgccaccagcagaacaagatcaaggacctgcagaaggagcagaagaccctgcaggtgaagtgccagcactacaagaagaagagaaccgagcaggaggagaccatcgccagcctgcagatggaggtgtgcagactgaagaaggaggaggaggacagaatcgtgacccagaacagagtgttcgcctacctgtgcaagagagtgccccacaccgtgctggacagacagctgctgtgcctgatcgactactacgagagcaagatcagaaagatccacacccagagacagtacaaggaggacgagagccagagcgaggaggagaacgactacagaaacctggacgccagccccacctacaagggcctgctgatgagcctgcagaaccagctgaaggagagcaagagcaagatcgacgccctgagcagcgagaagctgaacctgcagaaggacctggagaccagacccacccagcacgagctgagactgtacaagcagcaggtgaagaagctggagaaggccctgaagaagaacgtgaagctgcaggagctgatcaaccacaagaaggccgaggacaccgagaagaaggacgagcccagcaagtacaaccagcagcaggccctgatcgaccagagatacttccaggtgctgtgcagcatcaacagcatcatccacaaccccagagcccccgtgatcatctacaagcagaccaagggcggcgtgcagaacttcaacaaggacctggtgcaggactgcggcttcgagcacctggtgcccgtgatcgagatgtgggccgaccagctgaccagcctgaaggacctgtacaagagcctgaagaccctgagcgccgagctggtgccctggctgaacctgaagaagcaggacgagaacgagggcatcaaggtggaggacctgctgttcatcgtggacaccatgctggaggaggtggagaacaaggagaaggacagcaacatgccccacttccagaccctgcaggccatcgtgagccacttccagaagctgttcgacgtgcccagcctgaacggcgtgtaccccagaatgaacgaggtgtacaccagactgggcgagatgaacaacgccgtgagaaacctgcaggagctgctggagctggacagcagcagcagcctgtgcgtgctggtgagcaccgtgggcaagctgtgcagactgatcaacgaggacgtgaacgagcaggtgatgcaggtgctgggccccgaggacctgcagagcatcatctacaagctggaggagcacgaggagttcttccccgccttccaggccttcaccaacgacctgctggagatcctggagatcgacgacctggacgccatcgtgcccgccgtgaagaagctgaaggtgctgagctactag

SEQ ID NO: 76304 - DNA, 3666 bp, Artificial Sequence
  Description of Artificial Sequence: Synthetic coding sequence
atgctgttccccctgcaggtggccgccgtgaccagcagcgtgagagacgaccccctggagcactgcgtgagccccagaaccagagccagaagccccgagatctgcaagatggccgacaacctggacgagttcatcgaggagcagaaggccagactggccgaggacaaggccgagctggagagcgaccccccctacatggagatgaagggcaagctgagcgccaagctgagcgagaacagcaagatcctgatcagcatggccaaggagaacatcccccccaacagccagcagaccagaggcagcctgggcatcgactacggcctgagcctgcccctgggcgaggactacgagagaaagaagcacaagctgaaggaggagctgagacaggactacagaagatacctgacccaggagagactgaagctggagagaaacaaggagtacaaccagttcctgagaggcaaggaggagagcagcgagaagttcagacaggtggagaagagcaccgagcccaagagccagagaaacaagaagcccatcggccaggtgaagcccgacctgaccagccagatccagaccagctgcgagaacagcgagggccccagaaaggacgtgctgacccccagcgaggcctacgaggagctgctgaaccagagaagactggaggaggacagatacagacagctggacgacgagatcgagctgagaaacagaagaatcatcaagaaggccaacgaggaggtgggcatcagcaacctgaagcaccagagattcgccagcaaggccggcatccccgacagaagattccacagattcaacgaggacagagtgttcgacagaagataccacagacccgaccaggaccccgaggtgagcgaggagatggacgagagattcagatacgagagcgacttcgacagaagactgagcagagtgtacaccaacgacagaatgcacagaaacaagagaggcaacatgccccccatggagcacgacggcgacgtgatcgagcagagcaacatcagaatcagcagcgccgagaacaagagcgcccccgacaacgagaccagcaagagcgccaaccaggacacctgcagccccttcgccggcatgctgttcggcggcgaggacagagagctgatccagagaagaaaggagaagtacagactggagctgctggagcagatggccgagcagcagagaaacaagagaagagagaaggacctggagctgagagtggccgccagcggcgcccaggaccccgagaagagccccgacagactgaagcagttcagcgtggcccccagacacttcgaggagatgatcccccccgagagacccagaatcgccttccagacccccctgccccccctgagcgcccccagcgtgccccccatccccagcgtgcaccccgtgcccagccagaacgaggacctgagaagcggcctgagcagcgccctgggcgagatggtgagccccagaatcgcccccctgccccccccccccctgctgccccccctggccaccaactacagaaccccctacgacgacgcctactacttctacggcagcagaaacaccttcgaccccagcctggcctactacggcagcggcatgatgggcgtgcagcccgccgcctacgtgagcgcccccgtgacccaccagctggcccagcccgtggtgaacaccgtgggccagaacgagctgaagatcaccagcgaccaggtgatcaacagcggcctgatcttcgaggacaagcccaagcccagcaagcagagcctgcagagctaccaggaggccctgcagcagcagatcagagagagagaggagagaagaaagaaggagagagaggagaaggaggagtacgaggccaagctggaggccgagatgagaacctacaacccctggggcaagggcggcggcggcgcccccctgagagacgccaagggcaacctgatcaccgacctgaacagaatgcacagacagaacatcgacgcctaccacaaccccgacgccagaacctacgaggacaagagagccgtggtgagcctggaccccaacctggccaccagcaacgccgagaacctggaggacgccgccaacaagagcagcggccacatgcagacccagagcagccccttcgccagaggcaacgtgttcggcgagccccccaccgagctgcagatcaagcagcaggagctgtacaagaacttcctgagattccagatcgaggagaagaagcagagagaggaggccgagagagagagactgagaatcgccgaggagaaggaggagagaagactggccgagcagagagccagaatccagcaggagtacgaggaggagcaggagaagaagagagagaaggaggaggagcagagactgaagaacgaggagcacatcagactggccgaggagagacagaaggaggccgagagaaagaagaaggaggaggaggagaagtacaacctgcagctgcagcactactgcgagagagacaacctgatcggcgaggagaccaagcacatgagacagcccagccccatcgtgcccgccctgcagaacaagatcgccagcaagctgcagagaccccccagcgtggacagcatcatcagaagcttcatccacgagagcagcatgagcagagcccagagcccccccgtgcccgccagaaagaaccagctgagagccgaggaggagaagaagaacgtgatcatggagctgagcgagatgagaaagcagctgagaagcgaggagagaagactgcaggagagactgctgcacatggacagcgacgacgagatccccatcagaaagaaggagagaaaccccatggacatcttcgacatggccagacacagactgcaggcccccgtgagaagacagagccccaagggcctggacgccgccaccttccagaacgtgcacgacttcaacgagctgaaggacagagacagcgagaccagagtggacctgaagttcatgtacctggacccccccagagaccaccacaccctggagatccagcagcaggccctgctgagagagcagcagaagagactgaacagaatcaagatgcaggagggcgccaaggtggacctggacgccatccccagcgccaaggtgagagagcagagaatgcccagagacgacaccagcgacttcctgaagaacagcctgctggagagcgacagcgccttcatcggcgcctacggcgagacctaccccgccatcgaggacgacgtgctgcccccccccagccagctgcccagcgccagagagagaagaagaaacaagtggaagggcctggacatcgacagcagcagacccaacgtggcccccgacggcctgagcctgaagagcatcagcagcgtgaacgtggacgagctgagagtgagaaacgaggagagaatgagaagactgaacgagttccacaacaagcccatcaacaccgacgacgagagcagcctggtggaccccgacgacatcatgaagcacatcggcgacgacggcagcaacagcgtggccaccgagccctggctgagacccggcaccagcgagaccctgaagagattcatggccgagcagctgaaccaggagcagcagcagatccccggcaagcccggcaccttcacctggcagggcctgagcaccgcccacggctag

SEQ ID NO: 76305 - DNA, 3771 bp, Artificial Sequence
  Description of Artificial Sequence: Synthetic coding sequence
atgctgttccccctgcaggtggccgccgtgaccagcagcgtgagagacgaccccctggagcactgcgtgagccccagaaccagagccagaagccccgagatctgcaagatggccgacaacctggacgagttcatcgaggagcagaaggccagactggccgaggacaaggccgagctggagagcgaccccccctacatggagatgaagggcaagctgagcgccaagctgagcgagaacagcaagatcctgatcagcatggccaaggagaacatcccccccaacagccagcagaccagaggcagcctgggcatcgactacggcctgagcctgcccctgggcgaggactacgagagaaagaagcacaagctgaaggaggagctgagacaggactacagaagatacctgacccagaaggtgttcagcggcaccagcaagaagaacttcctgagcaccagcgagaccgaccccagcaccctgggcgtgagcctgcccatcggcgagagactgagcgccaaggagagactgaagctggagagaaacaaggagtacaaccagttcctgagaggcaaggaggagagcagcgagaagttcagacaggtggagaagagcaccgagcccaagagccagagaaacaagaagcccatcggccaggtgaagcccgacctgaccagccagatccagaccagctgcgagaacagcgagggccccagaaaggacgtgctgacccccagcgaggcctacgaggagctgctgaaccagagaagactggaggaggacagatacagacagctggacgacgagatcgagctgagaaacagaagaatcatcaagaaggccaacgaggaggtgggcatcagcaacctgaagcaccagagattcgccagcaaggccggcatccccgacagaagattccacagattcaacgaggacagagtgttcgacagaagataccacagacccgaccaggaccccgaggtgagcgaggagatggacgagagattcagatacgagagcgacttcgacagaagactgagcagagtgtacaccaacgacagaatgcacagaaacaagagaggcaacatgccccccatggagcacgacggcgacgtgatcgagcagagcaacatcagaatcagcagcgccgagaacaagagcgcccccgacaacgagaccagcaagagcgccaaccaggacacctgcagccccttcgccggcatgctgttcggcggcgaggacagagagctgatccagagaagaaaggagaagtacagactggagctgctggagcagatggccgagcagcagagaaacaagagaagagagaaggacctggagctgagagtggccgccagcggcgcccaggaccccgagaagagccccgacagactgaagcagttcagcgtggcccccagacacttcgaggagatgatcccccccgagagacccagaatcgccttccagacccccctgccccccctgagcgcccccagcgtgccccccatccccagcgtgcaccccgtgcccagccagaacgaggacctgagaagcggcctgagcagcgccctgggcgagatggtgagccccagaatcgcccccctgccccccccccccctgctgccccccctggccaccaactacagaaccccctacgacgacgcctactacttctacggcagcagaaacaccttcgaccccagcctggcctactacggcagcggcatgatgggcgtgcagcccgccgcctacgtgagcgcccccgtgacccaccagctggcccagcccgtggtgaacaccgtgggccagaacgagctgaagatcaccagcgaccaggtgatcaacagcggcctgatcttcgaggacaagcccaagcccagcaagcagagcctgcagagctaccaggaggccctgcagcagcagatcagagagagagaggagagaagaaagaaggagagagaggagaaggaggagtacgaggccaagctggaggccgagatgagaacctacaacccctggggcaagggcggcggcggcgcccccctgagagacgccaagggcaacctgatcaccgacctgaacagaatgcacagacagaacatcgacgcctaccacaaccccgacgccagaacctacgaggacaagagagccgtggtgagcctggaccccaacctggccaccagcaacgccgagaacctggaggacgccgccaacaagagcagcggccacatgcagacccagagcagccccttcgccagaggcaacgtgttcggcgagccccccaccgagctgcagatcaagcagcaggagctgtacaagaacttcctgagattccagatcgaggagaagaagcagagagaggaggccgagagagagagactgagaatcgccgaggagaaggaggagagaagactggccgagcagagagccagaatccagcaggagtacgaggaggagcaggagaagaagagagagaaggaggaggagcagagactgaagaacgaggagcacatcagactggccgaggagagacagaaggaggccgagagaaagaagaaggaggaggaggagaagtacaacctgcagctgcagcactactgcgagagagacaacctgatcggcgaggagaccaagcacatgagacagcccagccccatcgtgcccgccctgcagaacaagatcgccagcaagctgcagagaccccccagcgtggacagcatcatcagaagcttcatccacgagagcagcatgagcagagcccagagcccccccgtgcccgccagaaagaaccagctgagagccgaggaggagaagaagaacgtgatcatggagctgagcgagatgagaaagcagctgagaagcgaggagagaagactgcaggagagactgctgcacatggacagcgacgacgagatccccatcagaaagaaggagagaaaccccatggacatcttcgacatggccagacacagactgcaggcccccgtgagaagacagagccccaagggcctggacgccgccaccttccagaacgtgcacgacttcaacgagctgaaggacagagacagcgagaccagagtggacctgaagttcatgtacctggacccccccagagaccaccacaccctggagatccagcagcaggccctgctgagagagcagcagaagagactgaacagaatcaagatgcaggagggcgccaaggtggacctggacgccatccccagcgccaaggtgagagagcagagaatgcccagagacgacaccagcgacttcctgaagaacagcctgctggagagcgacagcgccttcatcggcgcctacggcgagacctaccccgccatcgaggacgacgtgctgcccccccccagccagctgcccagcgccagagagagaagaagaaacaagtggaagggcctggacatcgacagcagcagacccaacgtggcccccgacggcctgagcctgaagagcatcagcagcgtgaacgtggacgagctgagagtgagaaacgaggagagaatgagaagactgaacgagttccacaacaagcccatcaacaccgacgacgagagcagcctggtggaccccgacgacatcatgaagcacatcggcgacgacggcagcaacagcgtggccaccgagccctggctgagacccggcaccagcgagaccctgaagagattcatggccgagcagctgaaccaggagcagcagcagatccccggcaagcccggcaccttcacctggcagggcctgagcaccgcccacggctag

SEQ ID NO: 76306 - DNA, 2631 bp, Artificial Sequence
  Description of Artificial Sequence: Synthetic coding sequence
atggacgagagattcagatacgagagcgacttcgacagaagactgagcagagtgtacaccaacgacagaatgcacagaaacaagagaggcaacatgccccccatggagcacgacggcgacgtgatcgagcagagcaacatcagaatcagcagcgccgagaacaagagcgcccccgacaacgagaccagcaagagcgccaaccaggacacctgcagccccttcgccggcatgctgttcggcggcgaggacagagagctgatccagagaagaaaggagaagtacagactggagctgctggagcagatggccgagcagcagagaaacaagagaagagagaaggacctggagctgagagtggccgccagcggcgcccaggaccccgagaagagccccgacagactgaagcagttcagcgtggcccccagacacttcgaggagatgatcccccccgagagacccagaatcgccttccagacccccctgccccccctgagcgcccccagcgtgccccccatccccagcgtgcaccccgtgcccagccagaacgaggacctgagaagcggcctgagcagcgccctgggcgagatggtgagccccagaatcgcccccctgccccccccccccctgctgccccccctggccaccaactacagaaccccctacgacgacgcctactacttctacggcagcagaaacaccttcgaccccagcctggcctactacggcagcggcatgatgggcgtgcagcccgccgcctacgtgagcgcccccgtgacccaccagctggcccagcccgtggtgaacaccgtgggccagaacgagctgaagatcaccagcgaccaggtgatcaacagcggcctgatcttcgaggacaagcccaagcccagcaagcagagcctgcagagctaccaggaggccctgcagcagcagatcagagagagagaggagagaagaaagaaggagagagaggagaaggaggagtacgaggccaagctggaggccgagatgagaacctacaacccctggggcaagggcggcggcggcgcccccctgagagacgccaagggcaacctgatcagccacatgcagacccagagcagccccttcgccagaggcaacgtgttcggcgagccccccaccgagctgcagatcaagcagcaggagctgtacaagaacttcctgagattccagatcgaggagaagaagcagagagaggaggccgagagagagagactgagaatcgccgaggagaaggaggagagaagactggccgagcagagagccagaatccagcaggagtacgaggaggagcaggagaagaagagagagaaggaggaggagcagagactgaagaacgaggagcacatcagactggccgaggagagacagaaggaggccgagagaaagaagaaggaggaggaggagaagtacaacctgcagctgcagcactactgcgagagagacaacctgatcggcgaggagaccaagcacatgagacagcccagccccatcgtgcccgccctgcagaacaagatcgccagcaagctgcagagaccccccagcgtggacagcatcatcagaagcttcatccacgagagcagcatgagcagagcccagagcccccccgtgcccgccagaaagaaccagctgagagccgaggaggagaagaagaacgtgatcatggagctgagcgagatgagaaagcagctgagaagcgaggagagaagactgcaggagagactgctgcacatggacagcgacgacgagatccccatcagaaagaaggagagaaaccccatggacatcttcgacatggccagacacagactgcaggcccccgtgagaagacagagccccaagggcctggacgccgccaccttccagaacgtgcacgacttcaacgagctgaaggacagagacagcgagaccagagtggacctgaagttcatgtacctggacccccccagagaccaccacaccctggagatccagcagcaggccctgctgagagagcagcagaagagactgaacagaatcaagatgcaggagggcgccaaggtggacctggacgccatccccagcgccaaggtgagagagcagagaatgcccagagacgacaccagcgacttcctgaagaacagcctgctggagagcgacagcgccttcatcggcgcctacggcgagacctaccccgccatcgaggacgacgtgctgcccccccccagccagctgcccagcgccagagagagaagaagaaacaagtggaagggcctggacatcgacagcagcagacccaacgtggcccccgacggcctgagcctgaagagcatcagcagcgtgaacgtggacgagctgagagtgagaaacgaggagagaatgagaagactgaacgagttccacaacaagcccatcaacaccgacgacgagagcagcctggtggaccccgacgacatcatgaagcacatcggcgacgacggcagcaacagcgtggccaccgagccctggctgagacccggcaccagcgagaccctgaagagattcatggccgagcagctgaaccaggagcagcagcagatccccggcaagcccggcaccttcacctggcagggcctgagcaccgcccacggctag

SEQ ID NO: 76307 - DNA, 2631 bp, Artificial Sequence; identical to SEQ ID NO: 76306
  Description of Artificial Sequence: Synthetic coding sequence

SEQ ID NO: 76308 - DNA, 1677 bp, Artificial Sequence
  Description of Artificial Sequence: Synthetic coding sequence
atgccctggagaagaagaagaaacagagtgagcgccctggagggcggcagagaggaggaggccccccccgaggccgccgccgtgccccccgccctgctgaccagcccccagcagaccgaggccgccgccgagagaatcctgctgagaggcatcttcgagatcggcagagacagctgcgacgtggtgctgagcgagagagccctgagatggagacccatccagcccgagagacccgccggcgacagcaagtacgacctgctgtgcaaggaggagttcatcgagctgaaggacatcttcagcgtgaagctgaagagaagatgcagcgtgaagcagcagagaagcggcaccctgctgggcatcaccctgttcatctgcctgaagaaggagcagaacaagctgaagaacagcaccctggacctgatcaacctgagcgaggaccactgcgacatctggttcagacagttcaagaagatcctggccggcttccccaacagacccaagagcctgaagatcctgctgaacccccagagccacaagaaggaggccacccaggtgtactacgagaaggtggagcccctgctgaagctggccggcatcaagaccgacgtgaccatcatggagtacgagggccacgccctgagcctgctgaaggagtgcgagctgcagggcttcgacggcggccacagaaagcccctgttcgccatccactggagcgtgcagagactgttcaccggcatgcagaccctggagcccagcgtggtgtgcgtgggcggcgacggcagcgccagcgaggtggcccacgccctgctgctgagagcccagaagaacgccggcatggagaccgacagaatcctgacccccgtgagagcccagctgcccctgggcctgatccccgccggcagcaccaacgtgctggcccacagcctgcacggcgtgccccacgtgatcaccgccaccctgcacatcatcatgggccacgtgcagctggtggacgtgtgcaccttcagcaccgccggcaagctgctgagattcggcttcagcgccatgttcggcttcggcggcagaaccctggccctggccgagaagtacagatggatgagccccaaccagagaagagacttcgccgtggtgaaggccctggccaagctgaaggccgaggactgcgagatcagcttcctgcccttcaacagcagcgacgacgtgcaggagagaagagcccagggcagccccaagagcgactgcaacgaccagtggcagatgatccagggccagttcctgaacgtgagcatcatggccatcccctgcctgtgcagcgtggcccccagaggcctggcccccaacaccagactgaacaacggcagcatggccctgatcatcgccagaaacaccagcagacccgagttcatcaagcacctgaagagatacgccagcgtgaagaaccagttcaacttccccttcgtggagacctacaccgtggaggaggtgaaggtgcaccccagaaacaacaccggcggctacaaccccgaggaggaggaggacgagaccgccagcgagaactgcttcccctggaacgtggacggcgacctgatggaggtggccagcgaggtgcacatcagactgcaccccagactgatcagcctgtacggcggcagcatggaggagatgatccccaagtag

SEQ ID NO: 76309 - DNA, 1260 bp, Artificial Sequence
  Description of Artificial Sequence: Synthetic coding sequence
atgccctggagaagaagaagaaacagagtgagcgccctggagggcggcagagaggaggaggccccccccgaggccgccgccgtgccccccgccctgctgaccagcccccagcagaccgaggccgccgccgagagaatcctgctgagaggcatcttcgagatcggcagagacagctgcgacgtggtgctgagcgagagagccctgagatggagacccatccagcccgagagacccgccggcgacagcaagtacgacctgctgtgcaaggaggagttcatcgagctgaaggacatcttcagcgtgaagctgaagagaagatgcagcgtgaagcagcagagaagcggcaccctgctgggcatcaccctgttcatctgcctgaagaaggagcagaacaagctgaagaacagcaccctggacctgatcaacctgagcgaggaccactgcgacatctggttcagacagttcaagaagatcctggccggcagcaccaacgtgctggcccacagcctgcacggcgtgccccacgtgatcaccgccaccctgcacatcatcatgggccacgtgcagctggtggacgtgtgcaccttcagcaccgccggcaagctgctgagattcggcttcagcgccatgttcggcttcggcggcagaaccctggccctggccgagaagtacagatggatgagccccaaccagagaagagacttcgccgtggtgaaggccctggccaagctgaaggccgaggactgcgagatcagcttcctgcccttcaacagcagcgacgacgtgcaggagagaagagcccagggcagccccaagagcgactgcaacgaccagtggcagatgatccagggccagttcctgaacgtgagcatcatggccatcccctgcctgtgcagcgtggcccccagaggcctggcccccaacaccagactgaacaacggcagcatggccctgatcatcgccagaaacaccagcagacccgagttcatcaagcacctgaagagatacgccagcgtgaagaaccagttcaacttccccttcgtggagacctacaccgtggaggaggtgaaggtgcaccccagaaacaacaccggcggctacaaccccgaggaggaggaggacgagaccgccagcgagaactgcttcccctggaacgtggacggcgacctgatggaggtggccagcgaggtgcacatcagactgcaccccagactgatcagcctgtacggcggcagcatggaggagatgatccccaagtag

SEQ ID NO: 76310 - DNA, 1392 bp, Artificial Sequence
  Description of Artificial Sequence: Synthetic coding sequence
atgccctggagaagaagaagaaacagagtgagcgccctggagggcggcagagaggaggaggccccccccgaggccgccgccgtgccccccgccctgctgaccagcccccagcagaccgaggccgccgccgagagaatcctgctgagaggcatcttcgagatcggcagagacagctgcgacgtggtgctgagcgagagagccctgagatggagacccatccagcccgagagacccgccggcgacagcaagtacgacctgctgtgcaaggaggagttcatcgagctgaaggacatcttcagcgtgaagctgaagagaagatgcagcgtgaagcagcagagaagcggcaccctgctgggcatcaccctgttcatctgcctgaagaaggagcagaacaagctgaagaacagcaccctggacctgatcaacctgagcgaggaccactgcgacatctggttcagacagttcaagaagatcctggccggcttccccaacagacccaagagcctgaagatcctgctgaacccccagagccacaagaaggaggccacccaggtgtactacgagaaggtggagcccctgctgaagctggccggcatcaagaccgacgtgaccagaagcaccaacgtgctggcccacagcctgcacggcgtgccccacgtgatcaccgccaccctgcacatcatcatgggccacgtgcagctggtggacgtgtgcaccttcagcaccgccggcaagctgctgagattcggcttcagcgccatgttcggcttcggcggcagaaccctggccctggccgagaagtacagatggatgagccccaaccagagaagagacttcgccgtggtgaaggccctggccaagctgaaggccgaggactgcgagatcagcttcctgcccttcaacagcagcgacgacgtgcaggagagaagagcccagggcagccccaagagcgactgcaacgaccagtggcagatgatccagggccagttcctgaacgtgagcatcatggccatcccctgcctgtgcagcgtggcccccagaggcctggcccccaacaccagactgaacaacggcagcatggccctgatcatcgccagaaacaccagcagacccgagttcatcaagcacctgaagagatacgccagcgtgaagaaccagttcaacttccccttcgtggagacctacaccgtggaggaggtgaaggtgcaccccagaaacaacaccggcggctacaaccccgaggaggaggaggacgagaccgccagcgagaactgcttcccctggaacgtggacggcgacctgatggaggtggccagcgaggtgcacatcagactgcaccccagactgatcagcctgtacggcggcagcatggaggagatgatccccaagtag

SEQ ID NO: 76311 - DNA, 1599 bp, Artificial Sequence
  Description of Artificial Sequence: Synthetic coding sequence
atgccctggagaagaagaagaaacagagtgagcgccctggagggcggcagagaggaggaggccccccccgaggccgccgccgtgccccccgccctgctgaccagcccccagcagaccgaggccgccgccgagagaatcctgctgagaggcatcttcgagatcggcagagacagctgcgacgtggtgctgagcgagagagccctgagatggagacccatccagcccgagagacccgccggcgacagcaagtacgacctgctgtgcaaggaggagttcatcgagctgaaggacatcttcagcgtgaagctgaagagaagatgcagcgtgaagcagcagagaagcggcaccctgctgggcatcaccctgttcatctgcctgaagaaggagcagaacaagctgaagaacagcaccctggacctgatcaacctgagcgaggaccactgcgacatctggttcagacagttcaagaagatcctggccggcttccccaacagacccaagagcctgaagatcctgctgaacccccagagccacaagaaggaggccacccaggtgtactacgagaaggtggagcccctgctgaagctggccggcatcaagaccgacgtgaccatcatggagtacgagggccacgccctgagcctgctgaaggagtgcgagctgcagggcttcgacggcgtggtgtgcgtgggcggcgacggcagcgccagcgaggtggcccacgccctgctgctgagagcccagaagaacgccggcatggagaccgacagaatcctgacccccgtgagagcccagctgcccctgggcctgatccccgccggcagcaccaacgtgctggcccacagcctgcacggcgtgccccacgtgatcaccgccaccctgcacatcatcatgggccacgtgcagctggtggacgtgtgcaccttcagcaccgccggcaagctgctgagattcggcttcagcgccatgttcggcttcggcggcagaaccctggccctggccgagaagtacagatggatgagccccaaccagagaagagacttcgccgtggtgaaggccctggccaagctgaaggccgaggactgcgagatcagcttcctgcccttcaacagcagcgacgacgtgcaggagagaagagcccagggcagccccaagagcgactgcaacgaccagtggcagatgatccagggccagttcctgaacgtgagcatcatggccatcccctgcctgtgcagcgtggcccccagaggcctggcccccaacaccagactgaacaacggcagcatggccctgatcatcgccagaaacaccagcagacccgagttcatcaagcacctgaagagatacgccagcgtgaagaaccagttcaacttccccttcgtggagacctacaccgtggaggaggtgaaggtgcaccccagaaacaacaccggcggctacaaccccgaggaggaggaggacgagaccgccagcgagaactgcttcccctggaacgtggacggcgacctgatggaggtggccagcgaggtgcacatcagactgcaccccagactgatcagcctgtacggcggcagcatggaggagatgatccccaagtag

SEQ ID NO: 76312 - DNA, 1545 bp, Artificial Sequence
  Description of Artificial Sequence: Synthetic coding sequence
atgccctggagaagaagaagaaacagagtgagcgccctggagggcggcagagaggaggaggccccccccgaggccgccgccgtgccccccgccctgctgaccagcccccagcagaccgaggccgccgccgagagaatcctgctgagaggcatcttcgagatcggcagagacagctgcgacgtggtgctgagcgagagagccctgagatggagacccatccagcccgagagacccgccggcgacagcaagtacgacctgctgtgcaaggaggagttcatcgagctgaaggacatcttcagcgtgaagctgaagagaagatgcagcgtgaagcagcagagaagcggcaccctgctgggcatcaccctgttcatctgcctgaagaaggagcagaacaagctgaagaacagcaccctggacctgatcaacctgagcgaggaccactgcgacatctggttcagacagttcaagaagatcctggccgtgatggagtacgagggccacgccctgagcctgctgaaggagtgcgagctgcagggcttcgacggcggccacagaaagcccctgttcgccatccactggagcgtgcagagactgttcaccggcatgcagaccctggagcccagcgtggtgtgcgtgggcggcgacggcagcgccagcgaggtggcccacgccctgctgctgagagcccagaagaacgccggcatggagaccgacagaatcctgacccccgtgagagcccagctgcccctgggcctgatccccgccggcagcaccaacgtgctggcccacagcctgcacggcgtgccccacgtgatcaccgccaccctgcacatcatcatgggccacgtgcagctggtggacgtgtgcaccttcagcaccgccggcaagctgctgagattcggcttcagcgccatgttcggcttcggcggcagaaccctggccctggccgagaagtacagatggatgagccccaaccagagaagagacttcgccgtggtgaaggccctggccaagctgaaggccgaggactgcgagatcagcttcctgcccttcaacagcagcgacgacgtgcaggagagaagagcccagggcagccccaagagcgactgcaacgaccagtggcagatgatccagggccagttcctgaacgtgagcatcatggccatcccctgcctgtgcagcgtggcccccagaggcctggcccccaacaccagactgaacaacggcagcatggccctgatcatcgccagaaacaccagcagacccgagttcatcaagcacctgaagagatacgccagcgtgaagaaccagttcaacttccccttcgtggagacctacaccgtggaggaggtgaaggtgcaccccagaaacaacaccggcggctacaaccccgaggaggaggaggacgagaccgccagcgagaactgcttcccctggaacgtggacggcgacctgatggaggtggccagcgaggtgcacatcagactgcaccccagactgatcagcctgtacggcggcagcatggaggagatgatccccaagtag

SEQ ID NO: 76313 - DNA, 804 bp, Artificial Sequence
  Description of Artificial Sequence: Synthetic coding sequence
atgcacctgctgctgttccagctgctggtgctgctgcccctgggcaagaccaccagacaccaggacggcagacagaaccagagcagcctgagccccgtgctgctgcccagaaaccagagagagctgcccaccggcaaccacgaggaggccgaggagaagcccgacctgttcgtggccgtgccccacctggtggccaccagccccgccggcgagggccagagacagagagagaagatgctgagcagattcggcagattctggaagaagcccgagagagagatgcaccccagcagagacagcgacagcgagcccttcccccccggcacccagagcctgatccagcccatcgacggcatgaagatggagaagagccccctgagagaggaggccaagaagttctggcaccacttcatgttcagaaagacccccgccagccagggcgtgatcctgcccatcaagagccacgaggtgcactgggagacctgcagaaccgtgcccttcagccagaccatcacccacgagggctgcgagaaggtggtggtgcagaacaacctgtgcttcggcaagtgcggcagcgtgcacttccccggcgccgcccagcacagccacaccagctgcagccactgcctgcccgccaagttcaccaccatgcacctgcccctgaactgcaccgagctgagcagcgtgatcaaggtggtgatgctggtggaggagtgccagtgcaaggtgaagaccgagcacgaggacggccacatcctgcacgccggcagccaggacagcttcatccccggcgtgagcgcctag

SEQ ID NO: 76314 - DNA, 789 bp, Artificial Sequence
  Description of Artificial Sequence: Synthetic coding sequence
atggcctggctggaggacgtggacttcctggaggacgtgcccctgctggaggacatccccctgctggaggacgtgcccctgctggaggacgtgcccctgctggaggacaccagcagactggaggacatcaacctgatggaggacatggccctgctggaggacgtggacctgctggaggacaccgacttcctggaggacctggacttcagcgaggccatggacctgagagaggacaaggacttcctggaggacatggacagcctggaggacatggccctgctggaggacgtggacctgctggaggacaccgacttcctggaggaccccgacttcctggaggccatcgacctgagagaggacaaggacttcctggaggacatggacagcctggaggacctggaggccatcggcagatgcggcttcagcggcagacacggcttcttcggcagaagaagattcagcggcagacccaagctgagcggcagactgggcctgctgggcagaagaggcttcagcggcagactgggcggctactggaagacctggatcttctggaagacctggatcttctggaagacctggatcttcagaaagacctacatcggctggaagacctggatcttcagcggcagatgcggcctgaccggcagacccggcttcggcggcagaagaagattcttctggaagaccctgaccgactggaagacctggatcagcttctggaagaccctgatcgactggaagacctggatcagcttctggaagaccctgatcgactggaagatctag

SEQ ID NO: 76315 - DNA, 1365 bp, Artificial Sequence
  Description of Artificial Sequence: Synthetic coding sequence
atgctggccgagaacctggtggaggagttcgagatgaaggaggacgagccctggtacgaccaccaggacctgcagcaggacctgcagctggccgccgagctgggcaagaccctgctggacagaaacaccgagctggaggacagcgtgcagcagatgtacaccaccaaccaggagcagctgcaggagatcgagtacctgaccaagcaggtggagctgctgagacagatgaacgagcagcacgccaaggtgtacgagcagctggacgtgaccgccagagagctggaggagaccaaccagaagctggtggccgacagcaaggccagccagcagaagatcctgagcctgaccgagaccatcgagtgcctgcagaccaacatcgaccacctgcagagccaggtggaggagctgaagagcagcggccagggcagaagaagccccggcaagtgcgaccaggagaagcccgcccccagcttcgcctgcctgaaggagctgtacgacctgagacagcacttcgtgtacgaccacgtgttcgccgagaagatcaccagcctgcagggccagcccagccccgacgaggaggagaacgagcacctgaagaagaccgtgaccatgctgcaggcccagctgagcctggagagacagaagagagtgaccatggaggaggagtacggcctggtgctgaaggagaacagcgagctggagcagcagctgggcgccaccggcgcctacagagccagagccctggagctggaggccgaggtggccgagatgagacagatgctgcagagcgagcaccccttcgtgaacggcgtggagaagctggtgcccgacagcctgtacgtgcccttcaaggagcccagccagagcctgctggaggagatgttcctgaccgtgcccgagagccacagaaagcccctgaagagaagcagcagcgagaccatcctgagcagcctggccggcagcgacatcgtgaagggccacgaggagacctgcatcagaagagccaaggccgtgaagcagagaggcatcagcctgctgcacgaggtggacacccagtacagcgccctgaaggtgaagtacgaggagctgctgaagaagtgccaggaggagcaggacagcctgagccacaaggccgtgcagaccagcagagccgccgccaaggacctgaccggcgtgaacgcccagagcgagcccgtggccagcggctgggagctggccagcgtgaaccccgagcccgtgagcagccccaccaccccccccgagtacaaggccctgttcaaggagatcttcagctgcatcaagaagaccaagcaggagatcgacgagcagagaaccaagtacagaagcctgagcagccacagctag

SEQ ID NO: 76316 - DNA, 618 bp, Artificial Sequence
  Description of Artificial Sequence: Synthetic coding sequence
atgctgggcgccaagccccactggctgcccggccccctgcacagccccggcctgcccctggtgctggtgctgctggccctgggcgccggctgggcccaggagggcagcgagcccgtgctgctggagggcgagtgcctggtggtgtgcgagcccggcagagccgccgccggcggccccggcggcgccgccctgggcgaggccccccccggcagagtggccttcgccgccgtgagaagccaccaccacgagcccgccggcgagaccggcaacggcaccagcggcgccatctacttcgaccaggtgctggtgaacgagggcggcggcttcgacagagccagcggcagcttcgtggcccccgtgagaggcgtgtacagcttcagattccacgtggtgaaggtgtacaacagacagaccgtgcaggtgagcctgatgctgaacacctggcccgtgatcagcgccttcgccaacgaccccgacgtgaccagagaggccgccaccagcagcgtgctgctgcccctggaccccggcgacagagtgagcctgagactgagaagaggcaacctgctgggcggctggaagtacagcagcttcagcggcttcctgatcttccccctgtag

SEQ ID NO: 76317 - DNA, 990 bp, Artificial Sequence
  Description of Artificial Sequence: Synthetic coding sequence
atgatcctgatgaagatgggcttcagcggcatcgtggtgcaccaggagagcgtgtgcgccacctacggcagcggcctgagcagcacctgcatcgtggacgtgggcgaccagaagaccagcgtgtgctgcgtggaggacggcgtgagccacagaaacaccagaatcttcagctggaaccaggacatcagcggcctgcaggaccacgagttccagatcagacaccccgacagccccgccctgctgtaccagttcagactgggcgacgagaagctgcaggcccccatggccctgttctaccccgccaccttcggcatcgtgggccagaagatgaccaccctgcagcacagaagccagggcgaccccgaggacccccacgacgagcactacctgctggccacccagagcaagcaggagcagagcgccaaggccaccgccgacagaaagagcgccagcaagcccatcggcttcgagggcgacctgagaggccagagcagcgacctgcccgagagactgcacagccaggaggtggacctgggcagcgcccagggcgacggcctgatggccggcaacgacagcgaggaggccctgaccgccctgatgagcagaaagaccgccatcagcctgttcgagggcaaggccctgggcctggacaaggccatcctgcacagcatcgactgctgcagcagcgacgacaccaagaagaagatgtacagcagcatcctggtggtgggcggcggcctgatgttccacaaggcccaggagttcctgcagcacagaatcctgaacaagatgccccccagcttcagaagaatcatcgagaacgtggacgtgatcaccagacccaaggacatggaccccagactgatcgcctggaagggcggcgccgtgctggcctgcctggacaccacccaggagctgtggatctaccagagagagtggcagagattcggcgtgagaatgctgagagagagagccgccttcgtgtggtag

SEQ ID NO: 76318 - DNA, 1131 bp, Artificial Sequence
  Description of Artificial Sequence: Synthetic coding sequence
atggaggagttccacggcagaaccctgcacgacgacgacagctgccaggtgatccccgtgctgccccaggtgatgatgatcctgatccccggccagaccctgcccctgcagctgttccacccccaggaggtgagcatggtgagaaacctgatccagaaggacagaaccttcgccgtgctggcctacagcaacgtgcaggagagagaggcccagttcggcaccaccgccgagatctacgcctacagagaggagcaggacttcggcatcgagatcgtgaaggtgaaggccatcggcagacagagattcaaggtgctggagctgagaacccagagcgacggcatccagcaggccaaggtgcagatcctgcccgagtgcgtgctgcccagcaccatgagcgccgtgcagctggagagcctgaacaagtgccagatcttccccagcaagcccgtgagcagagaggaccagtgcagctacaagtggtggcagaagtaccagaagagaaagttccactgcgccaacctgaccagctggcccagatggctgtacagcctgtacgacgccgagaccctgatggacagaatcaagaagcagctgagagagtgggacgagaacctgaaggacgacagcctgcccagcaacttcagctacagagtggccgcctgcctgcccatcgacgacgtgctgagaatccagctgctgaagatcggcagcgccatccagagactgagatgcgagctggacatcatgaacaagtgcaccagcctgtgctgcaagcagtgccaggagaccgagatcaccaccaagaacgagatcttcagcctgagcctgtgcggccccatggccgcctacgtgaacccccacggctacgtgcacgagaccctgaccgtgtacaaggcctgcaacctgaacctgatcggcagacccagcaccgagcacagctggttccccggctacgcctggaccgtggcccagtgcaagatctgcgccagccacatcggctggaagttcaccgccaccaagaaggacatgagcccccagaagttctggggcctgaccagaagcgccctgctgcccaccatccccgacaccgaggacgagatcagccccgacaaggtgatcctgtgcctgtag

SEQ ID NO: 76319 - DNA, 1326 bp, Artificial Sequence
  Description of Artificial Sequence: Synthetic coding sequence
atggccggcgagggcgaccagcaggacgccgcccacaacatgggcaaccacctgcccctgctgcccgagagcgaggaggaggacgagatggaggtggaggaccaggacagcaaggaggccaagaagcccaacatcatcaacttcgacaccagcctgcccaccagccacacctacctgggcgccgacatggaggagttccacggcagaaccctgcacgacgacgacagctgccaggtgatccccgtgctgccccaggtgatgatgatcctgatccccggccagaccctgcccctgcagctgttccacccccaggaggtgagcatggtgagaaacctgatccagaaggacagaaccttcgccgtgctggcctacagcaacgtgcaggagagagaggcccagttcggcaccaccgccgagatctacgcctacagagaggagcaggacttcggcatcgagatcgtgaaggtgaaggccatcggcagacagagattcaaggtgctggagctgagaacccagagcgacggcatccagcaggccaaggtgcagatcctgcccgagtgcgtgctgcccagcaccatgagcgccgtgcagctggagagcctgaacaagtgccagatcttccccagcaagcccgtgagcagagaggaccagtgcagctacaagtggtggcagaagtaccagaagagaaagttccactgcgccaacctgaccagctggcccagatggctgtacagcctgtacgacgccgagaccctgatggacagaatcaagaagcagctgagagagtgggacgagaacctgaaggacgacagcctgcccagcaaccccatcgacttcagctacagagtggccgcctgcctgcccatcgacgacgtgctgagaatccagctgctgaagatcggcagcgccatccagagactgagatgcgagctggacatcatgaacaagtgcaccagcctgtgctgcaagcagtgccaggagaccgagatcaccaccaagaacgagatcttcagcctgagcctgtgcggccccatggccgcctacgtgaacccccacggctacgtgcacgagaccctgaccgtgtacaaggcctgcaacctgaacctgatcggcagacccagcaccgagcacagctggttccccggctacgcctggaccgtggcccagtgcaagatctgcgccagccacatcggctggaagttcaccgccaccaagaaggacatgagcccccagaagttctggggcctgaccagaagcgccctgctgcccaccatccccgacaccgaggacgagatcagccccgacaaggtgatcctgtgcctgtag

SEQ ID NO: 76320 - DNA, 1335 bp, Artificial Sequence
  Description of Artificial Sequence: Synthetic coding sequence
atggaggaggagggcaagaagggcaagaagcccggcatcgtgagccccttcaagagagtgttcctgaagggcgagaagagcagagacaagaaggcccacgagaaggtgaccgagagaagacccctgcacaccgtggtgctgagcctgcccgagagagtggagcccgacagactgctgagcgactacatcgagaaggaggtgaagtacctgggccagctgaccagcatccccggctacctgaaccccagcagcagaaccgagatcctgcacttcatcgacaacgccaagagagcccaccagctgcccggccacctgacccaggagcacgacgccgtgctgagcctgagcgcctacaacgtgaagctggcctggagagacggcgaggacatcatcctgagagtgcccatccacgacatcgccgccgtgagctacgtgagagacgacgccgcccacctggtggtgctgaagaccgcccaggaccccggcatcagccccagccagagcctgtgcgccgagagcagcagaggcctgagcgccggcagcctgagcgagagcgccgtgggccccgtggaggcctgctgcctggtgatcctggccgccgagagcaaggtggccgccgaggagctgtgctgcctgctgggccaggtgttccaggtggtgtacaccgagagcaccatcgacttcctggacagagccatcttcgacggcgccagcacccccacccaccacctgagcctgcacagcgacgacagcagcaccaaggtggacatcaaggagacctacgaggtggaggccagcaccttctgcttccccgagagcgtggacgtgggcggcgccagcccccacagcaagaccatcagcgagagcgagctgagcgccagcgccaccgagctgctgcaggactacatgctgaccctgagaaccaagctgagcagccaggagatccagcagttcgccgccctgctgcacgagtacagaaacggcgccagcatccacgagttctgcatcaacctgagacagctgtacggcgacagcagaaagttcctgctgctgggcctgagacccttcatccccgagaaggacagccagcacttcgagaacttcctggagaccatcggcgtgaaggacggcagaggcatcatcaccgacagcttcggcagacacagaagagccctgagcaccaccagcagcagcaccaccaacggcaacagagccaccggcagcagcgacgacagaagcgcccccagcgagggcgacgagtgggacagaatgatcagcgacatcagcagcgacatcgaggccctgggctgcagcatggaccaggacagcgcctag

SEQ ID NO: 76321 - DNA, 1398 bp, Artificial Sequence
  Description of Artificial Sequence: Synthetic coding sequence
atgcacagcagctgcagacagagaagaaaccagaacctgagcaaggagatcccccagaccgagttccacaccggctacagcatggagaacgagcccggcatcgtgagccccttcaagagagtgttcctgaagggcgagaagagcagagacaagaaggcccacgagaaggtgaccgagagaagacccctgcacaccgtggtgctgagcctgcccgagagagtggagcccgacagactgctgagcgactacatcgagaaggaggtgaagtacctgggccagctgaccagcatccccggctacctgaaccccagcagcagaaccgagatcctgcacttcatcgacaacgccaagagagcccaccagctgcccggccacctgacccaggagcacgacgccgtgctgagcctgagcgcctacaacgtgaagctggcctggagagacggcgaggacatcatcctgagagtgcccatccacgacatcgccgccgtgagctacgtgagagacgacgccgcccacctggtggtgctgaagaccgcccaggaccccggcatcagccccagccagagcctgtgcgccgagagcagcagaggcctgagcgccggcagcctgagcgagagcgccgtgggccccgtggaggcctgctgcctggtgatcctggccgccgagagcaaggtggccgccgaggagctgtgctgcctgctgggccaggtgttccaggtggtgtacaccgagagcaccatcgacttcctggacagagccatcttcgacggcgccagcacccccacccaccacctgagcctgcacagcgacgacagcagcaccaaggtggacatcaaggagacctacgaggtggaggccagcaccttctgcttccccgagagcgtggacgtgggcggcgccagcccccacagcaagaccatcagcgagagcgagctgagcgccagcgccaccgagctgctgcaggactacatgctgaccctgagaaccaagctgagcagccaggagatccagcagttcgccgccctgctgcacgagtacagaaacggcgccagcatccacgagttctgcatcaacctgagacagctgtacggcgacagcagaaagttcctgctgctgggcctgagacccttcatccccgagaaggacagccagcacttcgagaacttcctggagaccatcggcgtgaaggacggcagaggcatcatcaccgacagcttcggcagacacagaagagccctgagcaccaccagcagcagcaccaccaacggcaacagagccaccggcagcagcgacgacagaagcgcccccagcgagggcgacgagtgggacagaatgatcagcgacatcagcagcgacatcgaggccctgggctgcagcatggaccaggacagcgcctag

SEQ ID NO: 76322 - DNA, 1317 bp, Artificial Sequence
  Description of Artificial Sequence: Synthetic coding sequence
atggagaacgagcccggcatcgtgagccccttcaagagagtgttcctgaagggcgagaagagcagagacaagaaggcccacgagaaggtgaccgagagaagacccctgcacaccgtggtgctgagcctgcccgagagagtggagcccgacagactgctgagcgactacatcgagaaggaggtgaagtacctgggccagctgaccagcatccccggctacctgaaccccagcagcagaaccgagatcctgcacttcatcgacaacgccaagagagcccaccagctgcccggccacctgacccaggagcacgacgccgtgctgagcctgagcgcctacaacgtgaagctggcctggagagacggcgaggacatcatcctgagagtgcccatccacgacatcgccgccgtgagctacgtgagagacgacgccgcccacctggtggtgctgaagaccgcccaggaccccggcatcagccccagccagagcctgtgcgccgagagcagcagaggcctgagcgccggcagcctgagcgagagcgccgtgggccccgtggaggcctgctgcctggtgatcctggccgccgagagcaaggtggccgccgaggagctgtgctgcctgctgggccaggtgttccaggtggtgtacaccgagagcaccatcgacttcctggacagagccatcttcgacggcgccagcacccccacccaccacctgagcctgcacagcgacgacagcagcaccaaggtggacatcaaggagacctacgaggtggaggccagcaccttctgcttccccgagagcgtggacgtgggcggcgccagcccccacagcaagaccatcagcgagagcgagctgagcgccagcgccaccgagctgctgcaggactacatgctgaccctgagaaccaagctgagcagccaggagatccagcagttcgccgccctgctgcacgagtacagaaacggcgccagcatccacgagttctgcatcaacctgagacagctgtacggcgacagcagaaagttcctgctgctgggcctgagacccttcatccccgagaaggacagccagcacttcgagaacttcctggagaccatcggcgtgaaggacggcagaggcatcatcaccgacagcttcggcagacacagaagagccctgagcaccaccagcagcagcaccaccaacggcaacagagccaccggcagcagcgacgacagaagcgcccccagcgagggcgacgagtgggacagaatgatcagcgacatcagcagcgacatcgaggccctgggctgcagcatggaccaggacagcgcctag

SEQ ID NO: 76323 - DNA, 1161 bp, Artificial Sequence
  Description of Artificial Sequence: Synthetic coding sequence
atggaggaggagggcaagaagggcaagaagtacctgggccagctgaccagcatccccggctacctgaaccccagcagcagaaccgagatcctgcacttcatcgacaacgccaagagagcccaccagctgcccggccacctgacccaggagcacgacgccgtgctgagcctgagcgcctacaacgtgaagctggcctggagagacggcgaggacatcatcctgagagtgcccatccacgacatcgccgccgtgagctacgtgagagacgacgccgcccacctggtggtgctgaagaccgcccaggaccccggcatcagccccagccagagcctgtgcgccgagagcagcagaggcctgagcgccggcagcctgagcgagagcgccgtgggccccgtggaggcctgctgcctggtgatcctggccgccgagagcaaggtggccgccgaggagctgtgctgcctgctgggccaggtgttccaggtggtgtacaccgagagcaccatcgacttcctggacagagccatcttcgacggcgccagcacccccacccaccacctgagcctgcacagcgacgacagcagcaccaaggtggacatcaaggagacctacgaggtggaggccagcaccttctgcttccccgagagcgtggacgtgggcggcgccagcccccacagcaagaccatcagcgagagcgagctgagcgccagcgccaccgagctgctgcaggactacatgctgaccctgagaaccaagctgagcagccaggagatccagcagttcgccgccctgctgcacgagtacagaaacggcgccagcatccacgagttctgcatcaacctgagacagctgtacggcgacagcagaaagttcctgctgctgggcctgagacccttcatccccgagaaggacagccagcacttcgagaacttcctggagaccatcggcgtgaaggacggcagaggcatcatcaccgacagcttcggcagacacagaagagccctgagcaccaccagcagcagcaccaccaacggcaacagagccaccggcagcagcgacgacagaagcgcccccagcgagggcgacgagtgggacagaatgatcagcgacatcagcagcgacatcgaggccctgggctgcagcatggaccaggacagcgcctag

SEQ ID NO: 76324 - DNA, 216 bp, Artificial Sequence
  Description of Artificial Sequence: Synthetic coding sequence
atggaggaggagggcaagaagggcaagaagcccggcatcgtgagccccttcaagagagtgttcctgaagggcgagaagagcagagacaagaaggcccacgagaaggtgaccgagagaagacccctgcacaccgtggtgctgagcctgcccgagagagtggagcccgacagactgctgagcgactacatcgagaaggaggtgaagggcagccactag

SEQ ID NO: 76325 - DNA, 1062 bp, Artificial Sequence
  Description of Artificial Sequence: Synthetic coding sequence
atggaggaggagggcaagaagggcaagaagcccggcatcgtgagccccttcaagagagtgttcctgaagggcgagaagagcagagacaagaaggcccacgagaaggtgaccgagagaagacccctgcacaccgtggtgctgagcctgcccgagagagtggagcccgacagactgctgagcgactacatcgagaaggaggtgaagtacctgggccagctgaccagcatccccggctacctgaaccccagcagcagaaccgagatcctgcacttcatcgacaacgccaagagagcccaccagctgcccggccacctgacccaggagcacgacgccgtgctgagcctgagcgcctacaacgtgaagctggcctggagagacggcgaggacatcatcctgagagtgcccatccacgacatcgccgccgtgagctacgtgagagacgacgccgcccacctggtggtgctgaagaccgacgacagcagcaccaaggtggacatcaaggagacctacgaggtggaggccagcaccttctgcttccccgagagcgtggacgtgggcggcgccagcccccacagcaagaccatcagcgagagcgagctgagcgccagcgccaccgagctgctgcaggactacatgctgaccctgagaaccaagctgagcagccaggagatccagcagttcgccgccctgctgcacgagtacagaaacggcgccagcatccacgagttctgcatcaacctgagacagctgtacggcgacagcagaaagttcctgctgctgggcctgagacccttcatccccgagaaggacagccagcacttcgagaacttcctggagaccatcggcgtgaaggacggcagaggcatcatcaccgacagcttcggcagacacagaagagccctgagcaccaccagcagcagcaccaccaacggcaacagagccaccggcagcagcgacgacagaagcgcccccagcgagggcgacgagtgggacagaatgatcagcgacatcagcagcgacatcgaggccctgggctgcagcatggaccaggacagcgcctag

SEQ ID NO: 76326 - DNA, 1224 bp, Artificial Sequence
  Description of Artificial Sequence: Synthetic coding sequence
atgagaagaaacctgagactgggccccagcagcggcgccgacgcccagggccagggcgcccccagacccggcctggccgcccccagaatgctgctgccccccgccagccaggccagcagaggcagcggcagcaccggctgcagcctgatggcccaggaggtggacaccgcccagggcgccgagatgagaagaggcgccggcgccgccagaggcagagccagctggtgctgggccctggccctgctgtggctggccgtggtgcccggctggagcagagtgagcggcatccccagcagaagacactggcccgtgccctacaagagattcgacttcagacccaagcccgacccctactgccaggccaagtacaccttctgccccaccggcagccccatccccgtgatggagggcgacgacgacatcgaggtgttcagactgcaggcccccgtgtgggagttcaagtacggcgacctgctgggccacctgaagatcatgcacgacgccatcggcttcagaagcaccctgaccggcaagaactacaccatggagtggtacgagctgttccagctgggcaactgcaccttcccccacctgagacccgagatggacgcccccttctggtgcaaccagggcgccgcctgcttcttcgagggcatcgacgacgtgcactggaaggagaacggcaccctggtgcaggtggccaccatcagcggcaacatgttcaaccagatggccaagtgggtgaagcaggacaacgagaccggcatctactacgagacctggaacgtgaaggccagccccgagaagggcgccgagacctggttcgacagctacgactgcagcaagttcgtgctgagaaccttcaacaagctggccgagttcggcgccgagttcaagaacatcgagaccaactacaccagaatcttcctgtacagcggcgagcccacctacctgggcaacgagaccagcgtgttcggccccaccggcaacaagaccctgggcctggccatcaagagattctactaccccttcaagccccacctgcccaccaaggagttcctgctgagcctgctgcagatcttcgacgccgtgatcgtgcacaagcagttctacctgttctacaacttcgagtactggttcctgcccatgaagttccccttcatcaagatcacctacgaggagatccccctgcccatcagaaacaagaccctgagcggcctgtag

SEQ ID NO: 76327 - DNA, 822 bp, Artificial Sequence
  Description of Artificial Sequence: Synthetic coding sequence
atggagggcgacgacgacatcgaggtgttcagactgcaggcccccgtgtgggagttcaagtacggcgacctgctgggccacctgaagatcatgcacgacgccatcggcttcagaagcaccctgaccggcaagaactacaccatggagtggtacgagctgttccagctgggcaactgcaccttcccccacctgagacccgagatggacgcccccttctggtgcaaccagggcgccgcctgcttcttcgagggcatcgacgacgtgcactggaaggagaacggcaccctggtgcaggtggccaccatcagcggcaacatgttcaaccagatggccaagtgggtgaagcaggacaacgagaccggcatctactacgagacctggaacgtgaaggccagccccgagaagggcgccgagacctggttcgacagctacgactgcagcaagttcgtgctgagaaccttcaacaagctggccgagttcggcgccgagttcaagaacatcgagaccaactacaccagaatcttcctgtacagcggcgagcccacctacctgggcaacgagaccagcgtgttcggccccaccggcaacaagaccctgggcctggccatcaagagattctactaccccttcaagccccacctgcccaccaaggagttcctgctgagcctgctgcagatcttcgacgccgtgatcgtgcacaagcagttctacctgttctacaacttcgagtactggttcctgcccatgaagttccccttcatcaagatcacctacgaggagatccccctgcccatcagaaacaagaccctgagcggcctgtag

SEQ ID NO: 76328 - DNA, 1077 bp, Artificial Sequence
  Description of Artificial Sequence: Synthetic coding sequence
atggcccaggaggtggacaccgcccagggcgccgagatgagaagaggcgccggcgccgccagaggcagagccagctggtgctgggccctggccctgctgtggctggccgtggtgcccggctggagcagagtgagcggcatccccagcagaagacactggcccgtgccctacaagagattcgacttcagacccaagcccgacccctactgccaggccaagtacaccttctgccccaccggcagccccatccccgtgatggagggcgacgacgacatcgaggtgttcagactgcaggcccccgtgtgggagttcaagtacggcgacctgctgggccacctgaagatcatgcacgacgccatcggcttcagaagcaccctgaccggcaagaactacaccatggagtggtacgagctgttccagctgggcaactgcaccttcccccacctgagacccgagatggacgcccccttctggtgcaaccagggcgccgcctgcttcttcgagggcatcgacgacgtgcactggaaggagaacggcaccctggtgcaggtggccaccatcagcggcaacatgttcaaccagatggccaagtgggtgaagcaggacaacgagaccggcatctactacgagacctggaacgtgaaggccagccccgagaagggcgccgagacctggttcgacagctacgactgcagcaagttcgtgctgagaaccttcaacaagctggccgagttcggcgccgagttcaagaacatcgagaccaactacaccagaatcttcctgtacagcggcgagcccacctacctgggcaacgagaccagcgtgttcggccccaccggcaacaagaccctgggcctggccatcaagagattctactaccccttcaagccccacctgcccaccaaggagttcctgctgagcctgctgcagatcttcgacgccgtgatcgtgcacaagcagttctacctgttctacaacttcgagtactggttcctgcccatgaagttccccttcatcaagatcacctacgaggagatccccctgcccatcagaaacaagaccctgagcggcctgtag

SEQ ID NO: 76329 - DNA, 936 bp, Artificial Sequence
  Description of Artificial Sequence: Synthetic coding sequence
atggaggccaccagaagaagacagcacctgggcgccaccggcggccccggcgcccagctgggcgccagcttcctgcaggccagacacggcagcgtgagcgccgacgaggccgccagaaccgcccccttccacctggacctgtggttctacttcaccctgcagaactgggtgctggacttcggcagacccatcgccatgctggtgttccccctggagtggttccccctgaacaagcccagcgtgggcgactacttccacatggcctacaacgtgatcacccccttcctgctgctgaagctgatcgagagaagccccagaaccctgcccagaagcatcacctacgtgagcatcatcatcttcatcatgggcgccagcatccacctggtgggcgacagcgtgaaccacagactgctgttcagcggctaccagcaccacctgagcgtgagagagaaccccatcatcaagaacctgaagcccgagaccctgatcgacagcttcgagctgctgtactactacgacgagtacctgggccactgcatgtggtacatccccttcttcctgatcctgttcatgtacttcagcggctgcttcaccgccagcaaggccgagagcctgatccccggccccgccctgctgctggtggcccccagcggcctgtactactggtacctggtgaccgagggccagatcttcatcctgttcatcttcaccttcttcgccatgctggccctggtgctgcaccagaagagaaagagactgttcctggacagcaacggcctgttcctgttcagcagcttcgccctgaccctgctgctggtggccctgtgggtggcctggctgtggaacgaccccgtgctgagaaagaagtaccccggcgtgatctacgtgcccgagccctgggccttctacaccctgcacgtgagcagcagacactag

SEQ ID NO: 76330 - DNA, 549 bp, Artificial Sequence
  Description of Artificial Sequence: Synthetic coding sequence
atgagactgcccgccagactgcccagcaccagcaccagcggcagcaccagccactgcagaaccggcttctggaccctgggcgtgcccctgccctgctggtacagcctgagcagcggcttccacagcaccagccccgtgctgggcaccaccagcacctggcccaccaccagcagcagacccttcagctgcagcagcggctgcttcaccgccagcaaggccgagagcctgatccccggccccgccctgctgctggtggcccccagcggcctgtactactggtacctggtgaccgagggccagatcttcatcctgttcatcttcaccttcttcgccatgctggccctggtgctgcaccagaagagaaagagactgttcctggacagcaacggcctgttcctgttcagcagcttcgccctgaccctgctgctggtggccctgtgggtggcctggctgtggaacgaccccgtgctgagaaagaagtaccccggcgtgatctacgtgcccgagccctgggccttctacaccctgcacgtgagcagcagacactag

SEQ ID NO: 76331 - DNA, 1032 bp, Artificial Sequence
  Description of Artificial Sequence: Synthetic coding sequence
atggccgccgtggccggcaaggagagaagagccagaggcagacccagacccgagaccctgggcgccatccccagaagagagggcggcgaggccggcctgagcagagccttcaagcccctggcccaggcccccctgagctgcgagaccagcctgagaaagctgaagttcaagggcaagaagcacggcagcgtgagcgccgacgaggccgccagaaccgcccccttccacctggacctgtggttctacttcaccctgcagaactgggtgctggacttcggcagacccatcgccatgctggtgttccccctggagtggttccccctgaacaagcccagcgtgggcgactacttccacatggcctacaacgtgatcacccccttcctgctgctgaagctgatcgagagaagccccagaaccctgcccagaagcatcacctacgtgagcatcatcatcttcatcatgggcgccagcatccacctggtgggcgacagcgtgaaccacagactgctgttcagcggctaccagcaccacctgagcgtgagagagaaccccatcatcaagaacctgaagcccgagaccctgatcgacagcttcgagctgctgtactactacgacgagtacctgggccactgcatgtggtacatccccttcttcctgatcctgttcatgtacttcagcggctgcttcaccgccagcaaggccgagagcctgatccccggccccgccctgctgctggtggcccccagcggcctgtactactggtacctggtgaccgagggccagatcttcatcctgttcatcttcaccttcttcgccatgctggccctggtgctgcaccagaagagaaagagactgttcctggacagcaacggcctgttcctgttcagcagcttcgccctgaccctgctgctggtggccctgtgggtggcctggctgtggaacgaccccgtgctgagaaagaagtaccccggcgtgatctacgtgcccgagccctgggccttctacaccctgcacgtgagcagcagacactag

SEQ ID NO: 76332 - DNA, 861 bp, Artificial Sequence
  Description of Artificial Sequence: Synthetic coding sequence
atgaaccccgccagcgacggcggcaccagcgagagcatcttcgacctggactacgccagctggggcatcagaagcaccctgatggtggccggcttcgtgttctacctgggcgtgttcgtggtgtgccaccagctgagcagcagcctgaacgccacctacagaagcctggtggccagagagaaggtgttctgggacctggccgccaccagagccgtgttcggcgtgcagagcaccgccgccggcctgtgggccctgctgggcgaccccgtgctgcacgccgacaaggccagaggccagcagaactggtgctggttccacatcaccaccgccaccggcttcttctgcttcgagaacgtggccgtgcacctgagcaacctgatcttcagaaccttcgacctgttcctggtgatccaccacctgttcgccttcctgggcttcctgggctgcctggtgaacctgcaggccggccactacctggccatgaccaccctgctgctggagatgagcacccccttcacctgcgtgagctggatgctgctgaaggccggctggagcgagagcctgttctggaagctgaaccagtggctgatgatccacatgttccactgcagaatggtgctgacctaccacatgtggtgggtgtgcttctggcactgggacggcctggtgagcagcctgtacctgccccacctgaccctgttcctggtgggcctggccctgctgaccctgatcatcaacccctactggacccacaagaagacccagcagctgctgaaccccgtggactggaacttcgcccagcccgaggccaagagcagacccgagggcaacggccagctgctgagaaagaagagaccctag

SEQ ID NO: 76333 - DNA, 1065 bp, Artificial Sequence
  Description of Artificial Sequence: Synthetic coding sequence
atgtacagagagtgggtggtggtgaacgtgttcatgatgctgtacgtgcagctggtgcagggcagcagcaacgagcacggccccgtgaagagaagcagccagagcaccctggagagaagcgagcagcagatcagagccgccagcagcctggaggagctgctgagaatcacccacagcgaggactggaagctgtggagatgcagactgagactgaagagcttcaccagcatggacagcagaagcgccagccacagaagcaccagattcgccgccaccttctacgacatcgagaccctgaaggtgatcgacgaggagtggcagagaacccagtgcagccccagagagacctgcgtggaggtggccagcgagctgggcaagagcaccaacaccttcttcaagcccccctgcgtgaacgtgttcagatgcggcggctgctgcaacgaggagagcctgatctgcatgaacaccagcaccagctacatcagcaagcagctgttcgagatcagcgtgcccctgaccagcgtgcccgagctggtgcccgtgaaggtggccaaccacaccggctgcaagtgcctgcccaccgcccccagacacccctacagcatcatcagaagaagcatccagatccccgaggaggacagatgcagccacagcaagaagctgtgccccatcgacatgctgtgggacagcaacaagtgcaagtgcgtgctgcaggaggagaaccccctggccggcaccgaggaccacagccacctgcaggagcccgccctgtgcggcccccacatgatgttcgacgaggacagatgcgagtgcgtgtgcaagaccccctgccccaaggacctgatccagcaccccaagaactgcagctgcttcgagtgcaaggagagcctggagacctgctgccagaagcacaagctgttccaccccgacacctgcagctgcgaggacagatgccccttccacaccagaccctgcgccagcggcaagaccgcctgcgccaagcactgcagattccccaaggagaagagagccgcccagggcccccacagcagaaagaacccctag

SEQ ID NO: 76334 - DNA, 504 bp, Artificial Sequence
  Description of Artificial Sequence: Synthetic coding sequence
atggagagattcgtggtgaccgccccccccgccagaaacagaagcaagaccgccctgtacgtgacccccctggacagagtgaccgagttcggcggcgagctgcacgaggacggcggcaagctgttctgcaccagctgcaacgtggtgctgaaccacgtgagaaagagcgccatcagcgaccacctgaagagcaagacccacaccaagagaaaggccgagttcgaggagcagaacgtgagaaagaagcagagacccctgaccgccagcctgcagtgcaacagcaccgcccagaccgagaaggtgagcgtgatccaggacttcgtgaagatgtgcctggaggccaacatccccctggagaaggccgaccaccccgccgtgagagccttcctgagcagacacgtgaagaacggcggcagcatccccaagagcgaccagctgagaagagcctacctgcccgacggctacgagaacgagaaccagctgctgaacagccaggactgctag

SEQ ID NO: 76335 - DNA, 504 bp, Artificial Sequence; identical to SEQ ID NO: 76334
  Description of Artificial Sequence: Synthetic coding sequence

SEQ ID NO: 76336 - DNA, 504 bp, Artificial Sequence; identical to SEQ ID NO: 76334
  Description of Artificial Sequence: Synthetic coding sequence

SEQ ID NO: 76337 - DNA, 321 bp, Artificial Sequence
  Description of Artificial Sequence: Synthetic coding sequence
atggagagattcgtggtgaccgccccccccgccagaaacagaagcaagaccgccctgtacgtgacccccctggacagagtgaccgagttcggcggcgagctgcacgaggacggcggcaagctgttctgcaccagctgcaacgtggtgctgaaccacgtgagaaagagcgccatcagcgaccacctgaagagcaagacccacaccaagagaaaggccgagttcgaggagcagaacgtgagaaagaagcagagacccctgaccgccagcctgcagtgcaacagcaccgcccagaccgagaaggtgagcgtgatccaggactag

SEQ ID NO: 76338 - DNA, 504 bp, Artificial Sequence; identical to SEQ ID NO: 76334
  Description of Artificial Sequence: Synthetic coding sequence

SEQ ID NO: 76339 - DNA, 1608 bp, Artificial Sequence
  Description of Artificial Sequence: Synthetic coding sequence
atggccagcctgagcctggcccccgtgaacatcttcaaggccggcgccgacgaggagagagccgagaccgccagactgaccagcttcatcggcgccatcgccatcggcgacctggtgaagagcaccctgggccccaagggcatggacaagatcctgctgagcagcggcagagacgccagcctgatggtgaccaacgacggcgccaccatcctgaagaacatcggcgtggacaaccccgccgccaaggtgctggtggacatgagcagagtgcaggacgacgaggtgggcgacggcaccaccagcgtgaccgtgctggccgccgagctgctgagagaggccgagagcctgatcgccaagaagatccacccccagaccatcatcgccggctggagagaggccaccaaggccgccagagaggccctgctgagcagcgccgtggaccacggcagcgacgaggtgaagttcagacaggacctgatgaacatcgccggcaccaccctgagcagcaagctgctgacccaccacaaggaccacttcaccaagctggccgtggaggccgtgctgagactgaagggcagcggcaacctggaggccatccacatcatcaagaagctgggcggcagcctggccgacagctacctggacgagggcttcctgctggacaagaagatcggcgtgaaccagcccaagagaatcgagaacgccaagatcctgatcgccaacaccggcatggacaccgacaagatcaagatcttcggcagcagagtgagagtggacagcaccgccaaggtggccgagatcgagcacgccgagaaggagaagatgaaggagaaggtggagagaatcctgaagcacggcatcaactgcttcatcaacagacagctgatctacaactaccccgagcagctgttcggcgccgccggcgtgatggccatcgagcacgccgacttcgccggcgtggagagactggccctggtgaccggcggcgagatcgccagcaccttcgaccaccccgagctggtgaagctgggcagctgcaagctgatcgaggaggtgatgatcggcgaggacaagctgatccacttcagcggcgtggccctgggcgaggcctgcaccatcgtgctgagaggcgccacccagcagatcctggacgaggccgagagaagcctgcacgacgccctgtgcgtgctggcccagaccgtgaaggacagcagaaccgtgtacggcggcggctgcagcgagatgctgatggcccacgccgtgacccagctggccaacagaacccccggcaaggaggccgtggccatggagagctacgccaaggccctgagaatgctgcccaccatcatcgccgacaacgccggctacgacagcgccgacctggtggcccagctgagagccgcccacagcgagggcaacaccaccgccggcctggacatgagagagggcaccatcggcgacatggccatcctgggcatcaccgagagcttccaggtgaagagacaggtgctgctgagcgccgccgaggccgccgaggtgatcctgagagtggacaacatcatcaaggccgcccccagaaagagagtgcccgaccaccacccctgctag

SEQ ID NO: 76340 - DNA, 1467 bp, Artificial Sequence
  Description of Artificial Sequence: Synthetic coding sequence
atggacaagatcctgctgagcagcggcagagacgccagcctgatggtgaccaacgacggcgccaccatcctgaagaacatcggcgtggacaaccccgccgccaaggtgctggtggacatgagcagagtgcaggacgacgaggtgggcgacggcaccaccagcgtgaccgtgctggccgccgagctgctgagagaggccgagagcctgatcgccaagaagatccacccccagaccatcatcgccggctggagagaggccaccaaggccgccagagaggccctgctgagcagcgccgtggaccacggcagcgacgaggtgaagttcagacaggacctgatgaacatcgccggcaccaccctgagcagcaagctgctgacccaccacaaggaccacttcaccaagctggccgtggaggccgtgctgagactgaagggcagcggcaacctggaggccatccacatcatcaagaagctgggcggcagcctggccgacagctacctggacgagggcttcctgctggacaagaagatcggcgtgaaccagcccaagagaatcgagaacgccaagatcctgatcgccaacaccggcatggacaccgacaagatcaagatcttcggcagcagagtgagagtggacagcaccgccaaggtggccgagatcgagcacgccgagaaggagaagatgaaggagaaggtggagagaatcctgaagcacggcatcaactgcttcatcaacagacagctgatctacaactaccccgagcagctgttcggcgccgccggcgtgatggccatcgagcacgccgacttcgccggcgtggagagactggccctggtgaccggcggcgagatcgccagcaccttcgaccaccccgagctggtgaagctgggcagctgcaagctgatcgaggaggtgatgatcggcgaggacaagctgatccacttcagcggcgtggccctgggcgaggcctgcaccatcgtgctgagaggcgccacccagcagatcctggacgaggccgagagaagcctgcacgacgccctgtgcgtgctggcccagaccgtgaaggacagcagaaccgtgtacggcggcggctgcagcgagatgctgatggcccacgccgtgacccagctggccaacagaacccccggcaaggaggccgtggccatggagagctacgccaaggccctgagaatgctgcccaccatcatcgccgacaacgccggctacgacagcgccgacctggtggcccagctgagagccgcccacagcgagggcaacaccaccgccggcctggacatgagagagggcaccatcggcgacatggccatcctgggcatcaccgagagcttccaggtgaagagacaggtgctgctgagcgccgccgaggccgccgaggtgatcctgagagtggacaacatcatcaaggccgcccccagaaagagagtgcccgaccaccacccctgctag

SEQ ID NO: 76341 - DNA, 1638 bp, Artificial Sequence
  Description of Artificial Sequence: Synthetic coding sequence
atgatgggccacagacccgtgctggtgctgagccagaacaccaagagagagagcggcagaaaggtgcagagcggcaacatcaacgccgccaagaccatcgccgacatcatcagaacctgcctgggccccaagagcatgatgaagatgctgctggaccccatgggcggcatcgtgatgaccaacgacggcaacgccatcctgagagagatccaggtgcagcaccccgccgccaagagcatgatcgagatcagcagaacccaggacgaggaggtgggcgacggcaccaccagcgtgatcatcctggccggcgagatgctgagcgtggccgagcacttcctggagcagcagatgcaccccaccgtggtgatcagcgcctacagaaaggccctggacgacatgatcagcaccctgaagaagatcagcatccccgtggacatcagcgacagcgacatgatgctgaacatcatcaacagcagcatcaccaccaaggccatcagcagatggagcagcctggcctgcaacatcgccctggacgccgtgaagatggtgcagttcgaggagaacggcagaaaggagatcgacatcaagaagtacgccagagtggagaagatccccggcggcatcatcgaggacagctgcgtgctgagaggcgtgatgatcaacaaggacgtgacccaccccagaatgagaagatacatcaagaaccccagaatcgtgctgctggacagcagcctggagtacaagaagggcgagagccagaccgacatcgagatcaccagagaggaggacttcaccagaatcctgcagatggaggaggagtacatccagcagctgtgcgaggacatcatccagctgaagcccgacgtggtgatcaccgagaagggcatcagcgacctggcccagcactacctgatgagagccaacatcaccgccatcagaagagtgagaaagaccgacaacaacagaatcgccagagcctgcggcgccagaatcgtgagcagacccgaggagctgagagaggacgacgtgggcaccggcgccggcctgctggagatcaagaagatcggcgacgagtacttcaccttcatcaccgactgcaaggaccccaaggcctgcaccatcctgctgagaggcgccagcaaggagatcctgagcgaggtggagagaaacctgcaggacgccatgcaggtgtgcagaaacgtgctgctggacccccagctggtgcccggcggcggcgccagcgagatggccgtggcccacgccctgaccgagaagagcaaggccatgaccggcgtggagcagtggccctacagagccgtggcccaggccctggaggtgatccccagaaccctgatccagaactgcggcgccagcaccatcagactgctgaccagcctgagagccaagcacacccaggagaactgcgagacctggggcgtgaacggcgagaccggcaccctggtggacatgaaggagctgggcatctgggagcccctggccgtgaagctgcagacctacaagaccgccgtggagaccgccgtgctgctgctgagaatcgacgacatcgtgagcggccacaagaagaagggcgacgaccagagcagacagggcggcgcccccgacgccggccaggagtag

SEQ ID NO: 76342 - DNA, 1524 bp, Artificial Sequence
  Description of Artificial Sequence: Synthetic coding sequence
atgatgggccacagacccgtgctggtgctgagccagaacaccaagagagagagcggcagaaaggtgcagagcggcaacatcaacgccgccaagatccaggtgcagcaccccgccgccaagagcatgatcgagatcagcagaacccaggacgaggaggtgggcgacggcaccaccagcgtgatcatcctggccggcgagatgctgagcgtggccgagcacttcctggagcagcagatgcaccccaccgtggtgatcagcgcctacagaaaggccctggacgacatgatcagcaccctgaagaagatcagcatccccgtggacatcagcgacagcgacatgatgctgaacatcatcaacagcagcatcaccaccaaggccatcagcagatggagcagcctggcctgcaacatcgccctggacgccgtgaagatggtgcagttcgaggagaacggcagaaaggagatcgacatcaagaagtacgccagagtggagaagatccccggcggcatcatcgaggacagctgcgtgctgagaggcgtgatgatcaacaaggacgtgacccaccccagaatgagaagatacatcaagaaccccagaatcgtgctgctggacagcagcctggagtacaagaagggcgagagccagaccgacatcgagatcaccagagaggaggacttcaccagaatcctgcagatggaggaggagtacatccagcagctgtgcgaggacatcatccagctgaagcccgacgtggtgatcaccgagaagggcatcagcgacctggcccagcactacctgatgagagccaacatcaccgccatcagaagagtgagaaagaccgacaacaacagaatcgccagagcctgcggcgccagaatcgtgagcagacccgaggagctgagagaggacgacgtgggcaccggcgccggcctgctggagatcaagaagatcggcgacgagtacttcaccttcatcaccgactgcaaggaccccaaggcctgcaccatcctgctgagaggcgccagcaaggagatcctgagcgaggtggagagaaacctgcaggacgccatgcaggtgtgcagaaacgtgctgctggacccccagctggtgcccggcggcggcgccagcgagatggccgtggcccacgccctgaccgagaagagcaaggccatgaccggcgtggagcagtggccctacagagccgtggcccaggccctggaggtgatccccagaaccctgatccagaactgcggcgccagcaccatcagactgctgaccagcctgagagccaagcacacccaggagaactgcgagacctggggcgtgaacggcgagaccggcaccctggtggacatgaaggagctgggcatctgggagcccctggccgtgaagctgcagacctacaagaccgccgtggagaccgccgtgctgctgctgagaatcgacgacatcgtgagcggccacaagaagaagggcgacgaccagagcagacagggcggcgcccccgacgccggccaggagtag

SEQ ID NO: 76343 - DNA, 1503 bp, Artificial Sequence
  Description of Artificial Sequence: Synthetic coding sequence
atgatgaagatgctgctggaccccatgggcggcatcgtgatgaccaacgacggcaacgccatcctgagagagatccaggtgcagcaccccgccgccaagagcatgatcgagatcagcagaacccaggacgaggaggtgggcgacggcaccaccagcgtgatcatcctggccggcgagatgctgagcgtggccgagcacttcctggagcagcagatgcaccccaccgtggtgatcagcgcctacagaaaggccctggacgacatgatcagcaccctgaagaagatcagcatccccgtggacatcagcgacagcgacatgatgctgaacatcatcaacagcagcatcaccaccaaggccatcagcagatggagcagcctggcctgcaacatcgccctggacgccgtgaagatggtgcagttcgaggagaacggcagaaaggagatcgacatcaagaagtacgccagagtggagaagatccccggcggcatcatcgaggacagctgcgtgctgagaggcgtgatgatcaacaaggacgtgacccaccccagaatgagaagatacatcaagaaccccagaatcgtgctgctggacagcagcctggagtacaagaagggcgagagccagaccgacatcgagatcaccagagaggaggacttcaccagaatcctgcagatggaggaggagtacatccagcagctgtgcgaggacatcatccagctgaagcccgacgtggtgatcaccgagaagggcatcagcgacctggcccagcactacctgatgagagccaacatcaccgccatcagaagagtgagaaagaccgacaacaacagaatcgccagagcctgcggcgccagaatcgtgagcagacccgaggagctgagagaggacgacgtgggcaccggcgccggcctgctggagatcaagaagatcggcgacgagtacttcaccttcatcaccgactgcaaggaccccaaggcctgcaccatcctgctgagaggcgccagcaaggagatcctgagcgaggtggagagaaacctgcaggacgccatgcaggtgtgcagaaacgtgctgctggacccccagctggtgcccggcggcggcgccagcgagatggccgtggcccacgccctgaccgagaagagcaaggccatgaccggcgtggagcagtggccctacagagccgtggcccaggccctggaggtgatccccagaaccctgatccagaactgcggcgccagcaccatcagactgctgaccagcctgagagccaagcacacccaggagaactgcgagacctggggcgtgaacggcgagaccggcaccctggtggacatgaaggagctgggcatctgggagcccctggccgtgaagctgcagacctacaagaccgccgtggagaccgccgtgctgctgctgagaatcgacgacatcgtgagcggccacaagaagaagggcgacgaccagagcagacagggcggcgcccccgacgccggccaggagtag

SEQ ID NO: 76344 - DNA, 831 bp, Artificial Sequence
  Description of Artificial Sequence: Synthetic coding sequence
atgtacgagggcgacctggagggccagagcatgaactggaccagcgaggagggcagaggcgacatcatcagaagcggcaccaacatcgacagagcctggcagtgccagaacaccaagagagagagcggcagaaaggtgcagagcggcaacatcaacgccgccaagaccatcgccgacatcatcagaacctgcctgggccccaagagcatgatgaagatgctgctggaccccatgggcggcatcgtgatgaccaacgacggcaacgccatcctgagagagatccaggtgcagcaccccgccgccaagagcatgatcgagatcagcagaacccaggacgaggaggtgggcgacggcaccaccagcgtgatcatcctggccggcgagatgctgagcgtggccgagcacttcctggagcagcagatgcaccccaccgtggtgatcagcgcctacagaaaggccctggacgacatgatcagcaccctgaagaagatcagcatccccgtggacatcagcgacagcgacatgatgctgaacatcatcaacagcagcatcaccaccaaggccatcagcagatggagcagcctggcctgcaacatcgccctggacgccgtgaagatggtgcagttcgaggagaacggcagaaaggagatcgacatcaagaagtacgccagagtggagaagatccccggcggcatcatcgaggacagctgcgtgctgagaggcgtgatgatcaacaaggacgtgacccaccccagaatgagaagatacatcaagaaccccagaatcgtgctgctggacagcagcctggagtacaagaagggcgagagctag

SEQ ID NO: 76345 - DNA, 486 bp, Artificial Sequence
  Description of Artificial Sequence: Synthetic coding sequence
atgatgggccacagacccgtgctggtgctgagccagaacaccaagagagagagcggcagaaaggtgcagagcggcaacatcaacgccgccaagaccatcgccgacatcatcagaacctgcctgggccccaagagcatgatgaagatgctgctggaccccatgggcggcatcgtgatgaccaacgacggcaacgccatcctgagagagatccaggtgcagcaccccgccgccaagagcatgatcgagatcagcagaacccaggacgaggaggtgggcgacggcaccaccagcgtgatcatcctggagagccacagcgtgaccatgctggagtgcggcggcgccatcctggcccactgcaacctgtgcctgcccgccggcgagatgctgagcgtggccgagcacttcctggagcagcagatgcaccccaccgtggtgatcagcgcctacagaaaggccctggacgacatgatcagcaccctgaagtag

SEQ ID NO: 76346 - DNA, 567 bp, Artificial Sequence
  Description of Artificial Sequence: Synthetic coding sequence
atgtacgagggcgacctggagggccagagcatgaactggaccagcgaggagggcagaggcgacatcatcagaagcggcaccaacatcgacagagcctggcagtgccagaacaccaagagagagagcggcagaaaggtgcagagcggcaacatcaacgccgccaagatccaggtgcagcaccccgccgccaagagcatgatcgagatcagcagaacccaggacgaggaggtgggcgacggcaccaccagcgtgatcatcctggccggcgagatgctgagcgtggccgagcacttcctggagcagcagatgcaccccaccgtggtgatcagcgcctacagaaaggccctggacgacatgatcagcaccctgaagaagatcagcatccccgtggacatcagcgacagcgacatgatgctgaacatcatcaacagcagcatcaccaccaaggccatcagcagatggagcagcctggcctgcaacatcgccctggacgccgtgaagatggtgcagttcgaggagaacggcagaaaggagatcgacatcaagaagtacgccagagtggagtag

SEQ ID NO: 76347 - DNA, 1503 bp, Artificial Sequence; identical to SEQ ID NO: 76343
  Description of Artificial Sequence: Synthetic coding sequence

SEQ ID NO: 76348 - DNA, 1620 bp, Artificial Sequence
  Description of Artificial Sequence: Synthetic coding sequence
atgcccgagaacgtggcccccagaagcggcgccaccgccggcgccgccggcggcagaggcaagggcgcctaccaggacagagacaagcccgcccagatcagattcagcaacatcagcgccgccaaggccgtggccgacgccatcagaaccagcctgggccccaagggcatggacaagatgatccaggacggcaagggcgacgtgaccatcaccaacgacggcgccaccatcctgaagcagatgcaggtgctgcaccccgccgccagaatgctggtggagctgagcaaggcccaggacatcgaggccggcgacggcaccaccagcgtggtgatcatcgccggcagcctgctggacagctgcaccaagctgctgcagaagggcatccaccccaccatcatcagcgagagcttccagaaggccctggagaagggcatcgagatcctgaccgacatgagcagacccgtggagctgagcgacagagagaccctgctgaacagcgccaccaccagcctgaacagcaaggtggtgagccagtacagcagcctgctgagccccatgagcgtgaacgccgtgatgaaggtgatcgaccccgccaccgccaccagcgtggacctgagagacatcaagatcgtgaagaagctgggcggcaccatcgacgactgcgagctggtggagggcctggtgctgacccagaaggtgagcaacagcggcatcaccagagtggagaaggccaagatcggcctgatccagttctgcctgagcgcccccaagaccgacatggacaaccagatcgtggtgagcgactacgcccagatggacagagtgctgagagaggagagagcctacatcctgaacctggtgaagcagatcaagaagaccggctgcaacgtgctgctgatccagaagagcatcctgagagacgccctgagcgacctggccctgcacttcctgaacaagatgaagatcatggtgatcaaggacatcgagagagaggacatcgagttcatctgcaagaccatcggcaccaagcccgtggcccacatcgaccagttcaccgccgacatgctgggcagcgccgagctggccgaggaggtgaacctgaacggcagcggcaagctgctgaagatcaccggctgcgccagccccggcaagaccgtgaccatcgtggtgagaggcagcaacaagctggtgatcgaggaggccgagagaagcatccacgacgccctgtgcgtgatcagatgcctggtgaagaagagagccctgatcgccggcggcggcgcccccgagatcgagctggccctgagactgaccgagtacagcagaaccctgagcggcatggagagctactgcgtgagagccttcgccgacgccatggaggtgatccccagcaccctggccgagaacgccggcctgaaccccatcagcaccgtgaccgagctgagaaacagacacgcccagggcgagaagaccgccggcatcaacgtgagaaagggcggcatcagcaacatcctggaggagctggtggtgcagcccctgctggtgagcgtgagcgccctgaccctggccaccgagaccgtgagaagcatcctgaagatcgacgacgtggtgaacaccagatag

SEQ ID NO: 76349 - DNA, 1452 bp, Artificial Sequence
  Description of Artificial Sequence: Synthetic coding sequence
atggacaagatgatccaggacggcaagggcgacgtgaccatcaccaacgacggcgccaccatcctgaagcagatgcaggtgctgcaccccgccgccagaatgctggtggagctgagcaaggcccaggacatcgaggccggcgacggcaccaccagcgtggtgatcatcgccggcagcctgctggacagctgcaccaagctgctgcagaagggcatccaccccaccatcatcagcgagagcttccagaaggccctggagaagggcatcgagatcctgaccgacatgagcagacccgtggagctgagcgacagagagaccctgctgaacagcgccaccaccagcctgaacagcaaggtggtgagccagtacagcagcctgctgagccccatgagcgtgaacgccgtgatgaaggtgatcgaccccgccaccgccaccagcgtggacctgagagacatcaagatcgtgaagaagctgggcggcaccatcgacgactgcgagctggtggagggcctggtgctgacccagaaggtgagcaacagcggcatcaccagagtggagaaggccaagatcggcctgatccagttctgcctgagcgcccccaagaccgacatggacaaccagatcgtggtgagcgactacgcccagatggacagagtgctgagagaggagagagcctacatcctgaacctggtgaagcagatcaagaagaccggctgcaacgtgctgctgatccagaagagcatcctgagagacgccctgagcgacctggccctgcacttcctgaacaagatgaagatcatggtgatcaaggacatcgagagagaggacatcgagttcatctgcaagaccatcggcaccaagcccgtggcccacatcgaccagttcaccgccgacatgctgggcagcgccgagctggccgaggaggtgaacctgaacggcagcggcaagctgctgaagatcaccggctgcgccagccccggcaagaccgtgaccatcgtggtgagaggcagcaacaagctggtgatcgaggaggccgagagaagcatccacgacgccctgtgcgtgatcagatgcctggtgaagaagagagccctgatcgccggcggcggcgcccccgagatcgagctggccctgagactgaccgagtacagcagaaccctgagcggcatggagagctactgcgtgagagccttcgccgacgccatggaggtgatccccagcaccctggccgagaacgccggcctgaaccccatcagcaccgtgaccgagctgagaaacagacacgcccagggcgagaagaccgccggcatcaacgtgagaaagggcggcatcagcaacatcctggaggagctggtggtgcagcccctgctggtgagcgtgagcgccctgaccctggccaccgagaccgtgagaagcatcctgaagatcgacgacgtggtgaacaccagatag

SEQ ID NO: 76350 - DNA, 1530 bp, Artificial Sequence
  Description of Artificial Sequence: Synthetic coding sequence
atgcccgagaacgtggcccccagaagcggcgccaccgccggcgccgccggcggcagaggcaagggcgcctaccaggacagagacaagcccgcccagatcagattcagcaacatcagcgccgccaaggccgtggccgacgccatcagaaccagcctgggccccaagggcatggacaagatgctggtggagctgagcaaggcccaggacatcgaggccggcgacggcaccaccagcgtggtgatcatcgccggcagcctgctggacagctgcaccaagctgctgcagaagggcatccaccccaccatcatcagcgagagcttccagaaggccctggagaagggcatcgagatcctgaccgacatgagcagacccgtggagctgagcgacagagagaccctgctgaacagcgccaccaccagcctgaacagcaaggtggtgagccagtacagcagcctgctgagccccatgagcgtgaacgccgtgatgaaggtgatcgaccccgccaccgccaccagcgtggacctgagagacatcaagatcgtgaagaagctgggcggcaccatcgacgactgcgagctggtggagggcctggtgctgacccagaaggtgagcaacagcggcatcaccagagtggagaaggccaagatcggcctgatccagttctgcctgagcgcccccaagaccgacatggacaaccagatcgtggtgagcgactacgcccagatggacagagtgctgagagaggagagagcctacatcctgaacctggtgaagcagatcaagaagaccggctgcaacgtgctgctgatccagaagagcatcctgagagacgccctgagcgacctggccctgcacttcctgaacaagatgaagatcatggtgatcaaggacatcgagagagaggacatcgagttcatctgcaagaccatcggcaccaagcccgtggcccacatcgaccagttcaccgccgacatgctgggcagcgccgagctggccgaggaggtgaacctgaacggcagcggcaagctgctgaagatcaccggctgcgccagccccggcaagaccgtgaccatcgtggtgagaggcagcaacaagctggtgatcgaggaggccgagagaagcatccacgacgccctgtgcgtgatcagatgcctggtgaagaagagagccctgatcgccggcggcggcgcccccgagatcgagctggccctgagactgaccgagtacagcagaaccctgagcggcatggagagctactgcgtgagagccttcgccgacgccatggaggtgatccccagcaccctggccgagaacgccggcctgaaccccatcagcaccgtgaccgagctgagaaacagacacgcccagggcgagaagaccgccggcatcaacgtgagaaagggcggcatcagcaacatcctggaggagctggtggtgcagcccctgctggtgagcgtgagcgccctgaccctggccaccgagaccgtgagaagcatcctgaagatcgacgacgtggtgaacaccagatag

SEQ ID NO: 76351 - DNA, 1170 bp, Artificial Sequence
  Description of Artificial Sequence: Synthetic coding sequence
atgagcagacccgtggagctgagcgacagagagaccctgctgaacagcgccaccaccagcctgaacagcaaggtggtgagccagtacagcagcctgctgagccccatgagcgtgaacgccgtgatgaaggtgatcgaccccgccaccgccaccagcgtggacctgagagacatcaagatcgtgaagaagctgggcggcaccatcgacgactgcgagctggtggagggcctggtgctgacccagaaggtgagcaacagcggcatcaccagagtggagaaggccaagatcggcctgatccagttctgcctgagcgcccccaagaccgacatggacaaccagatcgtggtgagcgactacgcccagatggacagagtgctgagagaggagagagcctacatcctgaacctggtgaagcagatcaagaagaccggctgcaacgtgctgctgatccagaagagcatcctgagagacgccctgagcgacctggccctgcacttcctgaacaagatgaagatcatggtgatcaaggacatcgagagagaggacatcgagttcatctgcaagaccatcggcaccaagcccgtggcccacatcgaccagttcaccgccgacatgctgggcagcgccgagctggccgaggaggtgaacctgaacggcagcggcaagctgctgaagatcaccggctgcgccagccccggcaagaccgtgaccatcgtggtgagaggcagcaacaagctggtgatcgaggaggccgagagaagcatccacgacgccctgtgcgtgatcagatgcctggtgaagaagagagccctgatcgccggcggcggcgcccccgagatcgagctggccctgagactgaccgagtacagcagaaccctgagcggcatggagagctactgcgtgagagccttcgccgacgccatggaggtgatccccagcaccctggccgagaacgccggcctgaaccccatcagcaccgtgaccgagctgagaaacagacacgcccagggcgagaagaccgccggcatcaacgtgagaaagggcggcatcagcaacatcctggaggagctggtggtgcagcccctgctggtgagcgtgagcgccctgaccctggccaccgagaccgtgagaagcatcctgaagatcgacgacgtggtgaacaccagatag

SEQ ID NO: 76352 - DNA, 1626 bp, Artificial Sequence
  Description of Artificial Sequence: Synthetic coding sequence
atggccagcatgggcaccctggccttcgacgagtacggcagacccttcctgatcatcaaggaccaggacagaaagagcagactgatgggcctggaggccctgaagagccacatcatggccgccaaggccgtggccaacaccatgagaaccagcctgggccccaacggcctggacaagatgatggtggacaaggacggcgacgtgaccgtgaccaacgacggcgccaccatcctgagcatgatggacgtggaccaccagatcgccaagctgatggtggagctgagcaagagccaggacgacgagatcggcgacggcaccaccggcgtggtggtgctggccggcgccctgctggaggaggccgagcagctgctggacagaggcatccaccccatcagaatcgccgacggctacgagcaggccgccagagtggccatcgagcacctggacaagatcagcgacagcgtgctggtggacatcaaggacaccgagcccctgatccagaccgccaagaccaccctgggcagcaaggtggtgaacagctgccacagacagatggccgagatcgccgtgaacgccgtgctgaccgtggccgacatggagagaagagacgtggacttcgagctgatcaaggtggagggcaaggtgggcggcagactggaggacaccaagctgatcaagggcgtgatcgtggacaaggacttcagccacccccagatgcccaagaaggtggaggacgccaagatcgccatcctgacctgccccttcgagccccccaagcccaagaccaagcacaagctggacgtgaccagcgtggaggactacaaggccctgcagaagtacgagaaggagaagttcgaggagatgatccagcagatcaaggagaccggcgccaacctggccatctgccagtggggcttcgacgacgaggccaaccacctgctgctgcagaacaacctgcccgccgtgagatgggtgggcggccccgagatcgagctgatcgccatcgccaccggcggcagaatcgtgcccagattcagcgagctgaccgccgagaagctgggcttcgccggcctggtgcaggagatcagcttcggcaccaccaaggacaagatgctggtgatcgagcagtgcaagaacagcagagccgtgaccatcttcatcagaggcggcaacaagatgatcatcgaggaggccaagagaagcctgcacgacgccctgtgcgtgatcagaaacctgatcagagacaacagagtggtgtacggcggcggcgccgccgagatcagctgcgccctggccgtgagccaggaggccgacaagtgccccaccctggagcagtacgccatgagagccttcgccgacgccctggaggtgatccccatggccctgagcgagaacagcggcatgaaccccatccagaccatgaccgaggtgagagccagacaggtgaaggagatgaaccccgccctgggcatcgactgcctgcacaagggcaccaacgacatgaagcagcagcacgtgatcgagaccctgatcggcaagaagcagcagatcagcctggccacccagatggtgagaatgatcctgaagatcgacgacatcagaaagcccggcgagagcgaggagtag

SEQ ID NO: 76353 - DNA, 1545 bp, Artificial Sequence
  Description of Artificial Sequence: Synthetic coding sequence
atggccagcatgggcaccctggccttcgacgagtacggcagacccttcctgatcatcaaggaccaggacagaaagagcagactgatgggcctggaggccctgaagagccacatcatggccgccaaggccgtggccaacaccatgagaaccagcctgggccccaacggcctggacaagatgatggtggacaaggacggcgacgtgaccgtgaccaacgacgagatcggcgacggcaccaccggcgtggtggtgctggccggcgccctgctggaggaggccgagcagctgctggacagaggcatccaccccatcagaatcgccgacggctacgagcaggccgccagagtggccatcgagcacctggacaagatcagcgacagcgtgctggtggacatcaaggacaccgagcccctgatccagaccgccaagaccaccctgggcagcaaggtggtgaacagctgccacagacagatggccgagatcgccgtgaacgccgtgctgaccgtggccgacatggagagaagagacgtggacttcgagctgatcaaggtggagggcaaggtgggcggcagactggaggacaccaagctgatcaagggcgtgatcgtggacaaggacttcagccacccccagatgcccaagaaggtggaggacgccaagatcgccatcctgacctgccccttcgagccccccaagcccaagaccaagcacaagctggacgtgaccagcgtggaggactacaaggccctgcagaagtacgagaaggagaagttcgaggagatgatccagcagatcaaggagaccggcgccaacctggccatctgccagtggggcttcgacgacgaggccaaccacctgctgctgcagaacaacctgcccgccgtgagatgggtgggcggccccgagatcgagctgatcgccatcgccaccggcggcagaatcgtgcccagattcagcgagctgaccgccgagaagctgggcttcgccggcctggtgcaggagatcagcttcggcaccaccaaggacaagatgctggtgatcgagcagtgcaagaacagcagagccgtgaccatcttcatcagaggcggcaacaagatgatcatcgaggaggccaagagaagcctgcacgacgccctgtgcgtgatcagaaacctgatcagagacaacagagtggtgtacggcggcggcgccgccgagatcagctgcgccctggccgtgagccaggaggccgacaagtgccccaccctggagcagtacgccatgagagccttcgccgacgccctggaggtgatccccatggccctgagcgagaacagcggcatgaaccccatccagaccatgaccgaggtgagagccagacaggtgaaggagatgaaccccgccctgggcatcgactgcctgcacaagggcaccaacgacatgaagcagcagcacgtgatcgagaccctgatcggcaagaagcagcagatcagcctggccacccagatggtgagaatgatcctgaagatcgacgacatcagaaagcccggcgagagcgaggagtag

SEQ ID NO: 76354 - DNA, 1563 bp, Artificial Sequence
  Description of Artificial Sequence: Synthetic coding sequence
atgaacagcagcctgggccccaccatcgagaagctgagcgtgagccacatcatggccgccaaggccgtggccaacaccatgagaaccagcctgggccccaacggcctggacaagatgatggtggacaaggacggcgacgtgaccgtgaccaacgacggcgccaccatcctgagcatgatggacgtggaccaccagatcgccaagctgatggtggagctgagcaagagccaggacgacgagatcggcgacggcaccaccggcgtggtggtgctggccggcgccctgctggaggaggccgagcagctgctggacagaggcatccaccccatcagaatcgccgacggctacgagcaggccgccagagtggccatcgagcacctggacaagatcagcgacagcgtgctggtggacatcaaggacaccgagcccctgatccagaccgccaagaccaccctgggcagcaaggtggtgaacagctgccacagacagatggccgagatcgccgtgaacgccgtgctgaccgtggccgacatggagagaagagacgtggacttcgagctgatcaaggtggagggcaaggtgggcggcagactggaggacaccaagctgatcaagggcgtgatcgtggacaaggacttcagccacccccagatgcccaagaaggtggaggacgccaagatcgccatcctgacctgccccttcgagccccccaagcccaagaccaagcacaagctggacgtgaccagcgtggaggactacaaggccctgcagaagtacgagaaggagaagttcgaggagatgatccagcagatcaaggagaccggcgccaacctggccatctgccagtggggcttcgacgacgaggccaaccacctgctgctgcagaacaacctgcccgccgtgagatgggtgggcggccccgagatcgagctgatcgccatcgccaccggcggcagaatcgtgcccagattcagcgagctgaccgccgagaagctgggcttcgccggcctggtgcaggagatcagcttcggcaccaccaaggacaagatgctggtgatcgagcagtgcaagaacagcagagccgtgaccatcttcatcagaggcggcaacaagatgatcatcgaggaggccaagagaagcctgcacgacgccctgtgcgtgatcagaaacctgatcagagacaacagagtggtgtacggcggcggcgccgccgagatcagctgcgccctggccgtgagccaggaggccgacaagtgccccaccctggagcagtacgccatgagagccttcgccgacgccctggaggtgatccccatggccctgagcgagaacagcggcatgaaccccatccagaccatgaccgaggtgagagccagacaggtgaaggagatgaaccccgccctgggcatcgactgcctgcacaagggcaccaacgacatgaagcagcagcacgtgatcgagaccctgatcggcaagaagcagcagatcagcctggccacccagatggtgagaatgatcctgaagatcgacgacatcagaaagcccggcgagagcgaggagtag

SEQ ID NO: 76355 - DNA, 1347 bp, Artificial Sequence
  Description of Artificial Sequence: Synthetic coding sequence
atggccgccaaggccgtggccaacaccatgagaaccagcctgggccccaacgtgctggccggcgccctgctggaggaggccgagcagctgctggacagaggcatccaccccatcagaatcgccgacggctacgagcaggccgccagagtggccatcgagcacctggacaagatcagcgacagcgtgctggtggacatcaaggacaccgagcccctgatccagaccgccaagaccaccctgggcagcaaggtggtgaacagctgccacagacagatggccgagatcgccgtgaacgccgtgctgaccgtggccgacatggagagaagagacgtggacttcgagctgatcaaggtggagggcaaggtgggcggcagactggaggacaccaagctgatcaagggcgtgatcgtggacaaggacttcagccacccccagatgcccaagaaggtggaggacgccaagatcgccatcctgacctgccccttcgagccccccaagcccaagaccaagcacaagctggacgtgaccagcgtggaggactacaaggccctgcagaagtacgagaaggagaagttcgaggagatgatccagcagatcaaggagaccggcgccaacctggccatctgccagtggggcttcgacgacgaggccaaccacctgctgctgcagaacaacctgcccgccgtgagatgggtgggcggccccgagatcgagctgatcgccatcgccaccggcggcagaatcgtgcccagattcagcgagctgaccgccgagaagctgggcttcgccggcctggtgcaggagatcagcttcggcaccaccaaggacaagatgctggtgatcgagcagtgcaagaacagcagagccgtgaccatcttcatcagaggcggcaacaagatgatcatcgaggaggccaagagaagcctgcacgacgccctgtgcgtgatcagaaacctgatcagagacaacagagtggtgtacggcggcggcgccgccgagatcagctgcgccctggccgtgagccaggaggccgacaagtgccccaccctggagcagtacgccatgagagccttcgccgacgccctggaggtgatccccatggccctgagcgagaacagcggcatgaaccccatccagaccatgaccgaggtgagagccagacaggtgaaggagatgaaccccgccctgggcatcgactgcctgcacaagggcaccaacgacatgaagcagcagcacgtgatcgagaccctgatcggcaagaagcagcagatcagcctggccacccagatggtgagaatgatcctgaagatcgacgacatcagaaagcccggcgagagcgaggagtag

SEQ ID NO: 76356 - DNA, 1461 bp, Artificial Sequence
  Description of Artificial Sequence: Synthetic coding sequence
atggccagcatgggcaccctggccttcgacgagtacggcagacccttcctgatcatcaaggaccaggacagaaagagcagactgatgggcctggaggccctgaagagccacatcatggccgccaaggccgtggccaacaccatgagaaccagcctgggccccaacgtgctggccggcgccctgctggaggaggccgagcagctgctggacagaggcatccaccccatcagaatcgccgacggctacgagcaggccgccagagtggccatcgagcacctggacaagatcagcgacagcgtgctggtggacatcaaggacaccgagcccctgatccagaccgccaagaccaccctgggcagcaaggtggtgaacagctgccacagacagatggccgagatcgccgtgaacgccgtgctgaccgtggccgacatggagagaagagacgtggacttcgagctgatcaaggtggagggcaaggtgggcggcagactggaggacaccaagctgatcaagggcgtgatcgtggacaaggacttcagccacccccagatgcccaagaaggtggaggacgccaagatcgccatcctgacctgccccttcgagccccccaagcccaagaccaagcacaagctggacgtgaccagcgtggaggactacaaggccctgcagaagtacgagaaggagaagttcgaggagatgatccagcagatcaaggagaccggcgccaacctggccatctgccagtggggcttcgacgacgaggccaaccacctgctgctgcagaacaacctgcccgccgtgagatgggtgggcggccccgagatcgagctgatcgccatcgccaccggcggcagaatcgtgcccagattcagcgagctgaccgccgagaagctgggcttcgccggcctggtgcaggagatcagcttcggcaccaccaaggacaagatgctggtgatcgagcagtgcaagaacagcagagccgtgaccatcttcatcagaggcggcaacaagatgatcatcgaggaggccaagagaagcctgcacgacgccctgtgcgtgatcagaaacctgatcagagacaacagagtggtgtacggcggcggcgccgccgagatcagctgcgccctggccgtgagccaggaggccgacaagtgccccaccctggagcagtacgccatgagagccttcgccgacgccctggaggtgatccccatggccctgagcgagaacagcggcatgaaccccatccagaccatgaccgaggtgagagccagacaggtgaaggagatgaaccccgccctgggcatcgactgcctgcacaagggcaccaacgacatgaagcagcagcacgtgatcgagaccctgatcggcaagaagcagcagatcagcctggccacccagatggtgagaatgatcctgaagatcgacgacatcagaaagcccggcgagagcgaggagtag

SEQ ID NO: 76357 - DNA, 1512 bp, Artificial Sequence
  Description of Artificial Sequence: Synthetic coding sequence
atggccgccaaggccgtggccaacaccatgagaaccagcctgggccccaacggcctggacaagatgatggtggacaaggacggcgacgtgaccgtgaccaacgacggcgccaccatcctgagcatgatggacgtggaccaccagatcgccaagctgatggtggagctgagcaagagccaggacgacgagatcggcgacggcaccaccggcgtggtggtgctggccggcgccctgctggaggaggccgagcagctgctggacagaggcatccaccccatcagaatcgccgacggctacgagcaggccgccagagtggccatcgagcacctggacaagatcagcgacagcgtgctggtggacatcaaggacaccgagcccctgatccagaccgccaagaccaccctgggcagcaaggtggtgaacagctgccacagacagatggccgagatcgccgtgaacgccgtgctgaccgtggccgacatggagagaagagacgtggacttcgagctgatcaaggtggagggcaaggtgggcggcagactggaggacaccaagctgatcaagggcgtgatcgtggacaaggacttcagccacccccagatgcccaagaaggtggaggacgccaagatcgccatcctgacctgccccttcgagccccccaagcccaagaccaagcacaagctggacgtgaccagcgtggaggactacaaggccctgcagaagtacgagaaggagaagttcgaggagatgatccagcagatcaaggagaccggcgccaacctggccatctgccagtggggcttcgacgacgaggccaaccacctgctgctgcagaacaacctgcccgccgtgagatgggtgggcggccccgagatcgagctgatcgccatcgccaccggcggcagaatcgtgcccagattcagcgagctgaccgccgagaagctgggcttcgccggcctggtgcaggagatcagcttcggcaccaccaaggacaagatgctggtgatcgagcagtgcaagaacagcagagccgtgaccatcttcatcagaggcggcaacaagatgatcatcgaggaggccaagagaagcctgcacgacgccctgtgcgtgatcagaaacctgatcagagacaacagagtggtgtacggcggcggcgccgccgagatcagctgcgccctggccgtgagccaggaggccgacaagtgccccaccctggagcagtacgccatgagagccttcgccgacgccctggaggtgatccccatggccctgagcgagaacagcggcatgaaccccatccagaccatgaccgaggtgagagccagacaggtgaaggagatgaaccccgccctgggcatcgactgcctgcacaagggcaccaacgacatgaagcagcagcacgtgatcgagaccctgatcggcaagaagcagcagatcagcctggccacccagatggtgagaatgatcctgaagatcgacgacatcagaaagcccggcgagagcgaggagtag

SEQ ID NO: 76358 - DNA, 1593 bp, Artificial Sequence
  Description of Artificial Sequence: Synthetic coding sequence
atggccgccatcaaggccgtgaacagcaaggccgaggtggccagagccagagccgccctggccgtgaacatctgcgccgccagaggcctgcaggacgtgctgagaaccaacctgggccccaagggcaccatgaagatgctggtgagcggcgccggcgacatcaagctgaccaaggacggcaacgtgctgctggacgagatgcagatccagcaccccaccgccagcctgatcgccaaggtggccaccgcccaggacgacgtgaccggcgacggcaccaccagcaacgtgctgatcatcggcgagctgctgaagcaggccgacctgtacatcagcgagggcctgcaccccagaatcatcgccgagggcttcgaggccgccaagatcaaggccctggaggtgctggaggaggtgaaggtgaccaaggagatgaagagaaagatcctgctggacgtggccagaaccagcctgcagaccaaggtgcacgccgagctggccgacgtgctgaccgaggtggtggtggacagcgtgctggccgtgagaagacccggctaccccatcgacctgttcatggtggagatcatggagatgaagcacaagctgggcaccgacaccaagctgatccagggcctggtgctggaccacggcgccagacaccccgacatgaagaagagagtggaggacgccttcatcctgatctgcaacgtgagcctggagtacgagaagaccgaggtgaacagcggcttcttctacaagaccgccgaggagaaggagaagctggtgaaggccgagagaaagttcatcgaggacagagtgcagaagatcatcgacctgaaggacaaggtgtgcgcccagagcaacaagggcttcgtggtgatcaaccagaagggcatcgaccccttcagcctggacagcctggccaagcacggcatcgtggccctgagaagagccaagagaagaaacatggagagactgagcctggcctgcggcggcatggccgtgaacagcttcgaggacctgaccgtggactgcctgggccacgccggcctggtgtacgagtacaccctgggcgaggagaagttcaccttcatcgaggagtgcgtgaacccctgcagcgtgaccctgctggtgaagggccccaacaagcacaccctgacccaggtgaaggacgccatcagagacggcctgagagccatcaagaacgccatcgaggacggctgcatggtgcccggcgccggcgccatcgaggtggccatggccgaggccctggtgacctacaagaacagcatcaagggcagagccagactgggcgtgcaggccttcgccgacgccctgctgatcatccccaaggtgctggcccagaacgccggctacgacccccaggagaccctggtgaaggtgcaggccgagcacgtggagagcaagcagctggtgggcgtggacctgaacaccggcgagcccatggtggccgccgacgccggcgtgtgggacaactactgcgtgaagaagcagctgctgcacagctgcaccgtgatcgccaccaacatcctgctggtggacgagatcatgagagccggcatgagcagcctgaagtag

SEQ ID NO: 76359 - DNA, 1482 bp, Artificial Sequence
  Description of Artificial Sequence: Synthetic coding sequence
atggccgccatcaaggccgtgaacagcaaggccgaggtggccagagccagagccgccctggccgtgaacatctgcgccgccagaggcctgcaggacgtgctgagaaccaacctgggccccaagggcaccatgaagatgctggtgagcggcgccggcgacatcaagctgaccaaggacggcaacgtgctgctggacgagatgcagatccagcaccccaccgccagcctgatcgccaaggtggccaccgcccaggacgacgtgaccggcgacggcaccaccagcaacgtgctgatcatcggcgagctgctgaagcaggccgacctgtacatcagcgagggcctgcaccccagaatcatcgccgagggcttcgaggccgccaagatcaaggccctggaggtgctggaggaggtgaaggtgaccaaggagatgaagagaaagatcctgctggacgtggccagaaccagcctgcagaccaaggtgcacgccgagctggccgacgtgctgaccgaggtggtggtggacagcgtgctggccgtgagaagacccggctaccccatcgacctgttcatggtggagatcatggagatgaagcacaagctgggcaccgacaccaaggaggtgaacagcggcttcttctacaagaccgccgaggagaaggagaagctggtgaaggccgagagaaagttcatcgaggacagagtgcagaagatcatcgacctgaaggacaaggtgtgcgcccagagcaacaagggcttcgtggtgatcaaccagaagggcatcgaccccttcagcctggacagcctggccaagcacggcatcgtggccctgagaagagccaagagaagaaacatggagagactgagcctggcctgcggcggcatggccgtgaacagcttcgaggacctgaccgtggactgcctgggccacgccggcctggtgtacgagtacaccctgggcgaggagaagttcaccttcatcgaggagtgcgtgaacccctgcagcgtgaccctgctggtgaagggccccaacaagcacaccctgacccaggtgaaggacgccatcagagacggcctgagagccatcaagaacgccatcgaggacggctgcatggtgcccggcgccggcgccatcgaggtggccatggccgaggccctggtgacctacaagaacagcatcaagggcagagccagactgggcgtgcaggccttcgccgacgccctgctgatcatccccaaggtgctggcccagaacgccggctacgacccccaggagaccctggtgaaggtgcaggccgagcacgtggagagcaagcagctggtgggcgtggacctgaacaccggcgagcccatggtggccgccgacgccggcgtgtgggacaactactgcgtgaagaagcagctgctgcacagctgcaccgtgatcgccaccaacatcctgctggtggacgagatcatgagagccggcatgagcagcctgaagtag

SEQ ID NO: 76360 - DNA, 1458 bp, Artificial Sequence
  Description of Artificial Sequence: Synthetic coding sequence
atggccgccatcaaggccgtgaacagcaaggccgaggtggccagagccagagccgccctggccgtgaacatctgcgccgccagaggcctgcaggacgtgctgagaaccaacctgggccccaagggcaccatgaagatgctggtgagcggcgccggcgacatcaagctgaccaaggacggcaacgtgctgctggacgagatgggcctgcaccccagaatcatcgccgagggcttcgaggccgccaagatcaaggccctggaggtgctggaggaggtgaaggtgaccaaggagatgaagagaaagatcctgctggacgtggccagaaccagcctgcagaccaaggtgcacgccgagctggccgacgtgctgaccgaggtggtggtggacagcgtgctggccgtgagaagacccggctaccccatcgacctgttcatggtggagatcatggagatgaagcacaagctgggcaccgacaccaagctgatccagggcctggtgctggaccacggcgccagacaccccgacatgaagaagagagtggaggacgccttcatcctgatctgcaacgtgagcctggagtacgagaagaccgaggtgaacagcggcttcttctacaagaccgccgaggagaaggagaagctggtgaaggccgagagaaagttcatcgaggacagagtgcagaagatcatcgacctgaaggacaaggtgtgcgcccagagcaacaagggcttcgtggtgatcaaccagaagggcatcgaccccttcagcctggacagcctggccaagcacggcatcgtggccctgagaagagccaagagaagaaacatggagagactgagcctggcctgcggcggcatggccgtgaacagcttcgaggacctgaccgtggactgcctgggccacgccggcctggtgtacgagtacaccctgggcgaggagaagttcaccttcatcgaggagtgcgtgaacccctgcagcgtgaccctgctggtgaagggccccaacaagcacaccctgacccaggtgaaggacgccatcagagacggcctgagagccatcaagaacgccatcgaggacggctgcatggtgcccggcgccggcgccatcgaggtggccatggccgaggccctggtgacctacaagaacagcatcaagggcagagccagactgggcgtgcaggccttcgccgacgccctgctgatcatccccaaggtgctggcccagaacgccggctacgacccccaggagaccctggtgaaggtgcaggccgagcacgtggagagcaagcagctggtgggcgtggacctgaacaccggcgagcccatggtggccgccgacgccggcgtgtgggacaactactgcgtgaagaagcagctgctgcacagctgcaccgtgatcgccaccaacatcctgctggtggacgagatcatgagagccggcatgagcagcctgaagtag

SEQ ID NO: 76361 - DNA, 966 bp, Artificial Sequence
  Description of Artificial Sequence: Synthetic coding sequence
atgaagcccggcttcagccccagaggcggcggcttcggcggcagaggcggcttcggcgacagaggcggcagaggcggcagaggcggcttcggcggcggcagaggcagaggcggcggcttcagaggcagaggcagaggcggcggcggcggcggcggcggcggcggcggcggcggcagaggcggcggcggcttccacagcggcggcaacagaggcagaggcagaggcggcaagagaggcaaccagagcggcaagaacgtgatggtggagccccacagacacgagggcgtgttcatctgcagaggcaaggaggacgccctggtgaccaagaacctggtgcccggcgagagcgtgtacggcgagaagagagtgagcatcagcgagggcgacgacaagatcgagtacagagcctggaaccccttcagaagcaagctggccgccgccatcctgggcggcgtggaccagatccacatcaagcccggcgccaaggtgctgtacctgggcgccgccagcggcaccaccgtgagccacgtgagcgacatcgtgggccccgacggcctggtgtacgccgtggagttcagccacagaagcggcagagacctgatcaacctggccaagaagagaaccaacatcatccccgtgatcgaggacgccagacacccccacaagtacagaatgctgatcgccatggtggacgtgatcttcgccgacgtggcccagcccgaccagaccagaatcgtggccctgaacgcccacaccttcctgagaaacggcggccacttcgtgatcagcatcaaggccaactgcatcgacagcaccgccagcgccgaggccgtgttcgccagcgaggtgaagaagatgcagcaggagaacatgaagccccaggagcagctgaccctggagccctacgagagagaccacgccgtggtggtgggcgtgtacagacccccccccaaggtgaagaactag

SEQ ID NO: 76362 - DNA, 723 bp, Artificial Sequence
  Description of Artificial Sequence: Synthetic coding sequence
atggacgtgcacggcgaggccgccggcgaggccggccaggagggcggcgagggcctgcagggcggcgccggccagagcgaggagggccccagcgccgagaagtgcagagtgtgcccctgcgtgtgcagagagagacacccccaggaggagagaagatgcgagctggccagcgacggcgtgcccagaagaagaagcggcctgcagggcgccgacagctgcgactacgagggcggcgaccaggagtacggccccggcgaccagagccccggccagggccccgagcaccacggccccgccgagggcctgctgagcgacggccaggtgagagccgccggcgccgagcccggcagaccctacatcggcgacggcggcctgcacgagctgggccaccaccccgaccacgccgccggcgccggcggccagccccaccacgccgacagaagaggcgagtggcccggcggcgccggccccgcccagcccgccgccagaggcagactgtgcagaggcagagagctgtgcgcccagcccggcggccccgccgtgaccgaggtgggcagactggaggagctggccgtgcccagaagatgcgccccccccctgcccagagacgtgctggagggcagctgccccctgcccaccgccagctgcctgtgcgccgaccccgccggcctgagacccgccgccaccctgagactgagccccgccagacccgcctggccctag

SEQ ID NO: 76363 - DNA, 591 bp, Artificial Sequence
  Description of Artificial Sequence: Synthetic coding sequence
atggacgacaccctgttccagctgaagttcaccgccaagcagctggagaagctggccaagaaggccgagaaggacagcaaggccgagcaggccaaggtgaagaaggccctgctgcagaagaacgtggagtgcgccagagtgtacgccgagaacgccatcagaaagaagaacgagggcgtgaactggctgagaatggccagcagagtggacgccgtggccagcaaggtgcagaccgccgtgaccatgaagggcgtgaccaagaacatggcccaggtgaccaaggccctggacaaggccctgagcaccatggacctgcagaaggtgagcagcgtgatggacagattcgagcagcaggtgcagaacctggacgtgcacaccagcgtgatggaggacagcatgagcagcgccaccaccctgaccaccccccaggagcaggtggacagcctgatcatgcagatcgccgaggagaacggcctggaggtgctggaccagctgagccagctgcccgagggcgccagcgccgtgggcgagagcagcgtgagaagccaggaggaccagctgagcagaagactggccgccctgagaaactag

SEQ ID NO: 76364 - DNA, 600 bp, Artificial Sequence
  Description of Artificial Sequence: Synthetic coding sequence
atgagcaacatggagaagcacctgttcaacctgaagttcgccgccaaggagctgagcagaagcgccaagaagtgcgacaaggaggagaaggccgagaaggccaagatcaagaaggccatccagaagggcaacatggaggtggccagaatccacgccgagaacgccatcagacagaagaaccaggccgtgaacttcctgagaatgagcgccagagtggacgccgtggccgccagagtgcagaccgccgtgaccatgggcaaggtgaccaagagcatggccggcgtggtgaagagcatggacgccaccctgaagaccatgaacctggagaagatcagcgccctgatggacaagttcgagcaccagttcgagaccctggacgtgcagacccagcagatggaggacaccatgagcagcaccaccaccctgaccaccccccagaaccaggtggacatgctgctgcaggagatggccgacgaggccggcctggacctgaacatggagctgccccagggccagaccggcagcgtgggcaccagcgtggccagcgccgagcaggacgagctgagccagagactggccagactgagagaccaggtgtag

SEQ ID NO: 76365 - DNA, 669 bp, Artificial Sequence
  Description of Artificial Sequence: Synthetic coding sequence
atggacctgctgttcggcagaagaaagacccccgaggagctgctgagacagaaccagagagccctgaacagagccatgagagagctggacagagagagacagaagctggagacccaggagaagaagatcatcgccgacatcaagaagatggccaagcagggccagatggacgccgtgagaatcatggccaaggacctggtgagaaccagaagatacgtgagaaagttcgtgctgatgagagccaacatccaggccgtgagcctgaagatccagaccctgaagagcaacaacagcatggcccaggccatgaagggcgtgaccaaggccatgggcaccatgaacagacagctgaagctgccccagatccagaagatcatgatggagttcgagagacaggccgagatcatggacatgaaggaggagatgatgaacgacgccatcgacgacgccatgggcgacgaggaggacgaggaggagagcgacgccgtggtgagccaggtgctggacgagctgggcctgagcctgaccgacgagctgagcaacctgcccagcaccggcggcagcctgagcgtggccgccggcggcaagaaggccgaggccgccgccagcgccctggccgacgccgacgccgacctggaggagagactgaagaacctgagaagagactag

SEQ ID NO: 76366 - DNA, 669 bp, Artificial Sequence; identical to SEQ ID NO: 76365
  Description of Artificial Sequence: Synthetic coding sequence

SEQ ID NO: 76367 - DNA, 642 bp, Artificial Sequence
  Description of Artificial Sequence: Synthetic coding sequence
atggccagcctgttcaagaagaagaccgtggacgacgtgatcaaggagcagaacagagagctgagaggcacccagagagccatcatcagagacagagccgccctggagaagcaggagaagcagctggagctggagatcaagaagatggccaagatcggcaacaaggaggcctgcaaggtgctggccaagcagctggtgcacctgagaaagcagaagaccagaaccttcgccgtgagcagcaaggtgaccagcatgagcacccagaccaaggtgatgaacagccagatgaagatggccggcgccatgagcaccaccgccaagaccatgcaggccgtgaacaagaagatggacccccagaagaccctgcagaccatgcagaacttccagaaggagaacatgaagatggagatgaccgaggagatgatcaacgacaccctggacgacatcttcgacggcagcgacgacgaggaggagagccaggacatcgtgaaccaggtgctggacgagatcggcatcgagatcagcggcaagatggccaaggcccccagcgccgccagaagcctgcccagcgccagcaccagcaaggccaccatcagcgacgaggagatcgagagacagctgaaggccctgggcgtggactag

SEQ ID NO: 76368 - DNA, 519 bp, Artificial Sequence
  Description of Artificial Sequence: Synthetic coding sequence
atggagctggagatcaagaagatggccaagatcggcaacaaggaggcctgcaaggtgctggccaagcagctggtgcacctgagaaagcagaagaccagaaccttcgccgtgagcagcaaggtgaccagcatgagcacccagaccaaggtgatgaacagccagatgaagatggccggcgccatgagcaccaccgccaagaccatgcaggccgtgaacaagaagatggacccccagaagaccctgcagaccatgcagaacttccagaaggagaacatgaagatggagatgaccgaggagatgatcaacgacaccctggacgacatcttcgacggcagcgacgacgaggaggagagccaggacatcgtgaaccaggtgctggacgagatcggcatcgagatcagcggcaagatggccaaggcccccagcgccgccagaagcctgcccagcgccagcaccagcaaggccaccatcagcgacgaggagatcgagagacagctgaaggccctgggcgtggactag

SEQ ID NO: 76369 - DNA, 669 bp, Artificial Sequence
  Description of Artificial Sequence: Synthetic coding sequence
atgggcctgttcggcaagacccaggagaagccccccaaggagctggtgaacgagtggagcctgaagatcagaaaggagatgagagtggtggacagacagatcagagacatccagagagaggaggagaaggtgaagagaagcgtgaaggacgccgccaagaagggccagaaggacgtgtgcatcgtgctggccaaggagatgatcagaagcagaaaggccgtgagcaagctgtacgccagcaaggcccacatgaacagcgtgctgatgggcatgaagaaccagctggccgtgctgagagtggccggcagcctgcagaagagcaccgaggtgatgaaggccatgcagagcctggtgaagatccccgagatccaggccaccatgagagagctgagcaaggagatgatgaaggccggcatcatcgaggagatgctggaggacaccttcgagagcatggacgaccaggaggagatggaggaggaggccgagatggagatcgacagaatcctgttcgagatcaccgccggcgccctgggcaaggcccccagcaaggtgaccgacgccctgcccgagcccgagccccccggcgccatggccgccagcgaggacgaggaggaggaggaggaggccctggaggccatgcagagcagactggccaccctgagaagctag

SEQ ID NO: 76370 - DNA, 471 bp, Artificial Sequence
  Description of Artificial Sequence: Synthetic coding sequence
atgatcagaagcagaaaggccgtgagcaagctgtacgccagcaaggcccacatgaacagcgtgctgatgggcatgaagaaccagctggccgtgctgagagtggccggcagcctgcagaagagcaccgaggtgatgaaggccatgcagagcctggtgaagatccccgagatccaggccaccatgagagagctgagcaaggagatgatgaaggccggcatcatcgaggagatgctggaggacaccttcgagagcatggacgaccaggaggagatggaggaggaggccgagatggagatcgacagaatcctgttcgagatcaccgccggcgccctgggcaaggcccccagcaaggtgaccgacgccctgcccgagcccgagccccccggcgccatggccgccagcgaggacgaggaggaggaggaggaggccctggaggccatgcagagcagactggccaccctgagaagctag

SEQ ID NO: 76371 - DNA, 756 bp, Artificial Sequence
  Description of Artificial Sequence: Synthetic coding sequence
atggagggcgagctgtacagcgccctgaaggaggaggaggccagcgagagcgtgagcagcaccaacttcagcggcgagatgcacttctacgagctggtggaggacaccaaggacggcatctggctggtgcaggtgaacgagtggagcctgaagatcagaaaggagatgagagtggtggacagacagatcagagacatccagagagaggaggagaaggtgaagagaagcgtgaaggacgccgccaagaagggccagaaggacgtgtgcatcgtgctggccaaggagatgatcagaagcagaaaggccgtgagcaagctgtacgccagcaaggcccacatgaacagcgtgctgatgggcatgaagaaccagctggccgtgctgagagtggccggcagcctgcagaagagcaccgaggtgatgaaggccatgcagagcctggtgaagatccccgagatccaggccaccatgagagagctgagcaaggagatgatgaaggccggcatcatcgaggagatgctggaggacaccttcgagagcatggacgaccaggaggagatggaggaggaggccgagatggagatcgacagaatcctgttcgagatcaccgccggcgccctgggcaaggcccccagcaaggtgaccgacgccctgcccgagcccgagccccccggcgccatggccgccagcgaggacgaggaggaggaggaggaggccctggaggccatgcagagcagactggccaccctgagaagctag

SEQ ID NO: 76372 - DNA, 549 bp, Artificial Sequence
  Description of Artificial Sequence: Synthetic coding sequence
atgggcctgttcggcaagacccaggagaagccccccaaggagctggtgaacgagtggagcctgaagatcagaaaggagatgagagtggtggacagacagatcagagacatccagagagaggaggagaaggtgaagagaagcgtgaaggacgccgccaagaagggccagaaggacgtgtgcatcgtgctggccaaggagatgatcagaagcagaaaggccatgcagagcctggtgaagatccccgagatccaggccaccatgagagagctgagcaaggagatgatgaaggccggcatcatcgaggagatgctggaggacaccttcgagagcatggacgaccaggaggagatggaggaggaggccgagatggagatcgacagaatcctgttcgagatcaccgccggcgccctgggcaaggcccccagcaaggtgaccgacgccctgcccgagcccgagccccccggcgccatggccgccagcgaggacgaggaggaggaggaggaggccctggaggccatgcagagcagactggccaccctgagaagctag

SEQ ID NO: 76373 - DNA, 798 bp, Artificial Sequence
  Description of Artificial Sequence: Synthetic coding sequence
atgagcagaagaagacccgaggacggcctgggcaaggccggcccctgcgtgatgagacaccacccccccagaagcaaggccgaggtgtggagaaccctgagaggcggcggcggcagaggcgagctggccatgagcggcctgggcagactgttcggcaagggcaagaaggagaagggccccacccccgaggaggccatccagaagctgaaggagaccgagaagatcctgatcaagaagcaggagttcctggagcagaagatccagcaggagctgcagaccgccaagaagtacggcaccaagaacaagagagccgccctgcaggccctgagaagaaagaagagattcgagcagcagctggcccagaccgacggcaccctgagcaccctggagttccagagagaggccatcgagaacgccaccaccaacgccgaggtgctgagaaccatggagctggccgcccagagcatgaagaaggcctaccaggacatggacatcgacaaggtggacgagctgatgaccgacatcaccgagcagcaggaggtggcccagcagatcagcgacgccatcagcagacccatgggcttcggcgacgacgtggacgaggacgagctgctggaggagctggaggagctggagcaggaggagctggcccaggagctgctgaacgtgggcgacaaggaggaggagcccagcgtgaagctgcccagcgtgcccagcacccacctgcccgccggccccgcccccaaggtggacgaggacgaggaggccctgaagcagctggccgagtgggtgagctag

SEQ ID NO: 76374 - DNA, 378 bp, Artificial Sequence
  Description of Artificial Sequence: Synthetic coding sequence
atggccggccccagcctggcctgctgcctgctgggcctgctggccctgaccagcgcctgctacatccagaactgccccctgggcggcaagagagccgcccccgacctggacgtgagaaagtgcctgccctgcggccccggcggcaagggcagatgcttcggccccaacatctgctgcgccgaggagctgggctgcttcgtgggcaccgccgaggccctgagatgccaggaggagaactacctgcccagcccctgccagagcggccagaaggcctgcggcagcggcggcagatgcgccgtgctgggcctgtgctgcagccccgacggctgccacgccgaccccgcctgcgacgccgaggccaccttcagccagagatag

SEQ ID NO: 76375 - DNA, 831 bp, Artificial Sequence
  Description of Artificial Sequence: Synthetic coding sequence
atggcccccccccccgcccccctgctggcccccagacccggcgagaccagacccggctgcagaaagcccggcaccgtgagcttcgccgacgtggccgtgtacttcagccccgaggagtggggctgcctgagacccgcccagagagccctgtacagagacgtgatgcaggagacctacggccacctgggcgccctgggcttccccggccccaagcccgccctgatcagctggatggagcaggagagcgaggcctggagccccgccgcccaggaccccgagaagggcgagagactgggcggcgccagaagaggcgacgtgcccaacagaaaggaggaggagcccgaggaggtgcccagagccaagggccccagaaaggcccccgtgaaggagagccccgaggtgctggtggagagaaaccccgaccccgccatcagcgtggcccccgccagagcccagccccccaagaacgccgcctgggaccccaccaccggcgcccagccccccgcccccatccccagcatggacgcccaggccggccagagaagacacgtgtgcaccgactgcggcagaagattcacctaccccagcctgctggtgagccacagaagaatgcacagcggcgagagacccttcccctgccccgagtgcggcatgagattcaagagaaagttcgccgtggaggcccaccagtggatccacagaagctgcagcggcggcagaagaggcagaagacccggcatcagagccgtgcccagagcccccgtgagaggcgacagagacccccccgtgctgttcagacactaccccgacatcttcgaggagtgcggctag

SEQ ID NO: 76376 - DNA, 516 bp, Artificial Sequence
  Description of Artificial Sequence: Synthetic coding sequence
atgaacagactgttcggcaaggccaagcccaaggcccccccccccagcctgaccgactgcatcggcaccgtggacagcagagccgagagcatcgacaagaagatcagcagactggacgccgagctggtgaagtacaaggaccagatcaagaagatgagagagggccccgccaagaacatggtgaagcagaaggccctgagagtgctgaagcagaagagaatgtacgagcagcagagagacaacctggcccagcagagcttcaacatggagcaggccaactacaccatccagagcctgaaggacaccaagaccaccgtggacgccatgaagctgggcgtgaaggagatgaagaaggcctacaagcaggtgaagatcgaccagatcgaggacctgcaggaccagctggaggacatgatggaggacgccaacgagatccaggaggccctgagcagaagctacggcacccccgagctggacgaggacgacctggaggccggctggagcagcggcggctag

SEQ ID NO: 76377 - DNA, 606 bp, Artificial Sequence
  Description of Artificial Sequence: Synthetic coding sequence
atgggcaacctgttcggcagaaagaagcagagcagagtgaccgagcaggacaaggccatcctgcagctgaagcagcagagagacaagctgagacagtaccagaagagaatcgcccagcagctggagagagagagagccctggccagacagctgctgagagacggcagaaaggagagagccaagctgctgctgaagaagaagagataccaggagcagctgctggacagaaccgagaaccagatcagcagcctggaggccatggtgcagagcatcgagttcacccagatcgagatgaaggtgatggagggcctgcagttcggcaacgagtgcctgaacaagatgcaccaggtgatgagcatcgaggaggtggagagaatcctggacgagacccaggaggccgtggagtaccagagacagatcgacgagctgctggccggcagcttcacccaggaggacgaggacgccatcctggaggagctgagcgccatcacccaggagcagatcgagctgcccgaggtgcccagcgagcccctgcccgagaagatccccgagaacgtgcccgtgaaggccagacccagacaggccgagctggtggccgccagctag

SEQ ID NO: 76378 - DNA, 1362 bp, Artificial Sequence
  Description of Artificial Sequence: Synthetic coding sequence
atgtggagccccgagagagaggccgaggcccccgccggcggcgaccccgccggcctgctgccccccgagtgggaggaggacgaggagagaatgagcttcctgttcagcgccttcaagagaagcagagaggtgaacagcaccgactgggacagcaagatgggcttctgggcccccctggtgctgagccacagcagaagacagggcgtggtgagactgagactgagagacctgcaggaggccttccagagaaagggcagcgtgcccctgggcctggccaccgtgctgcaggacctgctgagaagaggcgagctgcagagagagagcgacttcatggccagcgtggacagcagctggatcagctggggcgtgggcgtgttcctgctgaagcccctgaagtggaccctgagcaacatgctgggcgacaacaaggtgcccgccgaggaggtgctggtggccgtggagctgctgaaggagaaggccgaggaggtgtacagactgtaccagaacagccccctgagcagccaccccgtggtggccctgagcgagctgagcaccctgtgcgccaacagctgccccgacgagagaaccttctacctggtgctgctgcagctgcagaaggagaagagagtgaccgtgctggagcagaacggcgagaagatcgtgaagttcgccagaggccccagagccaaggtgagccccgtgaacgacgtggacgtgggcgtgtaccagctgatgcagagcgagcagctgctgagcagaaaggtggagagcctgagccaggaggccgagagatgcaaggaggaggccagaagagcctgcagagccggcaagaagcagctggccctgagaagcctgaaggccaagcagagaaccgagaagagaatcgaggccctgcacgccaagctggacaccgtgcagggcatcctggacagaatctacgccagccagaccgaccagatggtgttcaacgcctaccaggccggcgtgggcgccctgaagctgagcatgaaggacgtgaccgtggagaaggccgagagcctggtggaccagatccaggagctgtgcgacacccaggacgaggtgagccagaccctggccggcggcgtgaccaacggcctggacttcgacagcgaggagctggagaaggagctggacatcctgctgcaggacaccaccaaggagcccctggacctgcccgacaaccccagaaacagacacttcaccaacagcgtgcccaaccccagaatcagcgacgccgagctggaggccgagctggagaagctgagcctgagcgagggcggcctggtgcccagcagcaagagccccaagagacagctggagcccaccctgaagcccctgtag

SEQ ID NO: 76379 - DNA, 1362 bp, Artificial Sequence; identical to SEQ ID NO: 76378
  Description of Artificial Sequence: Synthetic coding sequence

SEQ ID NO: 76380 - DNA, 1992 bp, Artificial Sequence
  Description of Artificial Sequence: Synthetic coding sequence
atggagagacccgaggagggcaagcagagcccccccccccagccctggggcagactgctgagactgggcgccgaggagggcgagccccacgtgctgctgagaaagagagagtggaccatcggcagaagaagaggctgcgacctgagcttccccagcaacaagctggtgagcggcgaccactgcagaatcgtggtggacgagaagagcggccaggtgaccctggaggacaccagcaccagcggcaccgtgatcaacaagctgaaggtggtgaagaagcagacctgccccctgcagaccggcgacgtgatctacctggtgtacagaaagaacgagcccgagcacaacgtggcctacctgtacgagagcctgagcgagaagcagggcatgacccaggagagcttcgaggccaacaaggagaacgtgttccacggcaccaaggacaccagcggcgccggcgccggcagaggcgccgaccccagagtgccccccagcagccccgccacccaggtgtgcttcgaggagccccagcccagcaccagcaccagcgacctgttccccaccgccagcgccagcagcaccgagcccagccccgccggcagagagagaagcagcagctgcggcagcggcggcggcggcatcagccccaagggcagcggccccagcgtggccagcgacgaggtgagcagcttcgccagcgccctgcccgacagaaagaccgccagcttcagcagcctggagccccaggaccaggaggacctggagcccgtgaagaagaagatgagaggcgacggcgacctggacctgaacggccagctgctggtggcccagcccagaagaaacgcccagaccgtgcacgaggacgtgagagccgccgccggcaagcccgacaagatggaggagaccctgacctgcatcatctgccaggacctgctgcacgactgcgtgagcctgcagccctgcatgcacaccttctgcgccgcctgctacagcggctggatggagagaagcagcctgtgccccacctgcagatgccccgtggagagaatctgcaagaaccacatcctgaacaacctggtggaggcctacctgatccagcaccccggcaacagcagaagcgaggaggacgtgcagagcatggacgccagaaacaagatcacccaggacatgctgcagcccaaggtgagaagaagcttcagcgacgaggagggcagcagcgaggacctgctggagctgagcgacgtggacagcgagagcagcgacatcagccagccctacgtggtgtgcagacagtgccccgagtacagaagacaggccgcccagcccccccactgccccgcccccgagggcgagcccggcgccccccaggccctgggcgacgcccccagcaccagcgtgagcctgaccaccgtgcaggactacgtgtgccccctgcagggcagccacgccctgtgcacctgctgcttccagcccatgcccgacagaagagccgagagagagcaggaccccagagtggccccccagcagtgcgccgtgtgcctgcagcccttctgccacctgtactggggctgcaccagaaccggctgctacggctgcctggcccccttctgcgagctgaacctgggcgacaagtgcctggacggcgtgctgaacaacaacagctacgagagcgacatcctgaagaactacctggccaccagaggcctgacctggaagaacatgctgaccgagagcctggtggccctgcagagaggcgtgttcctgctgagcgactacagagtgaccggcgacaccgtgctgtgctactgctgcggcctgagaagcttcagagagctgacctaccagtacagacagaacatccccgccagcgagctgcccgtggccgtgaccagcagacccgactgctactggggcagaaactgcagaacccaggtgaaggcccaccacgccatgaagttcaaccacatctgcgagcagaccagattcaagaactag

SEQ ID NO: 76381 - DNA, 1872 bp, Artificial Sequence
  Description of Artificial Sequence: Synthetic coding sequence
atggagagacccgaggagggcaagcagagcccccccccccagccctggggcagactgctgagactgggcgccgaggagggcgagccccacgtgctgctgagaaagagagagtggaccatcggcagaagaagaggctgcgacctgagcttccccagcaacaagctggtgagcggcgaccactgcagaatcgtggtggacgagaagagcggccaggtgaccctggaggacaccagcaccagcggcaccgtgatcaacaagctgaaggtggtgaagaagcagacctgccccctgcagaccggcgacgtgatctacctggtgtacagaaagaacgagcccgagcacaacgtggcctacctgtacgagagcctgagcgagaagcagggcatgacccaggagagcttcgagatggtgccctgctgcgtggcccaggccggcctgaagctgctgggcagcagcgacccccccaccctggccagccagagcatcgtgatcaccggcagcggcggcggcggcatcagccccaagggcagcggccccagcgtggccagcgacgaggtgagcagcttcgccagcgccctgcccgacagaaagaccgccagcttcagcagcctggagccccaggaccaggaggacctggagcccgtgaagaagaagatgagaggcgacggcgacctggacctgaacggccagctgctggtggcccagcccagaagaaacgcccagaccgtgcacgaggacgtgagagccgccgccggcaagcccgacaagatggaggagaccctgacctgcatcatctgccaggacctgctgcacgactgcgtgagcctgcagccctgcatgcacaccttctgcgccgcctgctacagcggctggatggagagaagcagcctgtgccccacctgcagatgccccgtggagagaatctgcaagaaccacatcctgaacaacctggtggaggcctacctgatccagcaccccgacaagagcagaagcgaggaggacgtgcagagcatggacgccagaaacaagatcacccaggacatgctgcagcccaaggtgagaagaagcttcagcgacgaggagggcagcagcgaggacctgctggagctgagcgacgtggacagcgagagcagcgacatcagccagccctacgtggtgtgcagacagtgccccgagtacagaagacaggccgcccagcccccccactgccccgcccccgagggcgagcccggcgccccccaggccctgggcgacgcccccagcaccagcgtgagcctgaccaccgccgtgcaggactacgtgtgccccctgcagggcagccacgccctgtgcacctgctgcttccagcccatgcccgacagaagagccgagagagagcaggaccccagagtggccccccagcagtgcgccgtgtgcctgcagcccttctgccacctgtactggggctgcaccagaaccggctgctacggctgcctggcccccttctgcgagctgaacctgggcgacaagtgcctggacggcgtgctgaacaacaacagctacgagagcgacatcctgaagaactacctggccaccagaggcctgacctggaagaacatgctgaccgagagcctggtggccctgcagagaggcgtgttcctgctgagcgactacagagtgaccggcgacaccgtgctgtgctactgctgcggcctgagaagcttcagagagctgacctaccagtacagacagaacatccccgccagcgagctgcccgtggccgtgaccagcagacccgactgctactggggcagaaactgcagaacccaggtgaaggcccaccacgccatgaagttcaaccacatctgcgagcagaccagattcaagaactag

SEQ ID NO: 76382 - DNA, 1995 bp, Artificial Sequence
  Description of Artificial Sequence: Synthetic coding sequence
atggagagacccgaggagggcaagcagagcccccccccccagccctggggcagactgctgagactgggcgccgaggagggcgagccccacgtgctgctgagaaagagagagtggaccatcggcagaagaagaggctgcgacctgagcttccccagcaacaagctggtgagcggcgaccactgcagaatcgtggtggacgagaagagcggccaggtgaccctggaggacaccagcaccagcggcaccgtgatcaacaagctgaaggtggtgaagaagcagacctgccccctgcagaccggcgacgtgatctacctggtgtacagaaagaacgagcccgagcacaacgtggcctacctgtacgagagcctgagcgagaagcagggcatgacccaggagagcttcgaggccaacaaggagaacgtgttccacggcaccaaggacaccagcggcgccggcgccggcagaggcgccgaccccagagtgccccccagcagccccgccacccaggtgtgcttcgaggagccccagcccagcaccagcaccagcgacctgttccccaccgccagcgccagcagcaccgagcccagccccgccggcagagagagaagcagcagctgcggcagcggcggcggcggcatcagccccaagggcagcggccccagcgtggccagcgacgaggtgagcagcttcgccagcgccctgcccgacagaaagaccgccagcttcagcagcctggagccccaggaccaggaggacctggagcccgtgaagaagaagatgagaggcgacggcgacctggacctgaacggccagctgctggtggcccagcccagaagaaacgcccagaccgtgcacgaggacgtgagagccgccgccggcaagcccgacaagatggaggagaccctgacctgcatcatctgccaggacctgctgcacgactgcgtgagcctgcagccctgcatgcacaccttctgcgccgcctgctacagcggctggatggagagaagcagcctgtgccccacctgcagatgccccgtggagagaatctgcaagaaccacatcctgaacaacctggtggaggcctacctgatccagcaccccgacaagagcagaagcgaggaggacgtgcagagcatggacgccagaaacaagatcacccaggacatgctgcagcccaaggtgagaagaagcttcagcgacgaggagggcagcagcgaggacctgctggagctgagcgacgtggacagcgagagcagcgacatcagccagccctacgtggtgtgcagacagtgccccgagtacagaagacaggccgcccagcccccccactgccccgcccccgagggcgagcccggcgccccccaggccctgggcgacgcccccagcaccagcgtgagcctgaccaccgccgtgcaggactacgtgtgccccctgcagggcagccacgccctgtgcacctgctgcttccagcccatgcccgacagaagagccgagagagagcaggaccccagagtggccccccagcagtgcgccgtgtgcctgcagcccttctgccacctgtactggggctgcaccagaaccggctgctacggctgcctggcccccttctgcgagctgaacctgggcgacaagtgcctggacggcgtgctgaacaacaacagctacgagagcgacatcctgaagaactacctggccaccagaggcctgacctggaagaacatgctgaccgagagcctggtggccctgcagagaggcgtgttcctgctgagcgactacagagtgaccggcgacaccgtgctgtgctactgctgcggcctgagaagcttcagagagctgacctaccagtacagacagaacatccccgccagcgagctgcccgtggccgtgaccagcagacccgactgctactggggcagaaactgcagaacccaggtgaaggcccaccacgccatgaagttcaaccacatctgcgagcagaccagattcaagaactag

SEQ ID NO: 76383 - DNA, 1959 bp, Artificial Sequence
  Description of Artificial Sequence: Synthetic coding sequence
atggagagacccgaggagggcaagcagagcccccccccccagccctggggcagactgctgagactgggcgccgaggagggcgagccccacgtgctgctgagaaagagagagtggaccatcggcagaagaagaggctgcgacctgagcttccccagcaacaagctggtgagcggcgaccactgcagaatcgtggtggacgagaagagcggccaggtgaccctggaggacaccagcaccagcggcaccgtgatcaacaagctgaaggtggtgaagaagcagacctgccccctgcagaccggcgacgtgatctacctggtgtacagaaagaacgagcccgagcacaacgtggcctacctgtacgagagcctgagcgagaagcagggcatgacccaggagagcttcgacaccagcggcgccggcgccggcagaggcgccgaccccagagtgccccccagcagccccgccacccaggtgtgcttcgaggagccccagcccagcaccagcaccagcgacctgttccccaccgccagcgccagcagcaccgagcccagccccgccggcagagagagaagcagcagctgcggcagcggcggcggcggcatcagccccaagggcagcggccccagcgtggccagcgacgaggtgagcagcttcgccagcgccctgcccgacagaaagaccgccagcttcagcagcctggagccccaggaccaggaggacctggagcccgtgaagaagaagatgagaggcgacggcgacctggacctgaacggccagctgctggtggcccagcccagaagaaacgcccagaccgtgcacgaggacgtgagagccgccgccggcaagcccgacaagatggaggagaccctgacctgcatcatctgccaggacctgctgcacgactgcgtgagcctgcagccctgcatgcacaccttctgcgccgcctgctacagcggctggatggagagaagcagcctgtgccccacctgcagatgccccgtggagagaatctgcaagaaccacatcctgaacaacctggtggaggcctacctgatccagcaccccgacaagagcagaagcgaggaggacgtgcagagcatggacgccagaaacaagatcacccaggacatgctgcagcccaaggtgagaagaagcttcagcgacgaggagggcagcagcgaggacctgctggagctgagcgacgtggacagcgagagcagcgacatcagccagccctacgtggtgtgcagacagtgccccgagtacagaagacaggccgcccagcccccccactgccccgcccccgagggcgagcccggcgccccccaggccctgggcgacgcccccagcaccagcgtgagcctgaccaccgccgtgcaggactacgtgtgccccctgcagggcagccacgccctgtgcacctgctgcttccagcccatgcccgacagaagagccgagagagagcaggaccccagagtggccccccagcagtgcgccgtgtgcctgcagcccttctgccacctgtactggggctgcaccagaaccggctgctacggctgcctggcccccttctgcgagctgaacctgggcgacaagtgcctggacggcgtgctgaacaacaacagctacgagagcgacatcctgaagaactacctggccaccagaggcctgacctggaagaacatgctgaccgagagcctggtggccctgcagagaggcgtgttcctgctgagcgactacagagtgaccggcgacaccgtgctgtgctactgctgcggcctgagaagcttcagagagctgacctaccagtacagacagaacatccccgccagcgagctgcccgtggccgtgaccagcagacccgactgctactggggcagaaactgcagaacccaggtgaaggcccaccacgccatgaagttcaaccacatctgcgagcagaccagattcaagaactag

SEQ ID NO: 76384 - DNA, 672 bp, Artificial Sequence
  Description of Artificial Sequence: Synthetic coding sequence
atggagagacccgaggagggcaagcagagcccccccccccagccctggggcagactgctgagactgggcgccgaggagggcgagccccacgtgctgctgagaaagagagagtggaccatcggcagaagaagaggctgcgacctgagcttccccagcaacaagctggtgagcggcgaccactgcagaatcgtggtggacgagaagagcggccaggtgaccctggaggacaccagcaccagcggcaccgtgatcaacaagctgaaggtggtgaagaagcagacctgccccctgcagaccggcgacgtgatctacctggtgtacagaaagaacgagcccgagcacaacgtggcctacctgtacgagagcctgagcgagaagcagggcatgacccaggagagcttcgacaccagcggcgccggcgccggcagaggcgccgaccccagagtgccccccagcagccccgccacccaggtgtgcttcgaggagccccagcccagcaccagcaccagcgacctgttccccaccgccagcgccagcagcaccgagcccagccccgccggcagagagagaagcagcagctgcggcagcggcggcggcggcatcagccccaagggcagcggccccagcgtggccagcgacgaggtgagcagcttcgccagcgccctgccctag

SEQ ID NO: 76385 - DNA, 1050 bp, Artificial Sequence
  Description of Artificial Sequence: Synthetic coding sequence
atgacccaggagagcttcggcagcggcggcggcggcatcagccccaagggcagcggccccagcgtggccagcgacgaggtgagcagcttcgccagcgccctgcccgacagaaagaccgccagcttcagcagcctggagccccaggaccaggaggacctggagcccgtgaagaagaagatgagaggcgacggcgacctggacctgaacggccagctgctggtggcccagcccagaagaaacgcccagaccgtgcacgaggacgtgagagccgccgccggcaagcccgacaagatggaggagaccctgacctgcatcatctgccaggacctgctgcacgactgcgtgagcctgcagccctgcatgcacaccttctgcgccgcctgctacagcggctggatggagagaagcagcctgtgccccacctgcagatgccccgtggagagaatctgcaagaaccacatcctgaacaacctggtggaggcctacctgatccagcaccccgacaagagcagaagcgaggaggacgtgcagagcatggacgccagaaacaagatcacccaggacatgctgcagcccaaggtgagaagaagcttcagcgacgaggagggcagcagcgaggacctgctggagctgagcgacgtggacagcgagagcagcgacatcagccagccctacgtggtgtgcagacagtgccccgagtacagaagacaggccgcccagcccccccactgccccgcccccgagggcgagcccggcgccccccaggccctgggcgacgcccccagcaccagcgtgagcctgaccaccgccgtgcaggactacgtgtgccccctgcagggcagccacgccctgtgcacctgctgcttccagcccatgcccgacagaagagccgagagagagcaggaccccagagtggccccccagcagtgcgccgtgtgcctgcagcccttctgccacctgtactggggctgcaccagaaccggctgctacggctgcctggcccccttctgcgtgagcggcagacagtgcttccccgccaccagcctgtag

SEQ ID NO: 76386 - DNA, 1719 bp, Artificial Sequence
  Description of Artificial Sequence: Synthetic coding sequence
atggagagacccgaggagggcaagcagagcccccccccccagccctggggcagactgctgagactgggcgccgaggagggcgagccccacgtgctgctgagaaagagagagtggaccatcggcagaagaagaggctgcgacctgagcttccccagcaacaagctggtgagcggcgaccactgcagaatcgtggtggacgagaagagcggccaggtgaccctggaggacaccagcaccagcggcaccgtgatcaacaagctgaaggtggtgaagaagcagacctgccccctgcagaccggcgacgtgatctacctggtgtacagaaagaacgagcccgagcacagaagcggcggcggcggcatcagccccaagggcagcggccccagcgtggccagcgacgaggtgagcagcttcgccagcgccctgcccgacagaaagaccgccagcttcagcagcctggagccccaggaccaggaggacctggagcccgtgaagaagaagatgagaggcgacggcgacctggacctgaacggccagctgctggtggcccagcccagaagaaacgcccagaccgtgcacgaggacgtgagagccgccgccggcaagcccgacaagatggaggagaccctgacctgcatcatctgccaggacctgctgcacgactgcgtgagcctgcagccctgcatgcacaccttctgcgccgcctgctacagcggctggatggagagaagcagcctgtgccccacctgcagatgccccgtggagagaatctgcaagaaccacatcctgaacaacctggtggaggcctacctgatccagcaccccgacaagagcagaagcgaggaggacgtgcagagcatggacgccagaaacaagatcacccaggacatgctgcagcccaaggtgagaagaagcttcagcgacgaggagggcagcagcgaggacctgctggagctgagcgacgtggacagcgagagcagcgacatcagccagccctacgtggtgtgcagacagtgccccgagtacagaagacaggccgcccagcccccccactgccccgcccccgagggcgagcccggcgccccccaggccctgggcgacgcccccagcaccagcgtgagcctgaccaccgccgtgcaggactacgtgtgccccctgcagggcagccacgccctgtgcacctgctgcttccagcccatgcccgacagaagagccgagagagagcaggaccccagagtggccccccagcagtgcgccgtgtgcctgcagcccttctgccacctgtactggggctgcaccagaaccggctgctacggctgcctggcccccttctgcgagctgaacctgggcgacaagtgcctggacggcgtgctgaacaacaacagctacgagagcgacatcctgaagaactacctggccaccagaggcctgacctggaagaacatgctgaccgagagcctggtggccctgcagagaggcgtgttcctgctgagcgactacagagtgaccggcgacaccgtgctgtgctactgctgcggcctgagaagcttcagagagctgacctaccagtacagacagaacatccccgccagcgagctgcccgtggccgtgaccagcagacccgactgctactggggcagaaactgcagaacccaggtgaaggcccaccacgccatgaagttcaaccacatctgcgagcagaccagattcaagaactag

SEQ ID NO: 76387 - DNA, 345 bp, Artificial Sequence
  Description of Artificial Sequence: Synthetic coding sequence
atgagactgctgatcctggccctgctgggcatctgcagcctgaccgcctacatcgtggagggcgtgggcagcgaggtgagcgacaagagaacctgcgtgagcctgaccacccagagactgcccgtgagcagaatcaagacctacaccatcaccgagggcagcctgagagccgtgatcttcatcaccaagagaggcctgaaggtgtgcgccgacccccaggccacctgggtgagagacgtggtgagaagcatggacagaaagagcaacaccagaaacaacatgatccagaccaagcccaccggcacccagcagagcaccaacaccgccgtgaccctgaccggctag

SEQ ID NO: 76388 - DNA, 345 bp, Artificial Sequence
  Description of Artificial Sequence: Synthetic coding sequence
atgagactgctgatcctggccctgctgggcatctgcagcctgaccgcctacatcgtggagggcgtgggcagcgaggtgagccacagaagaacctgcgtgagcctgaccacccagagactgcccgtgagcagaatcaagacctacaccatcaccgagggcagcctgagagccgtgatcttcatcaccaagagaggcctgaaggtgtgcgccgacccccaggccacctgggtgagagacgtggtgagaagcatggacagaaagagcaacaccagaaacaacatgatccagaccaagcccaccggcacccagcagagcaccaacaccgccgtgaccctgaccggctag

SEQ ID NO: 76389 - DNA, 1002 bp, Artificial Sequence
  Description of Artificial Sequence: Synthetic coding sequence
atggagagcagcggcaaccccgagagcaccaccttcttctactacgacctgcagagccagccctgcgagaaccaggcctgggtgttcgccaccctggccaccaccgtgctgtactgcctggtgttcctgctgagcctggtgggcaacagcctggtgctgtgggtgctggtgaagtacgagagcctggagagcctgaccaacatcttcatcctgaacctgtgcctgagcgacctggtgttcgcctgcctgctgcccgtgtggatcagcccctaccactggggctgggtgctgggcgacttcctgtgcaagctgctgaacatgatcttcagcatcagcctgtacagcagcatcttcttcctgaccatcatgaccatccacagatacctgagcgtggtgagccccctgagcaccctgagagtgcccaccctgagatgcagagtgctggtgaccatggccgtgtgggtggccagcatcctgagcagcatcctggacaccatcttccacaaggtgctgagcagcggctgcgactacagcgagctgacctggtacctgaccagcgtgtaccagcacaacctgttcttcctgctgagcctgggcatcatcctgttctgctacgtggagatcctgagaaccctgttcagaagcagaagcaagagaagacacagaaccgtgaagctgatcttcgccatcgtggtggcctacttcctgagctggggcccctacaacttcaccctgttcctgcagaccctgttcagaacccagatcatcagaagctgcgaggccaagcagcagctggagtacgccctgctgatctgcagaaacctggccttcagccactgctgcttcaaccccgtgctgtacgtgttcgtgggcgtgaagttcagaacccacctgaagcacgtgctgagacagttctggttctgcagactgcaggcccccagccccgccagcatcccccacagccccggcgccttcgcctacgagggcgccagcttctactag

SEQ ID NO: 76390 - DNA, 111 bp, Artificial Sequence
  Description of Artificial Sequence: Synthetic coding sequence
atggagagcagcggcaaccccgagagcaccaccttcttctactacgacctgcagagccagccctgcgagaaccaggcctgggtgttcgccaccctggccaccaccgtgtag

SEQ ID NO: 76391 - DNA, 1002 bp, Artificial Sequence; identical to SEQ ID NO: 76389
  Description of Artificial Sequence: Synthetic coding sequence

SEQ ID NO: 76392 - DNA, 300 bp, Artificial Sequence
  Description of Artificial Sequence: Synthetic coding sequence
atgaaggtgagcgccgccctgctgtgcctgctgctgatggccgccaccttcagcccccagggcctggcccagcccgacagcgtgagcatccccatcacctgctgcttcaacgtgatcaacagaaagatccccatccagagactggagagctacaccagaatcaccaacatccagtgccccaaggaggccgtgatcttcaagaccaagagaggcaaggaggtgtgcgccgaccccaaggagagatgggtgagagacagcatgaagcacctggaccagatcttccagaacctgaagccctag

SEQ ID NO: 76393 - DNA, 291 bp, Artificial Sequence
  Description of Artificial Sequence: Synthetic coding sequence
atgcagatcatcaccaccgccctggtgtgcctgctgctggccggcatgtggcccgaggacgtggacagcaagagcatgcaggtgcccttcagcagatgctgcttcagcttcgccgagcaggagatccccctgagagccatcctgtgctacagaaacaccagcagcatctgcagcaacgagggcctgatcttcaagctgaagagaggcaaggaggcctgcgccctggacaccgtgggctgggtgcagagacacagaaagatgctgagacactgccccagcaagagaaagtag

SEQ ID NO: 76394 - DNA, 282 bp, Artificial Sequence
  Description of Artificial Sequence: Synthetic coding sequence
atgaagatcagcgtggccgccatccccttcttcctgctgatcaccatcgccctgggcaccaagaccgagagcagcagcagaggcccctaccaccccagcgagtgctgcttcacctacaccacctacaagatccccagacagagaatcatggactactacgagaccaacagccagtgcagcaagcccggcatcgtgttcatcaccaagagaggccacagcgtgtgcaccaaccccagcgacaagtgggtgcaggactacatcaaggacatgaaggagaactag

SEQ ID NO: 76395 - DNA, 330 bp, Artificial Sequence
  Description of Artificial Sequence: Synthetic coding sequence
atgaagatcagcgtggccgccatccccttcttcctgctgatcaccatcgccctgggcaccaagaccgagagcagcagccagaccggcggcaagcccaaggtggtgaagatccagctgaagctggtgggcggcccctaccaccccagcgagtgctgcttcacctacaccacctacaagatccccagacagagaatcatggactactacgagaccaacagccagtgcagcaagcccggcatcgtgttcatcaccaagagaggccacagcgtgtgcaccaaccccagcgacaagtgggtgcaggactacatcaaggacatgaaggagaactag

SEQ ID NO: 76396 - DNA, 330 bp, Artificial Sequence; identical to SEQ ID NO: 76395
  Description of Artificial Sequence: Synthetic coding sequence

SEQ ID NO: 76397 - DNA, 342 bp, Artificial Sequence
  Description of Artificial Sequence: Synthetic coding sequence
atgaaggtgagcgtggccgccctgagctgcctgatgctggtggccgtgctgggcagccaggcccagttcatcaacgacgccgagaccgagctgatgatgagcaagctgcccctggagaaccccgtggtgctgaacagcttccacttcgccgccgactgctgcaccagctacatcagccagagcatcccctgcagcctgatgaagagctacttcgagaccagcagcgagtgcagcaagcccggcgtgatcttcctgaccaagaagggcagacaggtgtgcgccaagcccagcggccccggcgtgcaggactgcatgaagaagctgaagccctacagcatctag

SEQ ID NO: 76398 - DNA, 186 bp, Artificial Sequence
  Description of Artificial Sequence: Synthetic coding sequence
tgatgcaccagctacatcagccagagcatcccctgcagcctgatgaagagctacttcgagaccagcagcgagtgcagcaagcccggcgtgatcttcctgaccaagaagggcagacaggtgtgcgccaagcccagcggccccggcgtgcaggactgcatgaagaagctgaagccctacagcatctag

SEQ ID NO: 76399 - DNA, 342 bp, Artificial Sequence; identical to SEQ ID NO: 76397
  Description of Artificial Sequence: Synthetic coding sequence

SEQ ID NO: 76400 - DNA, 342 bp, Artificial Sequence; identical to SEQ ID NO: 76397
  Description of Artificial Sequence: Synthetic coding sequence

SEQ ID NO: 76401 - DNA, 363 bp, Artificial Sequence
  Description of Artificial Sequence: Synthetic coding sequence
atgaaggtgagcgaggccgccctgagcctgctggtgctgatcctgatcatcaccagcgccagcagaagccagcccaaggtgcccgagtgggtgaacacccccagcacctgctgcctgaagtactacgagaaggtgctgcccagaagactggtggtgggctacagaaaggccctgaactgccacctgcccgccatcatcttcgtgaccaagagaaacagagaggtgtgcaccaaccccaacgacgactgggtgcaggagtacatcaaggaccccaacctgcccctgctgcccaccagaaacctgagcaccgtgaagatcatcaccgccaagaacggccagccccagctgctgaacagccagtag

SEQ ID NO: 76402 - DNA, 1188 bp, Artificial Sequence
  Description of Artificial Sequence: Synthetic coding sequence
atggcctggagacacctgaagaagagagcccaggacgccgtgatcatcctgggcggcggcggcctgctgttcgccagctacctgatggccaccggcgacgagagattctacgccgagcacctgatgcccaccctgcagggcctgctggaccccgagagcgcccacagactggccgtgagattcaccagcctgggcctgctgcccagagccagattccaggacagcgacatgctggaggtgagagtgctgggccacaagttcagaaaccccgtgggcatcgccgccggcttcgacaagcacggcgaggccgtggacggcctgtacaagatgggcttcggcttcgtggagatcggcagcgtgacccccaagccccaggagggcaaccccagacccagagtgttcagactgcccgaggaccaggccgtgatcaacagatacggcttcaacagccacggcctgagcgtggtggagcacagactgagagccagacagcagaagcaggccaagctgaccgaggacggcctgcccctgggcgtgaacctgggcaagaacaagaccagcgtggacgccgccgaggactacgccgagggcgtgagagtgctgggccccctggccgactacctggtggtgaacgtgagcagccccaacaccgccggcctgagaagcctgcagggcaaggccgagctgagaagactgctgaccaaggtgctgcaggagagagacggcctgagaagagtgcacagacccgccgtgctggtgaagatcgcccccgacctgaccagccaggacaaggaggacatcgccagcgtggtgaaggagctgggcatcgacggcctgatcgtgaccaacaccaccgtgagcagacccgccggcctgcagggcgccctgagaagcgagaccggcggcctgagcggcaagcccctgagagacctgagcacccagaccatcagagagatgtacgccctgacccagggcagagtgcccatcatcggcgtgggcggcgtgagcagcggccaggacgccctggagaagatcagagccggcgccagcctggtgcagctgtacaccgccctgaccttctggggcccccccgtggtgggcaaggtgaagagagagctggaggccctgctgaaggagcagggcttcggcggcgtgaccgacgccatcggcgccgaccacagaagatag

SEQ ID NO: 76403 - DNA, 270 bp, Artificial Sequence
  Description of Artificial Sequence: Synthetic coding sequence
atgaagggcctggccgccgccctgctggtgctggtgtgcaccatggccctgtgcagctgcgcccaggtgggcaccaacaaggagctgtgctgcctggtgtacaccagctggcagatcccccagaagttcatcgtggactacagcgagaccagcccccagtgccccaagcccggcgtgatcctgctgaccaagagaggcagacagatctgcgccgaccccaacaagaagtgggtgcagaagtacatcagcgacctgaagctgaacgcctag

SEQ ID NO: 76404 - DNA, 297 bp, Artificial Sequence
  Description of Artificial Sequence: Synthetic coding sequence
atggccctgctgctggccctgagcctgctggtgctgtggaccagccccgcccccaccctgagcggcaccaacgacgccgaggactgctgcctgagcgtgacccagaagcccatccccggctacatcgtgagaaacttccactacctgctgatcaaggacggctgcagagtgcccgccgtggtgttcaccaccctgagaggcagacagctgtgcgccccccccgaccagccctgggtggagagaatcatccagagactgcagagaaccagcgccaagatgaagagaagaagcagctag

SEQ ID NO: 76405 - DNA, 315 bp, Artificial Sequence
  Description of Artificial Sequence: Synthetic coding sequence
atggccctgctgctggccctgagcctgctggtgctgtggaccagccccgcccccaccctgagcggcaccaacgacgccgaggactgctgcctgagcgtgacccagaagcccatccccggctacatcgtgagaaacttccactacctgctgatcaaggacggctgcagagtgcccgccgtggtgttcaccaccctgagaggcagacagctgtgcgccccccccgaccagccctgggtggagagaatcatccagagactgcagagaaccagcgccaaggccagcctggccctgcccggccccgtgagcagcctgtag

SEQ ID NO: 76406 - DNA, 291 bp, Artificial Sequence
  Description of Artificial Sequence: Synthetic coding sequence
atgtgctgcaccaagagcctgctgctggccgccctgatgagcgtgctgctgctgcacctgtgcggcgagagcgaggccgccagcaacttcgactgctgcctgggctacaccgacagaatcctgcaccccaagttcatcgtgggcttcaccagacagctggccaacgagggctgcgacatcaacgccatcatcttccacaccaagaagaagctgagcgtgtgcgccaaccccaagcagacctgggtgaagtacatcgtgagactgctgagcaagaaggtgaagaacatgtag

SEQ ID NO: 76407 - DNA, 288 bp, Artificial Sequence
  Description of Artificial Sequence: Synthetic coding sequence
atgtgctgcaccaagagcctgctgctggccgccctgatgagcgtgctgctgctgcacctgtgcggcgagagcgaggccagcaacttcgactgctgcctgggctacaccgacagaatcctgcaccccaagttcatcgtgggcttcaccagacagctggccaacgagggctgcgacatcaacgccatcatcttccacaccaagaagaagctgagcgtgtgcgccaaccccaagcagacctgggtgaagtacatcgtgagactgctgagcaagaaggtgaagaacatgtag

SEQ ID NO: 76408 - DNA, 405 bp, Artificial Sequence
  Description of Artificial Sequence: Synthetic coding sequence
atggcccagagcctggccctgagcctgctgatcctggtgctggccttcggcatccccagaacccagggcagcgacggcggcgcccaggactgctgcctgaagtacagccagagaaagatccccgccaaggtggtgagaagctacagaaagcaggagcccagcctgggctgcagcatccccgccatcctgttcctgcccagaaagagaagccaggccgagctgtgcgccgaccccaaggagctgtgggtgcagcagctgatgcagcacctggacaagacccccagcccccagaagcccgcccagggctgcagaaaggacagaggcgccagcaagaccggcaagaagggcaagggcagcaagggctgcaagagaaccgagagaagccagacccccaagggcccctag

SEQ ID NO: 76409 - DNA, 375 bp, Artificial Sequence
  Description of Artificial Sequence: Synthetic coding sequence
atggcccagagcctggccctgagcctgctgatcctggtgctggccttcggcatccccagaacccagggcagcgacggcggcgcccaggactgctgcctgaagtacagccagagaaagatccccgccaaggtggtgagaagctacagaaagcaggagcccagcctgggctgcagcatccccgccatcctgttcctgcccagaaagagaagccaggccgagctgtgcgccgaccccaaggagctgtgggtgcagcagctgatgcagcacctggacaagacccccagcccccagaagcccgcccagggctgcagaaaggacagaggcgccagcaagaccggcaagaagggcaagggcagcaagggctgcaagagatag

SEQ ID NO: 76410 - DNA, 549 bp, Artificial Sequence
  Description of Artificial Sequence: Synthetic coding sequence
atggccgagttccccagcaaggtgagcaccagaaccagcagccccgcccagggcgccgaggccagcgtgagcgccctgagacccgacctgggcttcgtgagaagcagactgggcgccctgatgctgctgcagctggtgctgggcctgctggtgtgggccctgatcgccgacaccccctaccacctgtaccccgcctacggctgggtgatgttcgtggccgtgttcctgtggctggtgaccatcgtgctgttcaacctgtacctgttccagctgcacatgaagctgtacatggtgccctggcccctggtgctgatgatcttcaacatcagcgccaccgtgctgtacatcaccgccttcatcgcctgcagcgccgccgtggacctgaccagcctgagaggcaccagaccctacaaccagagagccgccgccagcttcttcgcctgcctggtgatgatcgcctacggcgtgagcgccttcttcagctaccaggcctggagaggcgtgggcagcaacgccgccaccagccagatggccggcggctacgcctag

SEQ ID NO: 76411 - DNA, 414 bp, Artificial Sequence
  Description of Artificial Sequence: Synthetic coding sequence
atgaaggtgagcgtggccgccctgagctgcctgatgctggtgaccgccctgggcagccaggccagagtgaccaaggacgccgagaccgagttcatgatgagcaagctgcccctggagaaccccgtgctgctggacatgctgtggagaagaaagatcggcccccagatgaccctgagccacgccgccggcttccacgccaccagcgccgactgctgcatcagctacacccccagaagcatcccctgcagcctgctggagagctacttcgagaccaacagcgagtgcagcaagcccggcgtgatcttcctgaccaagaagggcagaagattctgcgccaaccccagcgacaagcaggtgcaggtgtgcgtgagaatgctgaagctggacaccagaatcaagaccagaaagaactag

SEQ ID NO: 76412 - DNA, 363 bp, Artificial Sequence
  Description of Artificial Sequence: Synthetic coding sequence
atgaaggtgagcgtggccgccctgagctgcctgatgctggtgaccgccctgggcagccaggccagagtgaccaaggacgccgagaccgagttcatgatgagcaagctgcccctggagaaccccgtgctgctggacagattccacgccaccagcgccgactgctgcatcagctacacccccagaagcatcccctgcagcctgctggagagctacttcgagaccaacagcgagtgcagcaagcccggcgtgatcttcctgaccaagaagggcagaagattctgcgccaaccccagcgacaagcaggtgcaggtgtgcgtgagaatgctgaagctggacaccagaatcaagaccagaaagaactag

SEQ ID NO: 76413 - DNA, 2862 bp, Artificial Sequence
  Description of Artificial Sequence: Synthetic coding sequence
atggaggagcagggccacagcgagatggagatcatccccagcgagagccacccccacatccagctgctgaagagcaacagagagctgctggtgacccacatcagaaacacccagtgcctggtggacaacctgctgaagaacgactacttcagcgccgaggacgccgagatcgtgtgcgcctgccccacccagcccgacaaggtgagaaagatcctggacctggtgcagagcaagggcgaggaggtgagcgagttcttcctgtacctgctgcagcagctggccgacgcctacgtggacctgagaccctggctgctggagatcggcttcagccccagcctgctgacccagagcaaggtggtggtgaacaccgaccccgtgagcagatacacccagcagctgagacaccacctgggcagagacagcaagttcgtgctgtgctacgcccagaaggaggagctgctgctggaggagatctacatggacaccatcatggagctggtgggcttcagcaacgagagcctgggcagcctgaacagcctggcctgcctgctggaccacaccaccggcatcctgaacgagcagggcgagaccatcttcatcctgggcgacgccggcgtgggcaagagcatgctgctgcagagactgcagagcctgtgggccaccggcagactggacgccggcgtgaagttcttcttccacttcagatgcagaatgttcagctgcttcaaggagagcgacagactgtgcctgcaggacctgctgttcaagcactactgctaccccgagagagaccccgaggaggtgttcgccttcctgctgagattcccccacgtggccctgttcaccttcgacggcctggacgagctgcacagcgacctggacctgagcagagtgcccgacagcagctgcccctgggagcccgcccaccccctggtgctgctggccaacctgctgagcggcaagctgctgaagggcgccagcaagctgctgaccgccagaaccggcatcgaggtgcccagacagttcctgagaaagaaggtgctgctgagaggcttcagccccagccacctgagagcctacgccagaagaatgttccccgagagagccctgcaggacagactgctgagccagctggaggccaaccccaacctgtgcagcctgtgcagcgtgcccctgttctgctggatcatcttcagatgcttccagcacttcagagccgccttcgagggcagcccccagctgcccgactgcaccatgaccctgaccgacgtgttcctgctggtgaccgaggtgcacctgaacagaatgcagcccagcagcctggtgcagagaaacaccagaagccccgtggagaccctgcacgccggcagagacaccctgtgcagcctgggccaggtggcccacagaggcatggagaagagcctgttcgtgttcacccaggaggaggtgcaggccagcggcctgcaggagagagacatgcagctgggcttcctgagagccctgcccgagctgggccccggcggcgaccagcagagctacgagttcttccacctgaccctgcaggccttcttcaccgccttcttcctggtgctggacgacagagtgggcacccaggagctgctgagattcttccaggagtggatgccccccgccggcgccgccaccaccagctgctacccccccttcctgcccttccagtgcctgcagggcagcggccccgccagagaggacctgttcaagaacaaggaccacttccagttcaccaacctgttcctgtgcggcctgctgagcaaggccaagcagaagctgctgagacacctggtgcccgccgccgccctgagaagaaagagaaaggccctgtgggcccacctgttcagcagcctgagaggctacctgaagagcctgcccagagtgcaggtggagagcttcaaccaggtgcaggccatgcccaccttcatctggatgctgagatgcatctacgagacccagagccagaaggtgggccagctggccgccagaggcatctgcgccaactacctgaagctgacctactgcaacgcctgcagcgccgactgcagcgccctgagcttcgtgctgcaccacttccccaagagactggccctggacctggacaacaacaacctgaacgactacggcgtgagagagctgcagccctgcttcagcagactgaccgtgctgagactgagcgtgaaccagatcaccgacggcggcgtgaaggtgctgagcgaggagctgaccaagtacaagatcgtgacctacctgggcctgtacaacaaccagatcaccgacgtgggcgccagatacgtgaccaagatcctggacgagtgcaagggcctgacccacctgaagctgggcaagaacaagatcaccagcgagggcggcaagtacctggccctggccgtgaagaacagcaagagcatcagcgaggtgggcatgtggggcaaccaggtgggcgacgagggcgccaaggccttcgccgaggccctgagaaaccaccccagcctgaccaccctgagcctggccagcaacggcatcagcaccgagggcggcaagagcctggccagagccctgcagcagaacaccagcctggagatcctgtggctgacccagaacgagctgaacgacgaggtggccgagagcctggccgagatgctgaaggtgaaccagaccctgaagcacctgtggctgatccagaaccagatcaccgccaagggcaccgcccagctggccgacgccctgcagagcaacaccggcatcaccgagatctgcctgaacggcaacctgatcaagcccgaggaggccaaggtgtacgaggacgagaagagaatcatctgcttctag

SEQ ID NO: 76414 - DNA, 360 bp, Artificial Sequence
  Description of Artificial Sequence: Synthetic coding sequence
atggccggcctgatgaccatcgtgaccagcctgctgttcctgggcgtgtgcgcccaccacatcatccccaccggcagcgtggtgatccccagcccctgctgcatgttcttcgtgagcaagagaatccccgagaacagagtggtgagctaccagctgagcagcagaagcacctgcctgaaggccggcgtgatcttcaccaccaagaagggccagcagttctgcggcgaccccaagcaggagtgggtgcagagatacatgaagaacctggacgccaagcagaagaaggccagccccagagccagagccgtggccgtgaagggccccgtgcagagataccccggcaaccagaccacctgctag

SEQ ID NO: 76415 - DNA, 450 bp, Artificial Sequence
  Description of Artificial Sequence: Synthetic coding sequence
atgaacctgtggctgctggcctgcctggtggccggcttcctgggcgcctgggcccccgccgtgcacacccagggcgtgttcgaggactgctgcctggcctaccactaccccatcggctgggccgtgctgagaagagcctggacctacagaatccaggaggtgagcggcagctgcaacctgcccgccgccatcttctacctgcccaagagacacagaaaggtgtgcggcaaccccaagagcagagaggtgcagagagccatgaagctgctggacgccagaaacaaggtgttcgccaagctgcaccacaacacccagaccttccagggcccccacgccgtgaagaagctgagcagcggcaacagcaagctgagcagcagcaagttcagcaaccccatcagcagcagcaagagaaacgtgagcctgctgatcagcgccaacagcggcctgtag

SEQ ID NO: 76416 - DNA, 255 bp, Artificial Sequence
  Description of Artificial Sequence: Synthetic coding sequence
atgaacctgtggctgctggcctgcctggtggccggcttcctgggcgcctgggcccccgccgtgcacacccagggcgtgttcgaggactgctgcctggcctaccactaccccatcggctgggccgtgctgagaagagcctggacctacagaatccaggaggtgagcggcagctgcaacctgcccgccgccatcagacccagctgctgcaaggaggtggagttctggaagctgcaggtgatcatcgtgcaggtgtag

SEQ ID NO: 76417 - DNA, 453 bp, Artificial Sequence
  Description of Artificial Sequence: Synthetic coding sequence
atgaacctgtggctgctggcctgcctggtggccggcttcctgggcgcctgggcccccgccgtgcacacccagggcgtgttcgaggactgctgcctggcctaccactaccccatcggctgggccgtgctgagaagagcctggacctacagaatccaggaggtgagcggcagctgcaacctgcccgccgccatcttctacctgcccaagagacacagaaaggtgtgcggcaaccccaagagcagagaggtgcagagagccatgaagctgctggacgccagaaacaaggtgttcgccaagctgcaccacaacacccagaccttccaggccggcccccacgccgtgaagaagctgagcagcggcaacagcaagctgagcagcagcaagttcagcaaccccatcagcagcagcaagagaaacgtgagcctgctgatcagcgccaacagcggcctgtag

SEQ ID NO: 76418 - DNA, 285 bp, Artificial Sequence
  Description of Artificial Sequence: Synthetic coding sequence
atgatgggcctgagcctggccagcgccgtgctgctggccagcctgctgagcctgcacctgggcaccgccaccagaggcagcgacatcagcaagacctgctgcttccagtacagccacaagcccctgccctggacctgggtgagaagctacgagttcaccagcaacagctgcagccagagagccgtgatcttcaccaccaagagaggcaagaaggtgtgcacccaccccagaaagaagtgggtgcagaagtacatcagcctgctgaagacccccaagcagctgtag

SEQ ID NO: 76419 - DNA, 285 bp, Artificial Sequence; identical to SEQ ID NO: 76418
  Description of Artificial Sequence: Synthetic coding sequence

SEQ ID NO: 76420 - DNA, 339 bp, Artificial Sequence
  Description of Artificial Sequence: Synthetic coding sequence
atgaagggcccccccaccttctgcagcctgctgctgctgagcctgctgctgagccccgaccccaccgccgccttcctgctgccccccagcaccgcctgctgcacccagctgtacagaaagcccctgagcgacaagctgctgagaaaggtgatccaggtggagctgcaggaggccgacggcgactgccacctgcaggccttcgtgctgcacctggcccagagaagcatctgcatccacccccagaaccccagcctgagccagtggttcgagcaccaggagagaaagctgcacggcaccctgcccaagctgaacttcggcatgctgagaaagatgggctag

SEQ ID NO: 76421 - DNA, 384 bp, Artificial Sequence
  Description of Artificial Sequence: Synthetic coding sequence
atgcagcagagaggcctggccatcgtggccctggccgtgtgcgccgccctgcacgccagcgaggccatcctgcccatcgccagcagctgctgcaccgaggtgagccaccacatcagcagaagactgctggagagagtgaacatgtgcagaatccagagagccgacggcgactgcgacctggccgccgtgatcctgcacgtgaagagaagaagaatctgcgtgagcccccacaaccacaccgtgaagcagtggatgaaggtgcaggccgccaagaagaacggcaagggcaacgtgtgccacagaaagaagcaccacggcaagagaaacagcaacagagcccaccagggcaagcacgagacctacggccacaagaccccctactag

SEQ ID NO: 76422 - DNA, 384 bp, Artificial Sequence; identical to SEQ ID NO: 76421
  Description of Artificial Sequence: Synthetic coding sequence

SEQ ID NO: 76423 - DNA, 243 bp, Artificial Sequence
  Description of Artificial Sequence: Synthetic coding sequence
atgtgcagaatccagagagccgacggcgactgcgacctggccgccgtgatcctgcacgtgaagagaagaagaatctgcgtgagcccccacaaccacaccgtgaagcagtggatgaaggtgcaggccgccaagaagaacggcaagggcaacgtgtgccacagaaagaagcaccacggcaagagaaacagcaacagagcccaccagggcaagcacgagacctacggccacaagaccccctactag

SEQ ID NO: 76424 - DNA, 354 bp, Artificial Sequence
  Description of Artificial Sequence: Synthetic coding sequence
atgcagcagagaggcctggccatcgtggccctggccgtgtgcgccgccctgcacgccagcgaggccatcctgcccatcgccagcagctgctgcaccgaggtgagccaccacatcagcagaagactgctggagagagtgaacatgtgcagaatccagagagccgacggcgactgcgacctggccgccgtgatgctggagtgcagcgacatgatcagcgcccactacaacctgcacctgcccggcagcaacgacagccccaccagcgccttccaggtggccggcatcaccgccttcatgagcagcgccgaggagagcgtgagcgccagaaccaccatcctgctgagcagcggctag

SEQ ID NO: 76425 - DNA, 282 bp, Artificial Sequence
  Description of Artificial Sequence: Synthetic coding sequence
atgcaggtgagcaccgccgccctggccgtgctgctgtgcaccatggccctgtgcaaccaggtgctgagcgcccccctggccgccgacacccccaccgcctgctgcttcagctacaccagcagacagatcccccagaacttcatcgccgactacttcgagaccagcagccagtgcagcaagcccagcgtgatcttcctgaccaagagaggcagacaggtgtgcgccgaccccagcgaggagtgggtgcagaagtacgtgagcgacctggagctgagcgcctag

SEQ ID NO: 76426 - DNA, 159 bp, Artificial Sequence
  Description of Artificial Sequence: Synthetic coding sequence
atgcaggtgagcaccgccgccctggccgtgctgctgtgcaccatggccctgtgcaaccaggtgctgagcgcccccctgagcagacccagagaggccggcagaagcgtgctgacccccgtgagaagcggcagcagaaacaccagcgtgacctggagctag

SEQ ID NO: 76427 - DNA, 144 bp, Artificial Sequence
  Description of Artificial Sequence: Synthetic coding sequence
atgcaggtgagcaccgccgccctggccgtgctgctgtgcaccatggccctgtgcaaccaggtgctgagcgccccccaggccggcagaagcgtgctgacccccgtgagaagcggcagcagaaacaccagcgtgacctggagctag

SEQ ID NO: 76428 - DNA, 279 bp, Artificial Sequence
  Description of Artificial Sequence: Synthetic coding sequence
atgaagctgtgcgtgaccgtgctgagcctgctgatgctggtggccgccttctgcagccccgccctgagcgcccccatgggcagcgacccccccaccgcctgctgcttcagctacaccgccagaaagctgcccagaaacttcgtggtggactactacgagaccagcagcctgtgcagccagcccgccgtggtgttccagaccaagagaagcaagcaggtgtgcgccgaccccagcgagagctgggtgcaggagtacgtgtacgacctggagctgaactag

SEQ ID NO: 76429 - DNA, 159 bp, Artificial Sequence
  Description of Artificial Sequence: Synthetic coding sequence
atgaagctgtgcgtgaccgtgctgagcctgctgatgctggtggccgccttctgcagccccgccctgagcgcccccaacagcaagcccaaggaggccagcaagagcgtgctgatccccgtgaaccccggcagcagaagcacctgcatgacctggaactag

SEQ ID NO: 76430 - DNA, 159 bp, Artificial Sequence
  Description of Artificial Sequence: Synthetic coding sequence
atgaagctgtgcgtgaccgtgctgagcctgctggtgctggtggccgccttctgcagcctggccctgagcgcccccaacagcaagcccaaggaggccagcaagagcgccctgacccccgtgagccccggcagcagaagcacctgcatgacctggaactag

SEQ ID NO: 76431 - DNA, 207 bp, Artificial Sequence
  Description of Artificial Sequence: Synthetic coding sequence
atgaagctgtgcgtgaccgtgctgagcctgctggtgctggtggccgccttctgcagcctggccctgagcgcccccaccaagagcagcgagtggaagctgcagggcgtgtgcttccagtgctgcagcagaaaggaccccatccaccagagctgccccacctggaccatggtgagacagagaaagatgcccaccaccggcaagggctag

SEQ ID NO: 76432 - DNA, 261 bp, Artificial Sequence
  Description of Artificial Sequence: Synthetic coding sequence
atgaagctgtgcgtgaccgtgctgagcctgctggtgctggtggccgccttctgcagcctggccctgagcgcccccatgggcagcgacccccccaccgcctgctgcttcagctacaccgccagaaagctgcccagaaacttcgtggtggactactacgagaccagcagcctgtgcagccagcccgccgtggtggccgccccccacggcccctggagcggcagaggcagatgcctgccccaggccagagacaaggccagatag

SEQ ID NO: 76433 - DNA, 279 bp, Artificial Sequence
  Description of Artificial Sequence: Synthetic coding sequence
atgaagctgtgcgtgaccgtgctgagcctgctggtgctggtggccgccttctgcagcctggccctgagcgcccccatgggcagcgacccccccaccgcctgctgcttcagctacaccgccagaaagctgcccagaaacttcgtggtggactactacgagaccagcagcctgtgcagccagcccgccgtggtgttccagaccaagagaggcaagcaggtgtgcgccgaccccagcgagagctgggtgcaggagtacgtgtacgacctggagctgaactag

SEQ ID NO: 76434 - DNA, 300 bp, Artificial Sequence
  Description of Artificial Sequence: Synthetic coding sequence
atgaaggtgagcgccgccctgctgtgcctgctgctgatcgccgccaccttcatcccccagggcctggcccagcccgacgccatcaacgcccccgtgacctgctgctacaacttcaccaacagaaagatcagcgtgcagagactggccagctacagaagaatcaccagcagcaagtgccccaaggaggccgtgatcttcaagaccatcgtggccaaggagatctgcgccgaccccaagcagaagtgggtgcaggacagcatggaccacctggacaagcagacccagacccccaagacctag

SEQ ID NO: 76435 - DNA, 330 bp, Artificial Sequence
  Description of Artificial Sequence: Synthetic coding sequence
atgctgaagctgacccccctgcccagcaagatgaaggtgagcgccgccctgctgtgcctgctgctgatggccgccaccttcagcccccagggcctggcccagcccgacagcgtgagcatccccatcacctgctgcttcaacgtgatcaacagaaagatccccatccagagactggagagctacaccagaatcaccaacatccagtgccccaaggaggccgtgatcttcaagaccaagagaggcaaggaggtgtgcgccgaccccaaggagagatgggtgagagacagcatgaagcacctggaccagatcttccagaacctgaagccctag

SEQ ID NO: 76436 - DNA, 1068 bp, Artificial Sequence
  Description of Artificial Sequence: Synthetic coding sequence
atggagacccccaacaccaccgaggactacgacaccaccaccgagttcgactacggcgacgccaccccctgccagaaggtgaacgagagagccttcggcgcccagctgctgccccccctgtacagcctggtgttcgtgatcggcctggtgggcaacatcctggtggtgctggtgctggtgcagtacaagagactgaagaacatgaccagcatctacctgctgaacctggccatcagcgacctgctgttcctgttcaccctgcccttctggatcgactacaagctgaaggacgactgggtgttcggcgacgccatgtgcaagatcctgagcggcttctactacaccggcctgtacagcgagatcttcttcatcatcctgctgaccatcgacagatacctggccatcgtgcacgccgtgttcgccctgagagccagaaccgtgaccttcggcgtgatcaccagcatcatcatctgggccctggccatcctggccagcatgcccggcctgtacttcagcaagacccagtgggagttcacccaccacacctgcagcctgcacttcccccacgagagcctgagagagtggaagctgttccaggccctgaagctgaacctgttcggcctggtgctgcccctgctggtgatgatcatctgctacaccggcatcatcaagatcctgctgagaagacccaacgagaagaagagcaaggccgtgagactgatcttcgtgatcatgatcatcttcttcctgttctggaccccctacaacctgaccatcctgatcagcgtgttccaggacttcctgttcacccacgagtgcgagcagagcagacacctggacctggccgtgcaggtgaccgaggtgatcgcctacacccactgctgcgtgaaccccgtgatctacgccttcgtgggcgagagattcagaaagtacctgagacagctgttccacagaagagtggccgtgcacctggtgaagtggctgcccttcctgagcgtggacagactggagagagtgagcagcaccagccccagcaccggcgagcacgagctgagcgccggcttctag

SEQ ID NO: 76437 - DNA, 1089 bp, Artificial Sequence
  Description of Artificial Sequence: Synthetic coding sequence
atgggcaccgaggccaccgagcaggtgagctggggccactacagcggcgacgaggaggacgcctacagcgccgagcccctgcccgagctgtgctacaaggccgacgtgcaggccttcagcagagccttccagcccagcgtgagcctgaccgtggccgccctgggcctggccggcaacggcctggtgctggccacccacctggccgccagaagagccgccagaagccccaccagcgcccacctgctgcagctggccctggccgacctgctgctggccctgaccctgcccttcgccgccgccggcgccctgcagggctggagcctgggcagcgccacctgcagaaccatcagcggcctgtacagcgccagcttccacgccggcttcctgttcctggcctgcatcagcgccgacagatacgtggccatcgccagagccctgcccgccggccccagacccagcacccccggcagagcccacctggtgagcgtgatcgtgtggctgctgagcctgctgctggccctgcccgccctgctgttcagccaggacggccagagagagggccagagaagatgcagactgatcttccccgagggcctgacccagaccgtgaagggcgccagcgccgtggcccaggtggccctgggcttcgccctgcccctgggcgtgatggtggcctgctacgccctgctgggcagaaccctgctggccgccagaggccccgagagaagaagagccctgagagtggtggtggccctggtggccgccttcgtggtgctgcagctgccctacagcctggccctgctgctggacaccgccgacctgctggccgccagagagagaagctgccccgccagcaagagaaaggacgtggccctgctggtgaccagcggcctggccctggccagatgcggcctgaaccccgtgctgtacgccttcctgggcctgagattcagacaggacctgagaagactgctgagaggcggcagctgccccagcggcccccagcccagaagaggctgccccagaagacccagactgagcagctgcagcgcccccaccgagacccacagcctgagctgggacaactag

SEQ ID NO: 76438 - DNA, 1125 bp, Artificial Sequence
  Description of Artificial Sequence: Synthetic coding sequence
atgctgagcaccagcagaagcagattcatcagaaacaccaacgagagcggcgaggaggtgaccaccttcttcgactacgactacggcgccccctgccacaagttcgacgtgaagcagatcggcgcccagctgctgccccccctgtacagcctggtgttcatcttcggcttcgtgggcaacatgctggtggtgctgatcctgatcaactgcaagaagctgaagtgcctgaccgacatctacctgctgaacctggccatcagcgacctgctgttcctgatcaccctgcccctgtgggcccacagcgccgccaacgagtgggtgttcggcaacgccatgtgcaagctgttcaccggcctgtaccacatcggctacttcggcggcatcttcttcatcatcctgctgaccatcgacagatacctggccatcgtgcacgccgtgttcgccctgaaggccagaaccgtgaccttcggcgtggtgaccagcgtgatcacctggctggtggccgtgttcgccagcgtgcccggcatcatcttcaccaagtgccagaaggaggacagcgtgtacgtgtgcggcccctacttccccagaggctggaacaacttccacaccatcatgagaaacatcctgggcctggtgctgcccctgctgatcatggtgatctgctacagcggcatcctgaagaccctgctgagatgcagaaacgagaagaagagacacagagccgtgagagtgatcttcaccatcatgatcgtgtacttcctgttctggaccccctacaacatcgtgatcctgctgaacaccttccaggagttcttcggcctgagcaactgcgagagcaccagccagctggaccaggccacccaggtgaccgagaccctgggcatgacccactgctgcatcaaccccatcatctacgccttcgtgggcgagaagttcagaagcctgttccacatcgccctgggctgcagaatcgcccccctgcagaagcccgtgtgcggcggccccggcgtgagacccggcaagaacgtgaaggtgaccacccagggcctgctggacggcagaggcaagggcaagagcatcggcagagcccccgaggccagcctgcaggacaaggagggcgcctag

SEQ ID NO: 76439 - DNA, 1125 bp, Artificial Sequence; identical to SEQ ID NO: 76438
  Description of Artificial Sequence: Synthetic coding sequence

SEQ ID NO: 76440 - DNA, 366 bp, Artificial Sequence
  Description of Artificial Sequence: Synthetic coding sequence
atgctgagcaccagcagaagcagattcatcagaaacaccaacgagagcggcgaggaggtgaccaccttcttcgactacgactacggcgccccctgccacaagttcgacgtgaagcagatcggcgcccagctgctgccccccctgtacagcctggtgttcatcttcggcttcgtgggcaacatgctggtggtgctgatcctgatcaactgcaagaagctgaagtgcctgaccgacatctacctgctgaacctggccatcagcgacctgctgttcctgatcaccctgcccctgtgggcccacagcgccgccaacgagtgggtgttcggcaacgccatgtgcaagctgttcaccggcctgtaccactag

SEQ ID NO: 76441 - DNA, 1083 bp, Artificial Sequence
  Description of Artificial Sequence: Synthetic coding sequence
atgctgagcaccagcagaagcagattcatcagaaacaccaacgagagcggcgaggaggtgaccaccttcttcgactacgactacggcgccccctgccacaagttcgacgtgaagcagatcggcgcccagctgctgccccccctgtacagcctggtgttcatcttcggcttcgtgggcaacatgctggtggtgctgatcctgatcaactgcaagaagctgaagtgcctgaccgacatctacctgctgaacctggccatcagcgacctgctgttcctgatcaccctgcccctgtgggcccacagcgccgccaacgagtgggtgttcggcaacgccatgtgcaagctgttcaccggcctgtaccacatcggctacttcggcggcatcttcttcatcatcctgctgaccatcgacagatacctggccatcgtgcacgccgtgttcgccctgaaggccagaaccgtgaccttcggcgtggtgaccagcgtgatcacctggctggtggccgtgttcgccagcgtgcccggcatcatcttcaccaagtgccagaaggaggacagcgtgtacgtgtgcggcccctacttccccagaggctggaacaacttccacaccatcatgagaaacatcctgggcctggtgctgcccctgctgatcatggtgatctgctacagcggcatcctgaagaccctgctgagatgcagaaacgagaagaagagacacagagccgtgagagtgatcttcaccatcatgatcgtgtacttcctgttctggaccccctacaacatcgtgatcctgctgaacaccttccaggagttcttcggcctgagcaactgcgagagcaccagccagctggaccaggccacccaggtgaccgagaccctgggcatgacccactgctgcatcaaccccatcatctacgccttcgtgggcgagaagttcagaagatacctgagcgtgttcttcagaaagcacatcaccaagagattctgcaagcagtgccccgtgttctacagagagaccgtggacggcgtgaccagcaccaacacccccagcaccggcgagcaggaggtgagcgccggcctgtag

SEQ ID NO: 76442 - DNA, 1068 bp, Artificial Sequence
  Description of Artificial Sequence: Synthetic coding sequence
atgaccaccagcctggacaccgtggagaccttcggcaccaccagctactacgacgacgtgggcctgctgtgcgagaaggccgacaccagagccctgatggcccagttcgtgccccccctgtacagcctggtgttcaccgtgggcctgctgggcaacgtggtggtggtgatgatcctgatcaagtacagaagactgagaatcatgaccaacatctacctgctgaacctggccatcagcgacctgctgttcctggtgaccctgcccttctggatccactacgtgagaggccacaactgggtgttcggccacggcatgtgcaagctgctgagcggcttctaccacaccggcctgtacagcgagatcttcttcatcatcctgctgaccatcgacagatacctggccatcgtgcacgccgtgttcgccctgagagccagaaccgtgaccttcggcgtgatcaccagcatcgtgacctggggcctggccgtgctggccgccctgcccgagttcatcttctacgagaccgaggagctgttcgaggagaccctgtgcagcgccctgtaccccgaggacaccgtgtacagctggagacacttccacaccctgagaatgaccatcttctgcctggtgctgcccctgctggtgatggccatctgctacaccggcatcatcaagaccctgctgagatgccccagcaagaagaagtacaaggccatcagactgatcttcgtgatcatggccgtgttcttcatcttctggaccccctacaacgtggccatcctgctgagcagctaccagagcatcctgttcggcaacgactgcgagagaagcaagcacctggacctggtgatgctggtgaccgaggtgatcgcctacagccactgctgcatgaaccccgtgatctacgccttcgtgggcgagagattcagaaagtacctgagacacttcttccacagacacctgctgatgcacctgggcagatacatccccttcctgcccagcgagaagctggagagaaccagcagcgtgagccccagcaccgccgagcccgagctgagcatcgtgttctag

SEQ ID NO: 76443 - DNA, 1068 bp, Artificial Sequence; identical to SEQ ID NO: 76442
  Description of Artificial Sequence: Synthetic coding sequence

SEQ ID NO: 76444 - DNA, 1068 bp, Artificial Sequence; identical to SEQ ID NO: 76442
  Description of Artificial Sequence: Synthetic coding sequence

SEQ ID NO: 76445 - DNA, 243 bp, Artificial Sequence
  Description of Artificial Sequence: Synthetic coding sequence
atgaccaccagcctggacaccgtggagaccttcggcaccaccagctactacgacgacgtgggcctgctgtgcgagaaggccgacaccagagccctgatggcccagttcgtgccccccctgtacagcctggtgttcaccgtgggcctgctgggcaacgtggtggtggtgatgatcctgatcaagtacagaagactgagaatcatgaccaacatctacctgctgaacctggccatcagcgactag

SEQ ID NO: 76446 - DNA, 66 bp, Artificial Sequence
  Description of Artificial Sequence: Synthetic coding sequence
atgaccaccagcctggacaccgtggagaccttcggcaccaccagctactacgacgacgtgggctag

SEQ ID NO: 76447 - DNA, 1068 bp, Artificial Sequence; identical to SEQ ID NO: 76442
  Description of Artificial Sequence: Synthetic coding sequence

SEQ ID NO: 76448 - DNA, 1131 bp, Artificial Sequence
  Description of Artificial Sequence: Synthetic coding sequence
atgcccttcggcatcagaatgctgctgagagcccacaagcccggcagcagcagaagaagcgagatgaccaccagcctggacaccgtggagaccttcggcaccaccagctactacgacgacgtgggcctgctgtgcgagaaggccgacaccagagccctgatggcccagttcgtgccccccctgtacagcctggtgttcaccgtgggcctgctgggcaacgtggtggtggtgatgatcctgatcaagtacagaagactgagaatcatgaccaacatctacctgctgaacctggccatcagcgacctgctgttcctggtgaccctgcccttctggatccactacgtgagaggccacaactgggtgttcggccacggcatgtgcaagctgctgagcggcttctaccacaccggcctgtacagcgagatcttcttcatcatcctgctgaccatcgacagatacctggccatcgtgcacgccgtgttcgccctgagagccagaaccgtgaccttcggcgtgatcaccagcatcgtgacctggggcctggccgtgctggccgccctgcccgagttcatcttctacgagaccgaggagctgttcgaggagaccctgtgcagcgccctgtaccccgaggacaccgtgtacagctggagacacttccacaccctgagaatgaccatcttctgcctggtgctgcccctgctggtgatggccatctgctacaccggcatcatcaagaccctgctgagatgccccagcaagaagaagtacaaggccatcagactgatcttcgtgatcatggccgtgttcttcatcttctggaccccctacaacgtggccatcctgctgagcagctaccagagcatcctgttcggcaacgactgcgagagaagcaagcacctggacctggtgatgctggtgaccgaggtgatcgcctacagccactgctgcatgaaccccgtgatctacgccttcgtgggcgagagattcagaaagtacctgagacacttcttccacagacacctgctgatgcacctgggcagatacatccccttcctgcccagcgagaagctggagagaaccagcagcgtgagccccagcaccgccgagcccgagctgagcatcgtgttctag

SEQ ID NO: 76449 - DNA, 1083 bp, Artificial Sequence
  Description of Artificial Sequence: Synthetic coding sequence
atgaaccccaccgacatcgccgacaccaccctggacgagagcatctacagcaactactacctgtacgagagcatccccaagccctgcaccaaggagggcatcaaggccttcggcgagctgttcctgccccccctgtacagcctggtgttcgtgttcggcctgctgggcaacagcgtggtggtgctggtgctgttcaagtacaagagactgagaagcatgaccgacgtgtacctgctgaacctggccatcagcgacctgctgttcgtgttcagcctgcccttctggggctactacgccgccgaccagtgggtgttcggcctgggcctgtgcaagatgatcagctggatgtacctggtgggcttctacagcggcatcttcttcgtgatgctgatgagcatcgacagatacctggccatcgtgcacgccgtgttcagcctgagagccagaaccctgacctacggcgtgatcaccagcctggccacctggagcgtggccgtgttcgccagcctgcccggcttcctgttcagcacctgctacaccgagagaaaccacacctactgcaagaccaagtacagcctgaacagcaccacctggaaggtgctgagcagcctggagatcaacatcctgggcctggtgatccccctgggcatcatgctgttctgctacagcatgatcatcagaaccctgcagcactgcaagaacgagaagaagaacaaggccgtgaagatgatcttcgccgtggtggtgctgttcctgggcttctggaccccctacaacatcgtgctgttcctggagaccctggtggagctggaggtgctgcaggactgcaccttcgagagatacctggactacgccatccaggccaccgagaccctggccttcgtgcactgctgcctgaaccccatcatctacttcttcctgggcgagaagttcagaaagtacatcctgcagctgttcaagacctgcagaggcctgttcgtgctgtgccagtactgcggcctgctgcagatctacagcgccgacacccccagcagcagctacacccagagcaccatggaccacgacctgcacgacgccctgtag

SEQ ID NO: 76450 - DNA, 1059 bp, Artificial Sequence
  Description of Artificial Sequence: Synthetic coding sequence
atggactaccaggtgagcagccccatctacgacatcaactactacaccagcgagccctgccagaagatcaacgtgaagcagatcgccgccagactgctgccccccctgtacagcctggtgttcatcttcggcttcgtgggcaacatgctggtgatcctgatcctgatcaactgcaagagactgaagagcatgaccgacatctacctgctgaacctggccatcagcgacctgttcttcctgctgaccgtgcccttctgggcccactacgccgccgcccagtgggacttcggcaacaccatgtgccagctgctgaccggcctgtacttcatcggcttcttcagcggcatcttcttcatcatcctgctgaccatcgacagatacctggccgtggtgcacgccgtgttcgccctgaaggccagaaccgtgaccttcggcgtggtgaccagcgtgatcacctgggtggtggccgtgttcgccagcctgcccggcatcatcttcaccagaagccagaaggagggcctgcactacacctgcagcagccacttcccctacagccagtaccagttctggaagaacttccagaccctgaagatcgtgatcctgggcctggtgctgcccctgctggtgatggtgatctgctacagcggcatcctgaagaccctgctgagatgcagaaacgagaagaagagacacagagccgtgagactgatcttcaccatcatgatcgtgtacttcctgttctgggccccctacaacatcgtgctgctgctgaacaccttccaggagttcttcggcctgaacaactgcagcagcagcaacagactggaccaggccatgcaggtgaccgagaccctgggcatgacccactgctgcatcaaccccatcatctacgccttcgtgggcgagaagttcagaaactacctgctggtgttcttccagaagcacatcgccaagagattctgcaagtgctgcagcatcttccagcaggaggcccccgagagagccagcagcgtgtacaccagaagcaccggcgagcaggagatcagcgtgggcctgtag

SEQ ID NO: 76451 - DNA, 1059 bp, Artificial Sequence; identical to SEQ ID NO: 76450
  Description of Artificial Sequence: Synthetic coding sequence

SEQ ID NO: 76452 - DNA, 999 bp, Artificial Sequence
  Description of Artificial Sequence: Synthetic coding sequence
ctgcccaagaaccagtgcgaggccaacagaagccccccccccgccagcgccctgctgaccggcgtgcacctgtggttctgcaacatgctggtgatcctgatcctgatcaactgcaagagactgaagagcatgaccgacatctacctgctgaacctggccatcagcgacctgttcttcctgctgaccgtgcccttctgggcccactacgccgccgcccagtgggacttcggcaacaccatgtgccagctgctgaccggcctgtacttcatcggcttcttcagcggcatcttcttcatcatcctgctgaccatcgacagatacctggccgtggtgcacgccgtgttcgccctgaaggccagaaccgtgaccttcggcgtggtgaccagcgtgatcacctgggtggtggccgtgttcgccagcctgcccggcatcatcttcaccagaagccagaaggagggcctgcactacacctgcagcagccacttcccctacagccagtaccagttctggaagaacttccagaccctgaagatcgtgatcctgggcctggtgctgcccctgctggtgatggtgatctgctacagcggcatcctgaagaccctgctgagatgcagaaacgagaagaagagacacagagccgtgagactgatcttcaccatcatgatcgtgtacttcctgttctgggccccctacaacatcgtgctgctgctgaacaccttccaggagttcttcggcctgaacaactgcagcagcagcaacagactggaccaggccatgcaggtgaccgagaccctgggcatgacccactgctgcatcaaccccatcatctacgccttcgtgggcgagaagttcagaaactacctgctggtgttcttccagaagcacatcgccaagagattctgcaagtgctgcagcatcttccagcaggaggcccccgagagagccagcagcgtgtacaccagaagcaccggcgagcaggagatcagcgtgggcctgtag

SEQ ID NO: 76453 - DNA, 1059 bp, Artificial Sequence; identical to SEQ ID NO: 76450
  Description of Artificial Sequence: Synthetic coding sequence

SEQ ID NO: 76454 - DNA, 1125 bp, Artificial Sequence
  Description of Artificial Sequence: Synthetic coding sequence
atgagcggcgagagcatgaacttcagcgacgtgttcgacagcagcgaggactacttcgtgagcgtgaacaccagctactacagcgtggacagcgagatgctgctgtgcagcctgcaggaggtgagacagttcagcagactgttcgtgcccatcgcctacagcctgatctgcgtgttcggcctgctgggcaacatcctggtggtgatcaccttcgccttctacaagaaggccagaagcatgaccgacgtgtacctgctgaacatggccatcgccgacatcctgttcgtgctgaccctgcccttctgggccgtgagccacgccaccggcgcctgggtgttcagcaacgccacctgcaagctgctgaagggcatctacgccatcaacttcaactgcggcatgctgctgctgacctgcatcagcatggacagatacatcgccatcgtgcaggccaccaagagcttcagactgagaagcagaaccctgcccagaagcaagatcatctgcctggtggtgtggggcctgagcgtgatcatcagcagcagcaccttcgtgttcaaccagaagtacaacacccagggcagcgacgtgtgcgagcccaagtaccagaccgtgagcgagcccatcagatggaagctgctgatgctgggcctggagctgctgttcggcttcttcatccccctgatgttcatgatcttctgctacaccttcatcgtgaagaccctggtgcaggcccagaacagcaagagacacaaggccatcagagtgatcatcgccgtggtgctggtgttcctggcctgccagatcccccacaacatggtgctgctggtgaccgccgccaacctgggcaagatgaacagaagctgccagagcgagaagctgatcggctacaccaagaccgtgaccgaggtgctggccttcctgcactgctgcctgaaccccgtgctgtacgccttcatcggccagaagttcagaaactacttcctgaagatcctgaaggacctgtggtgcgtgagaagaaagtacaagagcagcggcttcagctgcgccggcagatacagcgagaacatcagcagacagaccagcgagaccgccgacaacgacaacgccagcagcttcaccatgtag

SEQ ID NO: 76455 - DNA, 1125 bp, Artificial Sequence; identical to SEQ ID NO: 76454
  Description of Artificial Sequence: Synthetic coding sequence

SEQ ID NO: 76456 - DNA, 1125 bp, Artificial Sequence; identical to SEQ ID NO: 76454
  Description of Artificial Sequence: Synthetic coding sequence

SEQ ID NO: 76457 - DNA, 1137 bp, Artificial Sequence
  Description of Artificial Sequence: Synthetic coding sequence
atggacctgggcaagcccatgaagagcgtgctggtggtggccctgctggtgatcttccaggtgtgcctgtgccaggacgaggtgaccgacgactacatcggcgacaacaccaccgtggactacaccctgttcgagagcctgtgcagcaagaaggacgtgagaaacttcaaggcctggttcctgcccatcatgtacagcatcatctgcttcgtgggcctgctgggcaacggcctggtggtgctgacctacatctacttcaagagactgaagaccatgaccgacacctacctgctgaacctggccgtggccgacatcctgttcctgctgaccctgcccttctgggcctacagcgccgccaagagctgggtgttcggcgtgcacttctgcaagctgatcttcgccatctacaagatgagcttcttcagcggcatgctgctgctgctgtgcatcagcatcgacagatacgtggccatcgtgcaggccgtgagcgcccacagacacagagccagagtgctgctgatcagcaagctgagctgcgtgggcatctggatcctggccaccgtgctgagcatccccgagctgctgtacagcgacctgcagagaagcagcagcgagcaggccatgagatgcagcctgatcaccgagcacgtggaggccttcatcaccatccaggtggcccagatggtgatcggcttcctggtgcccctgctggccatgagcttctgctacctggtgatcatcagaaccctgctgcaggccagaaacttcgagagaaacaaggccatcaaggtgatcatcgccgtggtggtggtgttcatcgtgttccagctgccctacaacggcgtggtgctggcccagaccgtggccaacttcaacatcaccagcagcacctgcgagctgagcaagcagctgaacatcgcctacgacgtgacctacagcctggcctgcgtgagatgctgcgtgaaccccttcctgtacgccttcatcggcgtgaagttcagaaacgacctgttcaagctgttcaaggacctgggctgcctgagccaggagcagctgagacagtggagcagctgcagacacatcagaagaagcagcatgagcgtggaggccgagaccaccaccaccttcagcccctag

SEQ ID NO: 76458 - DNA, 1068 bp, Artificial Sequence
  Description of Artificial Sequence: Synthetic coding sequence
atggactacaccctggacctgagcgtgaccaccgtgaccgactactactaccccgacatcttcagcagcccctgcgacgccgagctgatccagaccaacggcaagctgctgctggccgtgttctactgcctgctgttcgtgttcagcctgctgggcaacagcctggtgatcctggtgctggtggtgtgcaagaagctgagaagcatcaccgacgtgtacctgctgaacctggccctgagcgacctgctgttcgtgttcagcttccccttccagacctactacctgctggaccagtgggtgttcggcaccgtgatgtgcaaggtggtgagcggcttctactacatcggcttctacagcagcatgttcttcatcaccctgatgagcgtggacagatacctggccgtggtgcacgccgtgtacgccctgaaggtgagaaccatcagaatgggcaccaccctgtgcctggccgtgtggctgaccgccatcatggccaccatccccctgctggtgttctaccaggtggccagcgaggacggcgtgctgcagtgctacagcttctacaaccagcagaccctgaagtggaagatcttcaccaacttcaagatgaacatcctgggcctgctgatccccttcaccatcttcatgttctgctacatcaagatcctgcaccagctgaagagatgccagaaccacaacaagaccaaggccatcagactggtgctgatcgtggtgatcgccagcctgctgttctgggtgcccttcaacgtggtgctgttcctgaccagcctgcacagcatgcacatcctggacggctgcagcatcagccagcagctgacctacgccacccacgtgaccgagatcatcagcttcacccactgctgcgtgaaccccgtgatctacgccttcgtgggcgagaagttcaagaagcacctgagcgagatcttccagaagagctgcagccagatcttcaactacctgggcagacagatgcccagagagagctgcgagaagagcagcagctgccagcagcacagcagcagaagcagcagcgtggactacatcctgtag

SEQ ID NO: 76459 - DNA, 819 bp, Artificial Sequence
  Description of Artificial Sequence: Synthetic coding sequence
atgagaaacctgttcagacagatgacctactacctgctggaccagtgggtgttcggcaccgtgatgtgcaaggtggtgagcggcttctactacatcggcttctacagcagcatgttcttcatcaccctgatgagcgtggacagatacctggccgtggtgcacgccgtgtacgccctgaaggtgagaaccatcagaatgggcaccaccctgtgcctggccgtgtggctgaccgccatcatggccaccatccccctgctggtgttctaccaggtggccagcgaggacggcgtgctgcagtgctacagcttctacaaccagcagaccctgaagtggaagatcttcaccaacttcaagatgaacatcctgggcctgctgatccccttcaccatcttcatgttctgctacatcaagatcctgcaccagctgaagagatgccagaaccacaacaagaccaaggccatcagactggtgctgatcgtggtgatcgccagcctgctgttctgggtgcccttcaacgtggtgctgttcctgaccagcctgcacagcatgcacatcctggacggctgcagcatcagccagcagctgacctacgccacccacgtgaccgagatcatcagcttcacccactgctgcgtgaaccccgtgatctacgccttcgtgggcgagaagttcaagaagcacctgagcgagatcttccagaagagctgcagccagatcttcaactacctgggcagacagatgcccagagagagctgcgagaagagcagcagctgccagcagcacagcagcagaagcagcagcgtggactacatcctgtag

SEQ ID NO: 76460 - DNA, 1074 bp, Artificial Sequence
  Description of Artificial Sequence: Synthetic coding sequence
atggccgacgactacggcagcgagagcaccagcagcatggaggactacgtgaacttcaacttcaccgacttctactgcgagaagaacaacgtgagacagttcgccagccacttcctgccccccctgtactggctggtgttcatcgtgggcgccctgggcaacagcctggtgatcctggtgtactggtactgcaccagagtgaagaccatgaccgacatgttcctgctgaacctggccatcgccgacctgctgttcctggtgaccctgcccttctgggccatcgccgccgccgaccagtggaagttccagaccttcatgtgcaaggtggtgaacagcatgtacaagatgaacttctacagctgcgtgctgctgatcatgtgcatcagcgtggacagatacatcgccatcgcccaggccatgagagcccacacctggagagagaagagactgctgtacagcaagatggtgtgcttcaccatctgggtgctggccgccgccctgtgcatccccgagatcctgtacagccagatcaaggaggagagcggcatcgccatctgcaccatggtgtaccccagcgacgagagcaccaagctgaagagcgccgtgctgaccctgaaggtgatcctgggcttcttcctgcccttcgtggtgatggcctgctgctacaccatcatcatccacaccctgatccaggccaagaagagcagcaagcacaaggccctgaaggtgaccatcaccgtgctgaccgtgttcgtgctgagccagttcccctacaactgcatcctgctggtgcagaccatcgacgcctacgccatgttcatcagcaactgcgccgtgagcaccaacatcgacatctgcttccaggtgacccagaccatcgccttcttccacagctgcctgaaccccgtgctgtacgtgttcgtgggcgagagattcagaagagacctggtgaagaccctgaagaacctgggctgcatcagccaggcccagtgggtgagcttcaccagaagagagggcagcctgaagctgagcagcatgctgctggagaccaccagcggcgccctgagcctgtag

SEQ ID NO: 76461 - DNA, 1110 bp, Artificial Sequence
  Description of Artificial Sequence: Synthetic coding sequence
atgacccccaccgacttcaccagccccatccccaacatggccgacgactacggcagcgagagcaccagcagcatggaggactacgtgaacttcaacttcaccgacttctactgcgagaagaacaacgtgagacagttcgccagccacttcctgccccccctgtactggctggtgttcatcgtgggcgccctgggcaacagcctggtgatcctggtgtactggtactgcaccagagtgaagaccatgaccgacatgttcctgctgaacctggccatcgccgacctgctgttcctggtgaccctgcccttctgggccatcgccgccgccgaccagtggaagttccagaccttcatgtgcaaggtggtgaacagcatgtacaagatgaacttctacagctgcgtgctgctgatcatgtgcatcagcgtggacagatacatcgccatcgcccaggccatgagagcccacacctggagagagaagagactgctgtacagcaagatggtgtgcttcaccatctgggtgctggccgccgccctgtgcatccccgagatcctgtacagccagatcaaggaggagagcggcatcgccatctgcaccatggtgtaccccagcgacgagagcaccaagctgaagagcgccgtgctgaccctgaaggtgatcctgggcttcttcctgcccttcgtggtgatggcctgctgctacaccatcatcatccacaccctgatccaggccaagaagagcagcaagcacaaggccctgaaggtgaccatcaccgtgctgaccgtgttcgtgctgagccagttcccctacaactgcatcctgctggtgcagaccatcgacgcctacgccatgttcatcagcaactgcgccgtgagcaccaacatcgacatctgcttccaggtgacccagaccatcgccttcttccacagctgcctgaaccccgtgctgtacgtgttcgtgggcgagagattcagaagagacctggtgaagaccctgaagaacctgggctgcatcagccaggcccagtgggtgagcttcaccagaagagagggcagcctgaagctgagcagcatgctgctggagaccaccagcggcgccctgagcctgtag

SEQ ID NO: 76462 - DNA, 1074 bp, Artificial Sequence; identical to SEQ ID NO: 76460
  Description of Artificial Sequence: Synthetic coding sequence

SEQ ID NO: 76463 - DNA, 1053 bp, Artificial Sequence
  Description of Artificial Sequence: Synthetic coding sequence
atggccctggagcagaaccagagcaccgactactactacgaggagaacgagatgaacggcacctacgactacagccagtacgagctgatctgcatcaaggaggacgtgagagagttcgccaaggtgttcctgcccgtgttcctgaccatcgtgttcgtgatcggcctggccggcaacagcatggtggtggccatctacgcctactacaagaagcagagaaccaagaccgacgtgtacatcctgaacctggccgtggccgacctgctgctgctgttcaccctgcccttctgggccgtgaacgccgtgcacggctgggtgctgggcaagatcatgtgcaagatcaccagcgccctgtacaccctgaacttcgtgagcggcatgcagttcctggcctgcatcagcatcgacagatacgtggccgtgaccaaggtgcccagccagagcggcgtgggcaagccctgctggatcatctgcttctgcgtgtggatggccgccatcctgctgagcatcccccagctggtgttctacaccgtgaacgacaacgccagatgcatccccatcttccccagatacctgggcaccagcatgaaggccctgatccagatgctggagatctgcatcggcttcgtggtgcccttcctgatcatgggcgtgtgctacttcatcaccgccagaaccctgatgaagatgcccaacatcaagatcagcagacccctgaaggtgctgctgaccgtggtgatcgtgttcatcgtgacccagctgccctacaacatcgtgaagttctgcagagccatcgacatcatctacagcctgatcaccagctgcaacatgagcaagagaatggacatcgccatccaggtgaccgagagcatcgccctgttccacagctgcctgaaccccatcctgtacgtgttcatgggcgccagcttcaagaactacgtgatgaaggtggccaagaagtacggcagctggagaagacagagacagagcgtggaggagttccccttcgacagcgagggccccaccgagcccaccagcaccttcagcatctag

SEQ ID NO: 76464 - DNA, 825 bp, Artificial Sequence
  Description of Artificial Sequence: Synthetic coding sequence
atggccctggagcagaaccagagcaccgactactactacgaggagaacgagatgaacggcacctacgactacagccagtacgagctgatctgcatcaaggaggacgtgagagagttcgccaaggtgttcctgcccgtgttcctgaccatcgtgttcgtgatcggcctggccggcaacagcatggtggtggccatctacgcctactacaagaagcagagaaccaagaccgacgtgtacatcctgaacctggccgtggccgacctgctgctgctgttcaccctgcccttctgggccgtgaacgccgtgcacggctgggtgctgggcaagatcatgtgcaagatcaccagcgccctgtacaccctgaacttcgtgagcggcatgcagttcctggcctgcatcagcatcgacagatacgtggccgtgaccaaggtgcccagccagagcggcgtgggcaagccctgctggatcatctgcttctgcgtgtggatggccgccatcctgctgagcatcccccagctggtgttctacaccgtgaacgacaacgccagatgcatccccatcttccccagatacctgggcaccagcatgaaggccctgatccagatgctggagatctgcatcggcttcgtggtgcccttcctgatcatgggcgtgtgctacttcatcaccgccagaaccctgatgaagatgcccaacatcaagatcagcagacccctgaaggtgctgctgaccgtggtgatcgtgttcatcgtgacccagctgcccttcgcctggatccacatgaacgacgccttccccagcaacaagaccagcgccctgttctag

SEQ ID NO: 76465 - DNA, 1071 bp, Artificial Sequence
  Description of Artificial Sequence: Synthetic coding sequence
atgatctacaccagattcctgaagggcagcctgaagatggccaactacaccctggcccccgaggacgagtacgacgtgctgatcgagggcgagctggagagcgacgaggccgagcagtgcgacaagtacgacgcccaggccctgagcgcccagctggtgcccagcctgtgcagcgccgtgttcgtgatcggcgtgctggacaacctgctggtggtgctgatcctggtgaagtacaagggcctgaagagagtggagaacatctacctgctgaacctggccgtgagcaacctgtgcttcctgctgaccctgcccttctgggcccacgccggcggcgaccccatgtgcaagatcctgatcggcctgtacttcgtgggcctgtacagcgagaccttcttcaactgcctgctgaccgtgcagagatacctggtgttcctgcacaagggcaacttcttcagcgccagaagaagagtgccctgcggcatcatcaccagcgtgctggcctgggtgaccgccatcctggccaccctgcccgagttcgtggtgtacaagccccagatggaggaccagaagtacaagtgcgccttcagcagaacccccttcctgcccgccgacgagaccttctggaagcacttcctgaccctgaagatgaacatcagcgtgctggtgctgcccctgttcatcttcaccttcctgtacgtgcagatgagaaagaccctgagattcagagagcagagatacagcctgttcaagctggtgttcgccatcatggtggtgttcctgctgatgtgggccccctacaacatcgccttcttcctgagcaccttcaaggagcacttcagcctgagcgactgcaagagcagctacaacctggacaagagcgtgcacatcaccaagctgatcgccaccacccactgctgcatcaaccccctgctgtacgccttcctggacggcaccttcagcaagtacctgtgcagatgcttccacctgagaagcaacacccccctgcagcccagaggccagagcgcccagggcaccagcagagaggagcccgaccacagcaccgaggtgtag

SEQ ID NO: 76466 - DNA, 1035 bp, Artificial Sequence
  Description of Artificial Sequence: Synthetic coding sequence
atggccaactacaccctggcccccgaggacgagtacgacgtgctgatcgagggcgagctggagagcgacgaggccgagcagtgcgacaagtacgacgcccaggccctgagcgcccagctggtgcccagcctgtgcagcgccgtgttcgtgatcggcgtgctggacaacctgctggtggtgctgatcctggtgaagtacaagggcctgaagagagtggagaacatctacctgctgaacctggccgtgagcaacctgtgcttcctgctgaccctgcccttctgggcccacgccggcggcgaccccatgtgcaagatcctgatcggcctgtacttcgtgggcctgtacagcgagaccttcttcaactgcctgctgaccgtgcagagatacctggtgttcctgcacaagggcaacttcttcagcgccagaagaagagtgccctgcggcatcatcaccagcgtgctggcctgggtgaccgccatcctggccaccctgcccgagttcgtggtgtacaagccccagatggaggaccagaagtacaagtgcgccttcagcagaacccccttcctgcccgccgacgagaccttctggaagcacttcctgaccctgaagatgaacatcagcgtgctggtgctgcccctgttcatcttcaccttcctgtacgtgcagatgagaaagaccctgagattcagagagcagagatacagcctgttcaagctggtgttcgccatcatggtggtgttcctgctgatgtgggccccctacaacatcgccttcttcctgagcaccttcaaggagcacttcagcctgagcgactgcaagagcagctacaacctggacaagagcgtgcacatcaccaagctgatcgccaccacccactgctgcatcaaccccctgctgtacgccttcctggacggcaccttcagcaagtacctgtgcagatgcttccacctgagaagcaacacccccctgcagcccagaggccagagcgcccagggcaccagcagagaggagcccgaccacagcaccgaggtgtag

SEQ ID NO: 76467 - DNA, 1035 bp, Artificial Sequence; identical to SEQ ID NO: 76466
  Description of Artificial Sequence: Synthetic coding sequence

SEQ ID NO: 76468 - DNA, 1035 bp, Artificial Sequence; identical to SEQ ID NO: 76466
  Description of Artificial Sequence: Synthetic coding sequence

SEQ ID NO: 76469 - DNA, 654 bp, Artificial Sequence
  Description of Artificial Sequence: Synthetic coding sequence
atggccaactacaccctggcccccgaggacgagtacgacgtgctgatcgagggcgagctggagagcgacgaggccgagcagtgcgacaagtacgacgcccaggccctgagcgcccagctggtgcccagcctgtgcagcgccgtgttcgtgatcggcgtgctggacaacctgctggtggtgctgatcctggtgaagtacaagggcctgaagagagtggagaacatctacctgctgaacctggccgtgagcaacctgtgcttcctgctgaccctgcccttctgggcccacgccggcggcgaccccatgtgcaagatcctgatcggcctgtacttcgtgggcctgtacagcgagaccttcttcaactgcctgctgaccgtgcagagatacctggtgttcctgcacaagggcaacttcttcagcgccagaagaagagtgccctgcggcatcatcaccagcgtgctggcctgggtgaccgccatcctggccaccctgcccgagttcgtggtgtacaagccccagatggaggaccagaagtacaagtgcgccttcagcagaacccccttcctgcccgccgacgagaccttctggaagcacttcctgaccctgaagatgaacatcagcgtgctggtgctgcccctgttcatcttcacctag

SEQ ID NO: 76470 - DNA, 1194 bp, Artificial Sequence
  Description of Artificial Sequence: Synthetic coding sequence
atggcccccatcagcctgagctggctgctgagactggccaccttctgccacctgaccgtgctgctggccggccagcaccacggcgtgaccaagtgcaacatcacctgcagcaagatgaccagcaagatccccgtggccctgctgatccactaccagcagaaccaggccagctgcggcaagagagccatcatcctggagaccagacagcacagactgttctgcgccgaccccaaggagcagtgggtgaaggacgccatgcagcacctggacagacaggccgccgccctgaccagaaacggcggcaccttcgagaagcagatcggcgaggtgaagcccagaaccacccccgccgccggcggcatggacgagagcgtggtgctggagcccgaggccaccggcgagagcagcagcctggagcccacccccagcagccaggaggcccagagagccctgggcaccagccccgagctgcccaccggcgtgaccggcagcagcggcaccagactgccccccacccccaaggcccaggacggcggccccgtgggcaccgagctgttcagagtgccccccgtgagcaccgccgccacctggcagagcagcgccccccaccagcccggccccagcctgtgggccgaggccaagaccagcgaggcccccagcacccaggaccccagcacccaggccagcaccgccagcagccccgcccccgaggagaacgcccccagcgagggccagagagtgtggggccagggccagagccccagacccgagaacagcctggagagagaggagatgggccccgtgcccgcccacaccgacgccttccaggactggggccccggcagcatggcccacgtgagcgtggtgcccgtgagcagcgagggcacccccagcagagagcccgtggccagcggcagctggacccccaaggccgaggagcccatccacgccaccatggacccccagagactgggcgtgctgatcacccccgtgcccgacgcccaggccgccaccagaagacaggccgtgggcctgctggccttcctgggcctgctgttctgcctgggcgtggccatgttcacctaccagagcctgcagggctgccccagaaagatggccggcgagatggccgagggcctgagatacatccccagaagctgcggcagcaacagctacgtgctggtgcccgtgtag

SEQ ID NO: 76471 - DNA, 1164 bp, Artificial Sequence
  Description of Artificial Sequence: Synthetic coding sequence
atgagagagcccctggaggccttcaagctggccgacctggacttcagaaagagcagcctggccagcggctggagaatggccagcggcgccttcaccatggaccagttccccgagagcgtgaccgagaacttcgagtacgacgacctggccgaggcctgctacatcggcgacatcgtggtgttcggcaccgtgttcctgagcatcttctacagcgtgatcttcgccatcggcctggtgggcaacctgctggtggtgttcgccctgaccaacagcaagaagcccaagagcgtgaccgacatctacctgctgaacctggccctgagcgacctgctgttcgtggccaccctgcccttctggacccactacctgatcaacgagaagggcctgcacaacgccatgtgcaagttcaccaccgccttcttcttcatcggcttcttcggcagcatcttcttcatcaccgtgatcagcatcgacagatacctggccatcgtgctggccgccaacagcatgaacaacagaaccgtgcagcacggcgtgaccatcagcctgggcgtgtgggccgccgccatcctggtggccgccccccagttcatgttcaccaagcagaaggagaacgagtgcctgggcgactaccccgaggtgctgcaggagatctggcccgtgctgagaaacgtggagaccaacttcctgggcttcctgctgcccctgctgatcatgagctactgctacttcagaatcatccagaccctgttcagctgcaagaaccacaagaaggccaaggccatcaagctgatcctgctggtggtgatcgtgttcttcctgttctggaccccctacaacgtgatgatcttcctggagaccctgaagctgtacgacttcttccccagctgcgacatgagaaaggacctgagactggccctgagcgtgaccgagaccgtggccttcagccactgctgcctgaaccccctgatctacgccttcgccggcgagaagttcagaagatacctgtaccacctgtacggcaagtgcctggccgtgctgtgcggcagaagcgtgcacgtggacttcagcagcagcgagagccagagaagcagacacggcagcgtgctgagcagcaacttcacctaccacaccagcgacggcgacgccctgctgctgctgtag

SEQ ID NO: 76472 - DNA, 1068 bp, Artificial Sequence
  Description of Artificial Sequence: Synthetic coding sequence
atggaccagttccccgagagcgtgaccgagaacttcgagtacgacgacctggccgaggcctgctacatcggcgacatcgtggtgttcggcaccgtgttcctgagcatcttctacagcgtgatcttcgccatcggcctggtgggcaacctgctggtggtgttcgccctgaccaacagcaagaagcccaagagcgtgaccgacatctacctgctgaacctggccctgagcgacctgctgttcgtggccaccctgcccttctggacccactacctgatcaacgagaagggcctgcacaacgccatgtgcaagttcaccaccgccttcttcttcatcggcttcttcggcagcatcttcttcatcaccgtgatcagcatcgacagatacctggccatcgtgctggccgccaacagcatgaacaacagaaccgtgcagcacggcgtgaccatcagcctgggcgtgtgggccgccgccatcctggtggccgccccccagttcatgttcaccaagcagaaggagaacgagtgcctgggcgactaccccgaggtgctgcaggagatctggcccgtgctgagaaacgtggagaccaacttcctgggcttcctgctgcccctgctgatcatgagctactgctacttcagaatcatccagaccctgttcagctgcaagaaccacaagaaggccaaggccatcaagctgatcctgctggtggtgatcgtgttcttcctgttctggaccccctacaacgtgatgatcttcctggagaccctgaagctgtacgacttcttccccagctgcgacatgagaaaggacctgagactggccctgagcgtgaccgagaccgtggccttcagccactgctgcctgaaccccctgatctacgccttcgccggcgagaagttcagaagatacctgtaccacctgtacggcaagtgcctggccgtgctgtgcggcagaagcgtgcacgtggacttcagcagcagcgagagccagagaagcagacacggcagcgtgctgagcagcaacttcacctaccacaccagcgacggcgacgccctgctgctgctgtag

SEQ ID NO: 76473 - DNA, 321 bp, Artificial Sequence
  Description of Artificial Sequence: Synthetic coding sequence
atggaccagttccccgagagcgtgaccgagaacttcgagtacgacgacctggccgaggcctgctacatcggcgacatcgtggtgttcggcaccgtgttcctgagcatcttctacagcgtgatcttcgccatcggcctggtgggcaacctgctggtggtgttcgccctgaccaacagcaagaagcccaagagcgtgaccgacatctacctgctgaacctggccctgagcgacctgctgttcgtggccaccctgcccttctggacccactacctgatcaacgagaagggcctgcacaacgccatgtgcaagttcaccacctag

SEQ ID NO: 76474 - DNA, 501 bp, Artificial Sequence
  Description of Artificial Sequence: Synthetic coding sequence
atggaccagttccccgagagcgtgaccgagaacttcgagtacgacgacctggccgaggcctgctacatcggcgacatcgtggtgttcggcaccgtgttcctgagcatcttctacagcgtgatcttcgccatcggcctggtgggcaacctgctggtggtgttcgccctgaccaacagcaagaagcccaagagcgtgaccgacatctacctgctgaacctggccctgagcgacctgctgttcgtggccaccctgcccttctggacccactacctgatcaacgagaagggcctgcacaacgccatgtgcaagttcaccaccgccttcttcttcatcggcttcttcggcagcatcttcttcatcaccgtgatcagcatcgacagatacctggccatcgtgctggccgccaacagcatgaacaacagaaccgtgcagcacggcgtgaccatcagcctgggcgtgtgggccgccgccatcctggtggccgccccccagttcatgtag

SEQ ID NO: 76475 - DNA, 1092 bp, Artificial Sequence
  Description of Artificial Sequence: Synthetic coding sequence
atggccagcggcaaggccttcaccatggaccagttccccgagagcgtgaccgagaacttcgagtacgacgacctggccgaggcctgctacatcggcgacatcgtggtgttcggcaccgtgttcctgagcatcttctacagcgtgatcttcgccatcggcctggtgggcaacctgctggtggtgttcgccctgaccaacagcaagaagcccaagagcgtgaccgacatctacctgctgaacctggccctgagcgacctgctgttcgtggccaccctgcccttctggacccactacctgatcaacgagaagggcctgcacaacgccatgtgcaagttcaccaccgccttcttcttcatcggcttcttcggcagcatcttcttcatcaccgtgatcagcatcgacagatacctggccatcgtgctggccgccaacagcatgaacaacagaaccgtgcagcacggcgtgaccatcagcctgggcgtgtgggccgccgccatcctggtggccgccccccagttcatgttcaccaagcagaaggagaacgagtgcctgggcgactaccccgaggtgctgcaggagatctggcccgtgctgagaaacgtggagaccaacttcctgggcttcctgctgcccctgctgatcatgagctactgctacttcagaatcatccagaccctgttcagctgcaagaaccacaagaaggccaaggccatcaagctgatcctgctggtggtgatcgtgttcttcctgttctggaccccctacaacgtgatgatcttcctggagaccctgaagctgtacgacttcttccccagctgcgacatgagaaaggacctgagactggccctgagcgtgaccgagaccgtggccttcagccactgctgcctgaaccccctgatctacgccttcgccggcgagaagttcagaagatacctgtaccacctgtacggcaagtgcctggccgtgctgtgcggcagaagcgtgcacgtggacttcagcagcagcgagagccagagaagcagacacggcagcgtgctgagcagcaacttcacctaccacaccagcgacggcgacgccctgctgctgctgtag

SEQ ID NO: 76476 - DNA, 1068 bp, Artificial Sequence; identical to SEQ ID NO: 76472
  Description of Artificial Sequence: Synthetic coding sequence

SEQ ID NO: 76477 - DNA, 1068 bp, Artificial Sequence; identical to SEQ ID NO: 76472
  Description of Artificial Sequence: Synthetic coding sequence

SEQ ID NO: 76478 - DNA, 324 bp, Artificial Sequence
  Description of Artificial Sequence: Synthetic coding sequence
atggccagagccgccctgagcgccgcccccagcaaccccagactgctgagagtggccctgctgctgctgctgctggtggccgccggcagaagagccgccggcgccagcgtggccaccgagctgagatgccagtgcctgcagaccctgcagggcatccaccccaagaacatccagagcgtgaacgtgaagagccccggcccccactgcgcccagaccgaggtgatcgccaccctgaagaacggcagaaaggcctgcctgaaccccgccagccccatcgtgaagaagatcatcgagaagatgctgaacagcgacaagagcaactag

SEQ ID NO: 76479 - DNA, 285 bp, Artificial Sequence
  Description of Artificial Sequence: Synthetic coding sequence
atgagcgtgaagggcatggccatcgccctggccgtgatcctgtgcgccaccgtggtgcagggcttccccatgttcaagagaggcagatgcctgtgcatcggccccggcgtgaaggccgtgaaggtggccgacatcgagaaggccagcatcatgtaccccagcaacaactgcgacaagatcgaggtgatcatcaccctgaaggagaacaagggccagagatgcctgaaccccaagagcaagcaggccagactgatcatcaagaaggtggagagaaagaacttctag

SEQ ID NO: 76480 - DNA, 285 bp, Artificial Sequence; identical to SEQ ID NO: 76479
  Description of Artificial Sequence: Synthetic coding sequence

SEQ ID NO: 76481 - DNA, 336 bp, Artificial Sequence
  Description of Artificial Sequence: Synthetic coding sequence
atgagcctgctgcccagaagagccccccccgtgagcatgagactgctggccgccgccctgctgctgctgctgctggccctgtacaccgccagagtggacggcagcaagtgcaagtgcagcagaaagggccccaagatcagatacagcgacgtgaagaagctggagatgaagcccaagtacccccactgcgaggagaagatggtgatcatcaccaccaagagcgtgagcagatacagaggccaggagcactgcctgcaccccaagctgcagagcaccaagagattcatcaagtggtacaacgcctggaacgagaagagaagagtgtacgaggagtag

SEQ ID NO: 76482 - DNA, 300 bp, Artificial Sequence
  Description of Artificial Sequence: Synthetic coding sequence
atgagactgctggccgccgccctgctgctgctgctgctggccctgtacaccgccagagtggacggcagcaagtgcaagtgcagcagaaagggccccaagatcagatacagcgacgtgaagaagctggagatgaagcccaagtacccccactgcgaggagaagatggtgatcatcaccaccaagagcgtgagcagatacagaggccaggagcactgcctgcaccccaagctgcagagcaccaagagattcatcaagtggtacaacgcctggaacgagaagagaagagtgtacgaggagtag

SEQ ID NO: 76483 - DNA, 822 bp, Artificial Sequence
  Description of Artificial Sequence: Synthetic coding sequence
atgagcggcagccagagcgaggtggcccccagcccccagagccccagaagccccgagatgggcagagacctgagacccggcagcagagtgctgctgctgctgctgctgctgctgctggtgtacctgacccagcccggcaacggcaacgagggcagcgtgaccggcagctgctactgcggcaagagaatcagcagcgacagcccccccagcgtgcagttcatgaacagactgagaaagcacctgagagcctaccacagatgcctgtactacaccagattccagctgctgagctggagcgtgtgcggcggcaacaaggacccctgggtgcaggagctgatgagctgcctggacctgaaggagtgcggccacgcctacagcggcatcgtggcccaccagaagcacctgctgcccaccagcccccccatcagccaggccagcgagggcgccagcagcgacatccacacccccgcccagatgctgctgagcaccctgcagagcacccagagacccaccctgcccgtgggcagcctgagcagcgacaaggagctgaccagacccaacgagaccaccatccacaccgccggccacagcctggccgccggccccgaggccggcgagaaccagaagcagcccgagaagaacgccggccccaccgccagaaccagcgccaccgtgcccgtgctgtgcctgctggccatcatcttcatcctgaccgccgccctgagctacgtgctgtgcaagagaagaagaggccagagcccccagagcagccccgacctgcccgtgcactacatccccgtggcccccgacagcaacacctag

SEQ ID NO: 76484 - DNA, 822 bp, Artificial Sequence; identical to SEQ ID NO: 76483
  Description of Artificial Sequence: Synthetic coding sequence

SEQ ID NO: 76485 - DNA, 360 bp, Artificial Sequence
  Description of Artificial Sequence: Synthetic coding sequence
atgaaggtgctgatcagcagcctgctgctgctgctgcccctgatgctgatgagcatggtgagcagcagcctgaaccccggcgtggccagaggccacagagacagaggccaggccagcagaagatggctgcaggagggcggccaggagtgcgagtgcaaggactggttcctgagagcccccagaagaaagttcatgaccgtgagcggcctgcccaagaagcagtgcccctgcgaccacttcaagggcaacgtgaagaagaccagacaccagagacaccacagaaagcccaacaagcacagcagagcctgccagcagttcctgaagcagtgccagctgagaagcttcgccctgcccctgtag

SEQ ID NO: 76486 - DNA, 360 bp, Artificial Sequence; identical to SEQ ID NO: 76485
  Description of Artificial Sequence: Synthetic coding sequence

SEQ ID NO: 76487 - DNA, 324 bp, Artificial Sequence
  Description of Artificial Sequence: Synthetic coding sequence
atggccagagccaccctgagcgccgcccccagcaaccccagactgctgagagtggccctgctgctgctgctgctggtggccgccagcagaagagccgccggcgcccccctggccaccgagctgagatgccagtgcctgcagaccctgcagggcatccacctgaagaacatccagagcgtgaaggtgaagagccccggcccccactgcgcccagaccgaggtgatcgccaccctgaagaacggccagaaggcctgcctgaaccccgccagccccatggtgaagaagatcatcgagaagatgctgaagaacggcaagagcaactag

SEQ ID NO: 76488 - DNA, 324 bp, Artificial Sequence
  Description of Artificial Sequence: Synthetic coding sequence
atggcccacgccaccctgagcgccgcccccagcaaccccagactgctgagagtggccctgctgctgctgctgctggtggccgccagcagaagagccgccggcgccagcgtggtgaccgagctgagatgccagtgcctgcagaccctgcagggcatccacctgaagaacatccagagcgtgaacgtgagaagccccggcccccactgcgcccagaccgaggtgatcgccaccctgaagaacggcaagaaggcctgcctgaaccccgccagccccatggtgcagaagatcatcgagaagatcctgaacaagggcagcaccaactag

SEQ ID NO: 76489 - DNA, 345 bp, Artificial Sequence
  Description of Artificial Sequence: Synthetic coding sequence
atgagcctgctgagcagcagagccgccagagtgcccggccccagcagcagcctgtgcgccctgctggtgctgctgctgctgctgacccagcccggccccatcgccagcgccggccccgccgccgccgtgctgagagagctgagatgcgtgtgcctgcagaccacccagggcgtgcaccccaagatgatcagcaacctgcaggtgttcgccatcggcccccagtgcagcaaggtggaggtggtggccagcctgaagaacggcaaggagatctgcctggaccccgaggcccccttcctgaagaaggtgatccagaagatcctggacggcggcaacaaggagaactag

SEQ ID NO: 76490 - DNA, 1053 bp, Artificial Sequence
  Description of Artificial Sequence: Synthetic coding sequence
atgagcaacatcaccgacccccagatgtgggacttcgacgacctgaacttcaccggcatgccccccgccgacgaggactacagcccctgcatgctggagaccgagaccctgaacaagtacgtggtgatcatcgcctacgccctggtgttcctgctgagcctgctgggcaacagcctggtgatgctggtgatcctgtacagcagagtgggcagaagcgtgaccgacgtgtacctgctgaacctggccctggccgacctgctgttcgccctgaccctgcccatctgggccgccagcaaggtgaacggctggatcttcggcaccttcctgtgcaaggtggtgagcctgctgaaggaggtgaacttctacagcggcatcctgctgctggcctgcatcagcgtggacagatacctggccatcgtgcacgccaccagaaccctgacccagaagagacacctggtgaagttcgtgtgcctgggctgctggggcctgagcatgaacctgagcctgcccttcttcctgttcagacaggcctaccaccccaacaacagcagccccgtgtgctacgaggtgctgggcaacgacaccgccaagtggagaatggtgctgagaatcctgccccacaccttcggcttcatcgtgcccctgttcgtgatgctgttctgctacggcttcaccctgagaaccctgttcaaggcccacatgggccagaagcacagagccatgagagtgatcttcgccgtggtgctgatcttcctgctgtgctggctgccctacaacctggtgctgctggccgacaccctgatgagaacccaggtgatccaggagagctgcgagagaagaaacaacatcggcagagccctggacgccaccgagatcctgggcttcctgcacagctgcctgaaccccatcatctacgccttcatcggccagaacttcagacacggcttcctgaagatcctggccatgcacggcctggtgagcaaggagttcctggccagacacagagtgaccagctacaccagcagcagcgtgaacgtgagcagcaacctgtag

SEQ ID NO: 76491 - DNA, 885 bp, Artificial Sequence
  Description of Artificial Sequence: Synthetic coding sequence
atgagcaacatcaccgacccccagatgtgggacttcgacgacctgaacttcaccggcatgccccccgccgacgaggactacagcccctgcatgctggagaccgagaccctgaacaagtacgtggtgatcatcgcctacgccctggtgttcctgctgagcctgctgggcaacagcctggtgatgctggtgatcctgtacagcagagtgggcagaagcgtgaccgacgtgtacctgctgaacctggccatcgtgcacgccaccagaaccctgacccagaagagacacctggtgaagttcgtgtgcctgggctgctggggcctgagcatgaacctgagcctgcccttcttcctgttcagacaggcctaccaccccaacaacagcagccccgtgtgctacgaggtgctgggcaacgacaccgccaagtggagaatggtgctgagaatcctgccccacaccttcggcttcatcgtgcccctgttcgtgatgctgttctgctacggcttcaccctgagaaccctgttcaaggcccacatgggccagaagcacagagccatgagagtgatcttcgccgtggtgctgatcttcctgctgtgctggctgccctacaacctggtgctgctggccgacaccctgatgagaacccaggtgatccaggagagctgcgagagaagaaacaacatcggcagagccctggacgccaccgagatcctgggcttcctgcacagctgcctgaaccccatcatctacgccttcatcggccagaacttcagacacggcttcctgaagatcctggccatgcacggcctggtgagcaaggagttcctggccagacacagagtgaccagctacaccagcagcagcgtgaacgtgagcagcaacctgtag

SEQ ID NO: 76492 - DNA, 804 bp, Artificial Sequence
  Description of Artificial Sequence: Synthetic coding sequence
atggtgctggaggtgagcgaccaccaggtgctgaacgacgccgaggtggccgccctgctggagaacttcagcagcagctacgactacggcgagaacgagagcgacagctgctgcaccagccccccctgcccccaggacttcagcctgaacttcgacagagccttcctgcccgccctgtacagcctgctgttcctgctgggcctgctgggcaacggcgccgtggccgccgtgctgctgagcagaagaaccgccctgagcagcaccgacaccttcctgctgcacctggccgtggccgacaccctgctggtgctgaccctgcccctgtgggccgtggacgccgccgtgcagtgggtgttcggcagcggcctgtgcaaggtggccggcgccctgttcaacatcaacttctacgccggcgccctgctgctggcctgcatcagcttcgacagatacctgaacatcgtgcacgccacccagctgtacagaagaggcccccccgccagagtgaccctgacctgcctggccgtgtggggcctgtgcctgctgttcgccctgcccgacttcatcttcctgagcgcccaccacgacgagagactgaacgccacccactgccagtacaacttcccccagggcagcagcagcggcagcggctgcggctgctgcagctgcgcctgggccgcccccaccagagagggcagcagaggcagccacagactgcccgccggcatccaccccggcctgagaccccagagaccccccaccagagcctgcgaggccggcatcagagcccccctgagccccacctag

SEQ ID NO: 76493 - DNA, 1248 bp, Artificial Sequence
  Description of Artificial Sequence: Synthetic coding sequence
atggagctgagaaagtacggccccggcagactggccggcaccgtgatcggcggcgccgcccagagcaagagccagaccaagagcgacagcatcaccaaggagttcctgcccggcctgtacaccgcccccagcagccccttcccccccagccaggtgagcgaccaccaggtgctgaacgacgccgaggtggccgccctgctggagaacttcagcagcagctacgactacggcgagaacgagagcgacagctgctgcaccagccccccctgcccccaggacttcagcctgaacttcgacagagccttcctgcccgccctgtacagcctgctgttcctgctgggcctgctgggcaacggcgccgtggccgccgtgctgctgagcagaagaaccgccctgagcagcaccgacaccttcctgctgcacctggccgtggccgacaccctgctggtgctgaccctgcccctgtgggccgtggacgccgccgtgcagtgggtgttcggcagcggcctgtgcaaggtggccggcgccctgttcaacatcaacttctacgccggcgccctgctgctggcctgcatcagcttcgacagatacctgaacatcgtgcacgccacccagctgtacagaagaggcccccccgccagagtgaccctgacctgcctggccgtgtggggcctgtgcctgctgttcgccctgcccgacttcatcttcctgagcgcccaccacgacgagagactgaacgccacccactgccagtacaacttcccccaggtgggcagaaccgccctgagagtgctgcagctggtggccggcttcctgctgcccctgctggtgatggcctactgctacgcccacatcctggccgtgctgctggtgagcagaggccagagaagactgagagccatgagactggtggtggtggtggtggtggccttcgccctgtgctggaccccctaccacctggtggtgctggtggacatcctgatggacctgggcgccctggccagaaactgcggcagagagagcagagtggacgtggccaagagcgtgaccagcggcctgggctacatgcactgctgcctgaaccccctgctgtacgccttcgtgggcgtgaagttcagagagagaatgtggatgctgctgctgagactgggctgccccaaccagagaggcctgcagagacagcccagcagcagcagaagagacagcagctggagcgagaccagcgaggccagctacagcggcctgtag

SEQ ID NO: 76494 - DNA, 1107 bp, Artificial Sequence
  Description of Artificial Sequence: Synthetic coding sequence
atggtgctggaggtgagcgaccaccaggtgctgaacgacgccgaggtggccgccctgctggagaacttcagcagcagctacgactacggcgagaacgagagcgacagctgctgcaccagccccccctgcccccaggacttcagcctgaacttcgacagagccttcctgcccgccctgtacagcctgctgttcctgctgggcctgctgggcaacggcgccgtggccgccgtgctgctgagcagaagaaccgccctgagcagcaccgacaccttcctgctgcacctggccgtggccgacaccctgctggtgctgaccctgcccctgtgggccgtggacgccgccgtgcagtgggtgttcggcagcggcctgtgcaaggtggccggcgccctgttcaacatcaacttctacgccggcgccctgctgctggcctgcatcagcttcgacagatacctgaacatcgtgcacgccacccagctgtacagaagaggcccccccgccagagtgaccctgacctgcctggccgtgtggggcctgtgcctgctgttcgccctgcccgacttcatcttcctgagcgcccaccacgacgagagactgaacgccacccactgccagtacaacttcccccaggtgggcagaaccgccctgagagtgctgcagctggtggccggcttcctgctgcccctgctggtgatggcctactgctacgcccacatcctggccgtgctgctggtgagcagaggccagagaagactgagagccatgagactggtggtggtggtggtggtggccttcgccctgtgctggaccccctaccacctggtggtgctggtggacatcctgatggacctgggcgccctggccagaaactgcggcagagagagcagagtggacgtggccaagagcgtgaccagcggcctgggctacatgcactgctgcctgaaccccctgctgtacgccttcgtgggcgtgaagttcagagagagaatgtggatgctgctgctgagactgggctgccccaaccagagaggcctgcagagacagcccagcagcagcagaagagacagcagctggagcgagaccagcgaggccagctacagcggcctgtag

SEQ ID NO: 76495 - DNA, 1119 bp, Artificial Sequence
  Description of Artificial Sequence: Synthetic coding sequence
atgaactaccccctgaccctggagatggacctggagaacctggaggacctgttctgggagctggacagactggacaactacaacgacaccagcctggtggagaaccacctgtgccccgccaccgagggccccctgatggccagcttcaaggccgtgttcgtgcccgtggcctacagcctgatcttcctgctgggcgtgatcggcaacgtgctggtgctggtgatcctggagagacacagacagaccagaagcagcaccgagaccttcctgttccacctggccgtggccgacctgctgctggtgttcatcctgcccttcgccgtggccgagggcagcgtgggctgggtgctgggcaccttcctgtgcaagaccgtgatcgccctgcacaaggtgaacttctactgcagcagcctgctgctggcctgcatcgccgtggacagatacctggccatcgtgcacgccgtgcacgcctacagacacagaagactgctgagcatccacatcacctgcggcaccatctggctggtgggcttcctgctggccctgcccgagatcctgttcgccaaggtgagccagggccaccacaacaacagcctgcccagatgcaccttcagccaggagaaccaggccgagacccacgcctggttcaccagcagattcctgtaccacgtggccggcttcctgctgcccatgctggtgatgggctggtgctacgtgggcgtggtgcacagactgagacaggcccagagaagaccccagagacagaaggccgtgagagtggccatcctggtgaccagcatcttcttcctgtgctggagcccctaccacatcgtgatcttcctggacaccctggccagactgaaggccgtggacaacacctgcaagctgaacggcagcctgcccgtggccatcaccatgtgcgagttcctgggcctggcccactgctgcctgaaccccatgctgtacaccttcgccggcgtgaagttcagaagcgacctgagcagactgctgaccaagctgggctgcaccggccccgccagcctgtgccagctgttccccagctggagaagaagcagcctgagcgagagcgagaacgccaccagcctgaccaccttctag

SEQ ID NO: 76496 - DNA, 1029 bp, Artificial Sequence
  Description of Artificial Sequence: Synthetic coding sequence
atggccgagcacgactaccacgaggactacggcttcagcagcttcaacgacagcagccaggaggagcaccaggacttcctgcagttcagcaaggtgttcctgccctgcatgtacctggtggtgttcgtgtgcggcctggtgggcaacagcctggtgctggtgatcagcatcttctaccacaagctgcagagcctgaccgacgtgttcctggtgaacctgcccctggccgacctggtgttcgtgtgcaccctgcccttctgggcctacgccggcatccacgagtgggtgttcggccaggtgatgtgcaagagcctgctgggcatctacaccatcaacttctacaccagcatgctgatcctgacctgcatcaccgtggacagattcatcgtggtggtgaaggccaccaaggcctacaaccagcaggccaagagaatgacctggggcaaggtgaccagcctgctgatctgggtgatcagcctgctggtgagcctgccccagatcatctacggcaacgtgttcaacctggacaagctgatctgcggctaccacgacgaggccatcagcaccgtggtgctggccacccagatgaccctgggcttcttcctgcccctgctgaccatgatcgtgtgctacagcgtgatcatcaagaccctgctgcacgccggcggcttccagaagcacagaagcctgaagatcatcttcctggtgatggccgtgttcctgctgacccagatgcccttcaacctgatgaagttcatcagaagcacccactgggagtactacgccatgaccagcttccactacaccatcatggtgaccgaggccatcgcctacctgagagcctgcctgaaccccgtgctgtacgccttcgtgagcctgaagttcagaaagaacttctggaagctggtgaaggacatcggctgcctgccctacctgggcgtgagccaccagtggaagagcagcgaggacaacagcaagaccttcagcgccagccacaacgtggaggccaccagcatgttccagctgtag

SEQ ID NO: 76497 - DNA, 1029 bp, Artificial Sequence; identical to SEQ ID NO: 76496
  Description of Artificial Sequence: Synthetic coding sequence

SEQ ID NO: 76498 - DNA, 1029 bp, Artificial Sequence; identical to SEQ ID NO: 76496
  Description of Artificial Sequence: Synthetic coding sequence

SEQ ID NO: 76499 - DNA, 1029 bp, Artificial Sequence; identical to SEQ ID NO: 76496
  Description of Artificial Sequence: Synthetic coding sequence

SEQ ID NO: 76500 - DNA, 1089 bp, Artificial Sequence
  Description of Artificial Sequence: Synthetic coding sequence
atggacctgcacctgttcgactacagcgagcccggcaacttcagcgacatcagctggccctgcaacagcagcgactgcatcgtggtggacaccgtgatgtgccccaacatgcccaacaagagcgtgctgctgtacaccctgagcttcatctacatcttcatcttcgtgatcggcatgatcgccaacagcgtggtggtgtgggtgaacatccaggccaagaccaccggctacgacacccactgctacatcctgaacctggccatcgccgacctgtgggtggtgctgaccatccccgtgtgggtggtgagcctggtgcagcacaaccagtggcccatgggcgagctgacctgcaaggtgacccacctgatcttcagcatcaacctgttcggcagcatcttcttcctgacctgcatgagcgtggacagatacctgagcatcacctacttcaccaacacccccagcagcagaaagaagatggtgagaagagtggtgtgcatcctggtgtggctgctggccttctgcgtgagcctgcccgacacctactacctgaagaccgtgaccagcgccagcaacaacgagacctactgcagaagcttctaccccgagcacagcatcaaggagtggctgatcggcatggagctggtgagcgtggtgctgggcttcgccgtgcccttcagcatcatcgccgtgttctacttcctgctggccagagccatcagcgccagcagcgaccaggagaagcacagcagcagaaagatcatcttcagctacgtggtggtgttcctggtgtgctggctgccctaccacgtggccgtgctgctggacatcttcagcatcctgcactacatccccttcacctgcagactggagcacgccctgttcaccgccctgcacgtgacccagtgcctgagcctggtgcactgctgcgtgaaccccgtgctgtacagcttcatcaacagaaactacagatacgagctgatgaaggccttcatcttcaagtacagcgccaagaccggcctgaccaagctgatcgacgccagcagagtgagcgagaccgagtacagcgccctggagcagagcaccaagtag

SEQ ID NO: 76501 - DNA, 636 bp, Artificial Sequence
  Description of Artificial Sequence: Synthetic coding sequence
atggacctgcacctgttcgactacagcgagcccggcaacttcagcgacatcagctggccctgcaacagcagcgactgcatcgtggtggacaccgtgatgtgccccaacatgcccaacaagagcgtgctgctgtacaccctgagcttcatctacatcttcatcttcgtgatcggcatgatcgccaacagcgtggtggtgtgggtgaacatccaggccaagaccaccggctacgacacccactgctacatcctgaacctggccatcgccgacctgtgggtggtgctgaccatccccgtgtgggtggtgagcctggtgcagcacaaccagtggcccatgggcgagctgacctgcaaggtgacccacctgatcttcagcatcaacctgttcggcagcatcttcttcctgacctgcatgagcgtggacagatacctgagcatcacctacttcaccaacacccccagcagcagaaagaagatggtgagaagagtggtgtgcatcctggtgtggctgctggccttctgcgtgagcctgcccgacacctactacctgaagaccgtgaccagcgccagcaacaacgagacctactgcagaagcttctaccccgagcacagcatcaaggagtggctgatcggctag

SEQ ID NO: 76502 - DNA, 1155 bp, Artificial Sequence
  Description of Artificial Sequence: Synthetic coding sequence
atggccgccaccgccagcccccagcccctggccaccgaggacgccgacagcgagaacagcagcttctactactacgactacctggacgaggtggccttcatgctgtgcagaaaggacgccgtggtgagcttcggcaaggtgttcctgcccgtgttctacagcctgatcttcgtgctgggcctgagcggcaacctgctgctgctgatggtgctgctgagatacgtgcccagaagaagaatggtggagatctacctgctgaacctggccatcagcaacctgctgttcctggtgaccctgcccttctggggcatcagcgtggcctggcactgggtgttcggcagcttcctgtgcaagatggtgagcaccctgtacaccatcaacttctacagcggcatcttcttcatcagctgcatgagcctggacaagtacctggagatcgtgcacgcccagccctaccacagactgagaaccagagccaagagcctgctgctggccaccatcgtgtgggccgtgagcctggccgtgagcatccccgacatggtgttcgtgcagacccacgagaaccccaagggcgtgtggaactgccacgccgacttcggcggccacggcaccatctggaagctgttcctgagattccagcagaacctgctgggcttcctgctgcccctgctggccatgatcttcttctacagcagaatcggctgcgtgctggtgagactgagacccgccggccagggcagagccctgaagatcgccgccgccctggtggtggccttcttcgtgctgtggttcccctacaacctgaccctgttcctgcacaccctgctggacctgcaggtgttcggcaactgcgaggtgagccagcacctggactacgccctgcaggtgaccgagagcatcgccttcctgcactgctgcttcagccccatcctgtacgccttcagcagccacagattcagacagtacctgaaggccttcctggccgccgtgctgggctggcacctggcccccggcaccgcccaggccagcctgagcagctgcagcgagagcagcatcctgaccgcccaggaggagatgaccggcatgaacgacctgggcgagagacagagcgagaactaccccaacaaggaggacgtgggcaacaagagcgcctag

SEQ ID NO: 76503 - DNA, 1155 bp, Artificial Sequence; identical to SEQ ID NO: 76502
  Description of Artificial Sequence: Synthetic coding sequence

SEQ ID NO: 76504 - DNA, 1155 bp, Artificial Sequence; identical to SEQ ID NO: 76502
  Description of Artificial Sequence: Synthetic coding sequence

SEQ ID NO: 76505 - DNA, 1122 bp, Artificial Sequence
  Description of Artificial Sequence: Synthetic coding sequence
atgagaatggaggacgaggactacaacaccagcatcagctacggcgacgagtaccccgactacctggacagcatcgtggtgctggaggacctgagccccctggaggccagagtgaccagaatcttcctggtggtggtgtacagcatcgtgtgcttcctgggcatcctgggcaacggcctggtgatcatcatcgccaccttcaagatgaagaagaccgtgaacatggtgtggttcctgaacctggccgtggccgacttcctgttcaacgtgttcctgcccatccacatcacctacgccgccatggactaccactgggtgttcggcaccgccatgtgcaagatcagcaacttcctgctgatccacaacatgttcaccagcgtgttcctgctgaccatcatcagcagcgacagatgcatcagcgtgctgctgcccgtgtggagccagaaccacagaagcgtgagactggcctacatggcctgcatggtgatctgggtgctggccttcttcctgagcagccccagcctggtgttcagagacaccgccaacctgcacggcaagatcagctgcttcaacaacttcagcctgagcacccccggcagcagcagctggcccacccacagccagatggaccccgtgggctacagcagacacatggtggtgaccgtgaccagattcctgtgcggcttcctggtgcccgtgctgatcatcaccgcctgctacctgaccatcgtgtgcaagctgcagagaaacagactggccaagaccaagaagcccttcaagatcatcgtgaccatcatcatcaccttcttcctgtgctggtgcccctaccacaccctgaacctgctggagctgcaccacaccgccatgcccggcagcgtgttcagcctgggcctgcccctggccaccgccctggccatcgccaacagctgcatgaaccccatcctgtacgtgttcatgggccaggacttcaagaagttcaaggtggccctgttcagcagactggtgaacgccctgagcgaggacaccggccacagcagctaccccagccacagaagcttcaccaagatgagcagcatgaacgagagaaccagcatgaacgagagagagaccggcatgctgtag

SEQ ID NO: 76506 - DNA, 1116 bp, Artificial Sequence
  Description of Artificial Sequence: Synthetic coding sequence
atggaggacgaggactacaacaccagcatcagctacggcgacgagtaccccgactacctggacagcatcgtggtgctggaggacctgagccccctggaggccagagtgaccagaatcttcctggtggtggtgtacagcatcgtgtgcttcctgggcatcctgggcaacggcctggtgatcatcatcgccaccttcaagatgaagaagaccgtgaacatggtgtggttcctgaacctggccgtggccgacttcctgttcaacgtgttcctgcccatccacatcacctacgccgccatggactaccactgggtgttcggcaccgccatgtgcaagatcagcaacttcctgctgatccacaacatgttcaccagcgtgttcctgctgaccatcatcagcagcgacagatgcatcagcgtgctgctgcccgtgtggagccagaaccacagaagcgtgagactggcctacatggcctgcatggtgatctgggtgctggccttcttcctgagcagccccagcctggtgttcagagacaccgccaacctgcacggcaagatcagctgcttcaacaacttcagcctgagcacccccggcagcagcagctggcccacccacagccagatggaccccgtgggctacagcagacacatggtggtgaccgtgaccagattcctgtgcggcttcctggtgcccgtgctgatcatcaccgcctgctacctgaccatcgtgtgcaagctgcagagaaacagactggccaagaccaagaagcccttcaagatcatcgtgaccatcatcatcaccttcttcctgtgctggtgcccctaccacaccctgaacctgctggagctgcaccacaccgccatgcccggcagcgtgttcagcctgggcctgcccctggccaccgccctggccatcgccaacagctgcatgaaccccatcctgtacgtgttcatgggccaggacttcaagaagttcaaggtggccctgttcagcagactggtgaacgccctgagcgaggacaccggccacagcagctaccccagccacagaagcttcaccaagatgagcagcatgaacgagagaaccagcatgaacgagagagagaccggcatgctgtag

SEQ ID NO: 76507 - DNA, 1122 bp, Artificial Sequence; identical to SEQ ID NO: 76505
  Description of Artificial Sequence: Synthetic coding sequence

SEQ ID NO: 76508 - DNA, 432 bp, Artificial Sequence
  Description of Artificial Sequence: Synthetic coding sequence
atgagaatggaggacgaggactacaacaccagcatcagctacggcgacgagtaccccgactacctggacagcatcgtggtgctggaggacctgagccccctggaggccagagtgaccagaatcttcctggtggtggtgtacagcatcgtgtgcttcctgggcatcctgggcaacggcctggtgatcatcatcgccaccttcaagatgaagaagaccgtgaacatggtgtggttcctgaacctggccgtggccgacttcctgttcaacgtgttcctgcccatccacatcacctacgccgccatggactaccactgggtgttcggcaccgccatgtgcaagatcagcaacttcctgctgatccacaacatgttcaccagcgtgttcctgctgaccatcatcagcagcgacagatgcatcagcgtgctgctgtag

SEQ ID NO: 76509 - DNA, 1122 bp, Artificial Sequence; identical to SEQ ID NO: 76505
  Description of Artificial Sequence: Synthetic coding sequence

SEQ ID NO: 76510 - DNA, 444 bp, Artificial Sequence
  Description of Artificial Sequence: Synthetic coding sequence
atgagaatggaggacgaggactacaacaccagcatcagctacggcgacgagtaccccgactacctggacagcatcgtggtgctggaggacctgagccccctggaggccagagtgaccagaatcttcctggtggtggtgtacagcatcgtgtgcttcctgggcatcctgggcaacggcctggtgatcatcatcgccaccttcaagatgaagaagaccgtgaacatggtgtggttcctgaacctggccgtggccgacttcctgttcaacgtgttcctgcccatccacatcacctacgccgccatggactaccactgggtgttcggcaccgccatgtgcaagatcagcaacttcctgctgatccacaacatgttcaccagcgtgttcctgctgaccatcatcagcagcgacagatgcatcagcgtgctgctgcccgtgtggagctag

SEQ ID NO: 76511 - DNA, 1116 bp, Artificial Sequence; identical to SEQ ID NO: 76506
  Description of Artificial Sequence: Synthetic coding sequence

SEQ ID NO: 76512 - DNA, 1005 bp, Artificial Sequence
  Description of Artificial Sequence: Synthetic coding sequence
atgcccagcaaggagagctggagcggcagaaagaccaacagagccgccgtgcacaagagcaagcaggagggcagacagcaggacctgctgatcgccgccctgggcatgaagctgggcagccccaagagcagcgtgaccatctggcagcccctgaagctgttcgcctacagccagctgaccagcctggtgagaagagccaccctgaaggagaacgagcagatccccaagtacgagaagatccacaacttcaaggtgcacaccttcagaggcccccactggtgcgagtactgcgccaacttcatgtggggcctgatcgcccagggcgtgaagtgcgccgactgcggcctgaacgtgcacaagcagtgcagcaagatggtgcccaacgactgcaagcccgacctgaagcacgtgaagaaggtgtacagctgcgacctgaccaccctggtgaaggcccacaccaccaagagacccatggtggtggacatgtgcatcagagagatcgagagcagaggcctgaacagcgagggcctgtacagagtgagcggcttcagcgacctgatcgaggacgtgaagatggccttcgacagagacggcgagaaggccgacatcagcgtgaacatgtacgaggacatcaacatcatcaccggcgccctgaagctgtacttcagagacctgcccatccccctgatcacctacgacgcctaccccaagttcatcgagagcgccaagatcatggaccccgacgagcagctggagaccctgcacgaggccctgaagctgctgccccccgcccactgcgagaccctgagatacctgatggcccacctgaagagagtgaccctgcacgagaaggagaacctgatgaacgccgagaacctgggcatcgtgttcggccccaccctgatgagaagccccgagctggacgccatggccgccctgaacgacatcagataccagagactggtggtggagctgctgatcaagaacgaggacatcctgttctag

SEQ ID NO: 76513 - DNA, 1302 bp, Artificial Sequence
  Description of Artificial Sequence: Synthetic coding sequence
atggccctgaccctgttcgacaccgacgagtacagaccccccgtgtggaagagctacctgtaccagctgcagcaggaggccccccaccccagaagaatcacctgcacctgcgaggtggagaacagacccaagtactacggcagagagttccacggcatgatcagcagagaggccgccgaccagctgctgatcgtggccgagggcagctacctgatcagagagagccagagacagcccggcacctacaccctggccctgagattcggcagccagaccagaaacttcagactgtactacgacggcaagcacttcgtgggcgagaagagattcgagagcatccacgacctggtgaccgacggcctgatcaccctgtacatcgagaccaaggccgccgagtacatcgccaagatgaccatcaaccccatctacgagcacgtgggctacaccaccctgaacagagagcccgcctacaagaagcacatgcccgtgctgaaggagacccacgacgagagagacagcaccggccaggacggcgtgagcgagaagagagtgcacaccttcagaggcccccactggtgcgagtactgcgccaacttcatgtggggcctgatcgcccagggcgtgaagtgcgccgactgcggcctgaacgtgcacaagcagtgcagcaagatggtgcccaacgactgcaagcccgacctgaagcacgtgaagaaggtgtacagctgcgacctgaccaccctggtgaaggcccacaccaccaagagacccatggtggtggacatgtgcatcagagagatcgagagcagaggcctgaacagcgagggcctgtacagagtgagcggcttcagcgacctgatcgaggacgtgaagatggccttcgacagagacggcgagaaggccgacatcagcgtgaacatgtacgaggacatcaacatcatcaccggcgccctgaagctgtacttcagagacctgcccatccccctgatcacctacgacgcctaccccaagttcatcgagagcgccaagatcatggaccccgacgagcagctggagaccctgcacgaggccctgaagctgctgccccccgcccactgcgagaccctgagatacctgatggcccacctgaagagagtgaccctgcacgagaaggagaacctgatgaacgccgagaacctgggcatcgtgttcggccccaccctgatgagaagccccgagctggacgccatggccgccctgaacgacatcagataccagagactggtggtggagctgctgatcaagaacgaggacatcctgttctag

SEQ ID NO: 76514 - DNA, 1380 bp, Artificial Sequence
  Description of Artificial Sequence: Synthetic coding sequence
atggccctgaccctgttcgacaccgacgagtacagaccccccgtgtggaagagctacctgtaccagctgcagcaggaggccccccaccccagaagaatcacctgcacctgcgaggtggagaacagacccaagtactacggcagagagttccacggcatgatcagcagagaggccgccgaccagctgctgatcgtggccgagggcagctacctgatcagagagagccagagacagcccggcacctacaccctggccctgagattcggcagccagaccagaaacttcagactgtactacgacggcaagcacttcgtgggcgagaagagattcgagagcatccacgacctggtgaccgacggcctgatcaccctgtacatcgagaccaaggccgccgagtacatcgccaagatgaccatcaaccccatctacgagcacgtgggctacaccaccctgaacagagagcccgcctacaagaagcacatgcccgtgctgaaggagacccacgacgagagagacagcaccggccaggacggcgtgagcgagaagagactgaccagcctggtgagaagagccaccctgaaggagaacgagcagatccccaagtacgagaagatccacaacttcaaggtgcacaccttcagaggcccccactggtgcgagtactgcgccaacttcatgtggggcctgatcgcccagggcgtgaagtgcgccgactgcggcctgaacgtgcacaagcagtgcagcaagatggtgcccaacgactgcaagcccgacctgaagcacgtgaagaaggtgtacagctgcgacctgaccaccctggtgaaggcccacaccaccaagagacccatggtggtggacatgtgcatcagagagatcgagagcagaggcctgaacagcgagggcctgtacagagtgagcggcttcagcgacctgatcgaggacgtgaagatggccttcgacagagacggcgagaaggccgacatcagcgtgaacatgtacgaggacatcaacatcatcaccggcgccctgaagctgtacttcagagacctgcccatccccctgatcacctacgacgcctaccccaagttcatcgagagcgccaagatcatggaccccgacgagcagctggagaccctgcacgaggccctgaagctgctgccccccgcccactgcgagaccctgagatacctgatggcccacctgaagagagtgaccctgcacgagaaggagaacctgatgaacgccgagaacctgggcatcgtgttcggccccaccctgatgagaagccccgagctggacgccatggccgccctgaacgacatcagataccagagactggtggtggagctgctgatcaagaacgaggacatcctgttctag

SEQ ID NO: 76515 - DNA, 1167 bp, Artificial Sequence
  Description of Artificial Sequence: Synthetic coding sequence
atgaccgccagcgtgctgctgcaccccagatggatcgagcccaccgtgatgttcctgtacgacaacggcggcggcctggtggccgacgagctgaacaagaacatggagggcgccgccgccgccgccgccgccgccgccgccgccgccgccgccggcgccggcggcggcggcttcccccaccccgccgccgccgccgccggcggcaacttcagcgtggccgccgccgccgccgccgccgccgccgccgccgccaaccagtgcagaaacctgatggcccaccccgcccccctggcccccggcgccgccagcgcctacagcagcgcccccggcgaggccccccccagcgccgccgccgccgccgccgccgccgccgccgccgccgccgccgccgccgccgccagcagcagcggcggccccggccccgccggccccgccggcgccgaggccgccaagcagtgcagcccctgcagcgccgccgcccagagcagcagcggccccgccgccctgccctacggctacttcggcagcggctactacccctgcgccagaatgggcccccaccccaacgccatcaagagctgcgcccagcccgccagcgccgccgccgccgccgccttcgccgacaagtacatggacaccgccggccccgccgccgaggagttcagcagcagagccaaggagttcgccttctaccaccagggctacgccgccggcccctaccaccaccaccagcccatgcccggctacctggacatgcccgtggtgcccggcctgggcggccccggcgagagcagacacgagcccctgggcctgcccatggagagctaccagccctgggccctgcccaacggctggaacggccagatgtactgccccaaggagcaggcccagcccccccacctgtggaagagcaccctgcccgacgtggtgagccaccccagcgacgccagcagctacagaagaggcagaaagaagagagtgccctacaccaaggtgcagctgaaggagctggagagagagtacgccaccaacaagttcatcaccaaggacaagagaagaagaatcagcgccaccaccaacctgagcgagagacaggtgaccatctggttccagaacagaagagtgaaggagaagaaggtgatcaacaagctgaagaccaccagctag

SEQ ID NO: 76516 - DNA, 999 bp, Artificial Sequence
  Description of Artificial Sequence: Synthetic coding sequence
atgttcagcgaggagctgtggctggagaacgagaagaagtgcgccgtggtgagaaagagcaagcagggcagaaagagacaggagctgctggccgtggccttcggcgtgaaggtgggcgtgaagggcggcttcctgtggccccccctgaagctgttcgcctgcagccagatcagcagcctggtgagaagagccgccctgacccacaacgacaaccacttcaactacgagaagacccacaacttcaaggtgcacaccttcagaggcccccactggtgcgagtactgcgccaacttcatgtggggcctgatcgcccagggcgtgagatgcagcgactgcggcctgaacgtgcacaagcagtgcagcaagcacgtgcccaacgactgccagcccgacctgaagagaatcaagaaggtgtactgctgcgacctgaccaccctggtgaaggcccacaacacccagagacccatggtggtggacatctgcatcagagagatcgaggccagaggcctgaagagcgagggcctgtacagagtgagcggcttcaccgagcacatcgaggacgtgaagatggccttcgacagagacggcgagaaggccgacatcagcgccaacgtgtaccccgacatcaacatcatcaccggcgccctgaagctgtacttcagagacctgcccatccccgtgatcacctacgacacctacagcaagttcatcgacgccgccaagatcagcaacgccgacgagagactggaggccgtgcacgaggtgctgatgctgctgccccccgcccactacgagaccctgagatacctgatgatccacctgaagaaggtgaccatgaacgagaaggacaacttcatgaacgccgagaacctgggcatcgtgttcggccccaccctgatgagaccccccgaggacagcaccctgaccaccctgcacgacatgagataccagaagctgatcgtgcagatcctgatcgagaacgaggacgtgctgttctag

SEQ ID NO: 76517 - DNA, 525 bp, Artificial Sequence
  Description of Artificial Sequence: Synthetic coding sequence
atggccgccagcagcaacagcagcctgagcggcagcagcgtgagcagcgtgtacagcgagcccagaagccccagagagctgcccaagtacgccgaggagtaccagccccccatctggaagagctacctgtaccagctgcagcaggaggcccccagacccaagagaatcatctgccccagagaggtggagaacagacccaagtactacggcagagagttccacggcatcatcagcagagagcaggccgacgagctgctgggcggcgtggagggcgcctacatcctgagagagagccagagacagcccggctgctacaccctggccctgagattcggcaaccagaccctgaactacagactgttccacgacggcaagcacttcgtgggcgagaagagattcgagagcatccacgacctggtgaccgacggcctgatcaccctgtacatcgagaccaaggccgccgagtacatcagcaagatgaccaccaaccccatctacgagcacatcggctacgccaccctgtag

SEQ ID NO: 76518 - DNA, 825 bp, Artificial Sequence
  Description of Artificial Sequence: Synthetic coding sequence
atgttcagcgaggagctgtggctggagaacgagaagaagtgcgccgtggtgagaaagagcaagcagggcagaaagagacaggagctgctggccgtggccttcggcgtgaaggtgggcgtgaagggcggcttcctgtggccccccctgaagctgttcgcctgcagccagatcagcagcctggtgagaagagccgccctgacccacaacgacaaccacttcaactacgagaagacccacaacttcaaggtgcacaccttcagaggcccccactggtgcgagtactgcgccaacttcatgtggggcctgatcgcccagggcgtgagatgcagcggcctgaagagcgagggcctgtacagagtgagcggcttcaccgagcacatcgaggacgtgaagatggccttcgacagagacggcgagaaggccgacatcagcgccaacgtgtaccccgacatcaacatcatcaccggcgccctgaagctgtacttcagagacctgcccatccccgtgatcacctacgacacctacagcaagttcatcgacgccgccaagatcagcaacgccgacgagagactggaggccgtgcacgaggtgctgatgctgctgccccccgcccactacgagaccctgagatacctgatgatccacctgaagaaggtgaccatgaacgagaaggacaacttcatgaacgccgagaacctgggcatcgtgttcggccccaccctgatgagaccccccgaggacagcaccctgaccaccctgcacgacatgagataccagaagctgatcgtgcagatcctgatcgagaacgaggacgtgctgttctag

SEQ ID NO: 76519 - DNA, 864 bp, Artificial Sequence
  Description of Artificial Sequence: Synthetic coding sequence
atgttcagcgaggagctgtggctggagaacgagaagaagtgcgccgtggtgagaaagagcaagcagggcagaaagagacaggagctgctggccgtggccttcggcgtgaaggtgcacaccttcagaggcccccactggtgcgagtactgcgccaacttcatgtggggcctgatcgcccagggcgtgagatgcagcgactgcggcctgaacgtgcacaagcagtgcagcaagcacgtgcccaacgactgccagcccgacctgaagagaatcaagaaggtgtactgctgcgacctgaccaccctggtgaaggcccacaacacccagagacccatggtggtggacatctgcatcagagagatcgaggccagaggcctgaagagcgagggcctgtacagagtgagcggcttcaccgagcacatcgaggacgtgaagatggccttcgacagagacggcgagaaggccgacatcagcgccaacgtgtaccccgacatcaacatcatcaccggcgccctgaagctgtacttcagagacctgcccatccccgtgatcacctacgacacctacagcaagttcatcgacgccgccaagatcagcaacgccgacgagagactggaggccgtgcacgaggtgctgatgctgctgccccccgcccactacgagaccctgagatacctgatgatccacctgaagaaggtgaccatgaacgagaaggacaacttcatgaacgccgagaacctgggcatcgtgttcggccccaccctgatgagaccccccgaggacagcaccctgaccaccctgcacgacatgagataccagaagctgatcgtgcagatcctgatcgagaacgaggacgtgctgttctag

SEQ ID NO: 76520 - DNA, 579 bp, Artificial Sequence
  Description of Artificial Sequence: Synthetic coding sequence
atggccgccagcagcaacagcagcctgagcggcagcagcgtgagcagcgacgccgaggagtaccagccccccatctggaagagctacctgtaccagctgcagcaggaggcccccagacccaagagaatcatctgccccagagaggtggagaacagacccaagtactacggcagagagttccacggcatcatcagcagagagcaggccgacgagctgctgggcggcgtggagggcgcctacatcctgagagagagccagagacagcccggctgctacaccctggccctgagaaaccccaccaagatcagcaacgccgacgagagactggaggccgtgcacgaggtgctgatgctgctgccccccgcccactacgagaccctgagatacctgatgatccacctgaagaaggtgaccatgaacgagaaggacaacttcatgaacgccgagaacctgggcatcgtgttcggccccaccctgatgagaccccccgaggacagcaccctgaccaccctgcacgacatgagataccagaagctgatcgtgcagatcctgatcgagaacgaggacgtgctgttctag

SEQ ID NO: 76521 - DNA, 861 bp, Artificial Sequence
  Description of Artificial Sequence: Synthetic coding sequence
atgttcagcgaggagctgtggctggagaacgagaagaagtgcgccgtggtgagaaagagcaagcagggcagaaagagacaggagctgctggccgtggccttcggcgtgaaggtgggcgtgaagggcggcttcctgtggccccccctgaagctgttcgcctgcagccagatcagcagcctggtgagaagagccgccctgacccacaacgacaaccacttcaactacgagaagacccacaacttcaaggtgcacaccttcagaggcccccactggtgcgagtactgcgccaacttcatgtggggcctgatcgcccagggcgtgagatgcagcgactgcggcctgaacgtgcacaagcagtgcagcaagcacgtgcccaacgactgccagcccgacctgaagagaatcaagaaggtgtactgctgcgacctgaccaccctggtgaaggcccacaacacccagagacccatggtggtggacatctgcatcagagagatcgaggccagaggcctgaagagcgagggcctgtacagagtgagcggcttcaccgagcacatcgaggacgtgaagatggccttcgacagagagatcagcaacgccgacgagagactggaggccgtgcacgaggtgctgatgctgctgccccccgcccactacgagaccctgagatacctgatgatccacctgaagaaggtgaccatgaacgagaaggacaacttcatgaacgccgagaacctgggcatcgtgttcggccccaccctgatgagaccccccgaggacagcaccctgaccaccctgcacgacatgagataccagaagctgatcgtgcagatcctgatcgagaacgaggacgtgctgttctag

SEQ ID NO: 76522 - DNA, 1446 bp, Artificial Sequence
  Description of Artificial Sequence: Synthetic coding sequence
atggccgccagcagcaacagcagcctgagcggcagcagcgtgagcagcgtgtacagcgagcccagaagccccagagagctgcccaagtacgccgaggagtaccagccccccatctggaagagctacctgtaccagctgcagcaggaggcccccagacccaagagaatcatctgccccagagaggtggagaacagacccaagtactacggcagagagttccacggcatcatcagcagagagcaggccgacgagctgctgggcggcgtggagggcgcctacatcctgagagagagccagagacagcccggctgctacaccctggccctgagattcggcaaccagaccctgaactacagactgttccacgacggcaagcacttcgtgggcgagaagagattcgagagcatccacgacctggtgaccgacggcctgatcaccctgtacatcgagaccaaggccgccgagtacatcagcaagatgaccaccaaccccatctacgagcacatcggctacgccaccctgctgagagagaaggtgagcagaagactgagcagaagcaagaacgagcccagaaagaccaacgtgacccacgaggagcacaccgccgtggagaagatcagcagcctggtgagaagagccgccctgacccacaacgacaaccacttcaactacgagaagacccacaacttcaaggtgcacaccttcagaggcccccactggtgcgagtactgcgccaacttcatgtggggcctgatcgcccagggcgtgagatgcagcgactgcggcctgaacgtgcacaagcagtgcagcaagcacgtgcccaacgactgccagcccgacctgaagagaatcaagaaggtgtactgctgcgacctgaccaccctggtgaaggcccacaacacccagagacccatggtggtggacatctgcatcagagagatcgaggccagaggcctgaagagcgagggcctgtacagagtgagcggcttcaccgagcacatcgaggacgtgaagatggccttcgacagagacggcgagaaggccgacatcagcgccaacgtgtaccccgacatcaacatcatcaccggcgccctgaagctgtacttcagagacctgcccatccccgtgatcacctacgacacctacagcaagttcatcgacgccgccaagatcagcaacgccgacgagagactggaggccgtgcacgaggtgctgatgctgctgccccccgcccactacgagaccctgagatacctgatgatccacctgaagaaggtgaccatgaacgagaaggacaacttcatgaacgccgagaacctgggcatcgtgttcggccccaccctgatgagaccccccgaggacagcaccctgaccaccctgcacgacatgagataccagaagctgatcgtgcagatcctgatcgagaacgaggacgtgctgttctag

SEQ ID NO: 76523 - DNA, 975 bp, Artificial Sequence
  Description of Artificial Sequence: Synthetic coding sequence
atggccgccagcagcaacagcagcctgagcggcagcagcgtgagcagcgacgccgaggagtaccagccccccatctggaagagctacctgtaccagctgcagcaggaggcccccagacccaagagaatcatctgccccagagagatcagcagcctggtgagaagagccgccctgacccacaacgacaaccacttcaactacgagaagacccacaacttcaaggtgcacaccttcagaggcccccactggtgcgagtactgcgccaacttcatgtggggcctgatcgcccagggcgtgagatgcagcgactgcggcctgaacgtgcacaagcagtgcagcaagcacgtgcccaacgactgccagcccgacctgaagagaatcaagaaggtgtactgctgcgacctgaccaccctggtgaaggcccacaacacccagagacccatggtggtggacatctgcatcagagagatcgaggccagaggcctgaagagcgagggcctgtacagagtgagcggcttcaccgagcacatcgaggacgtgaagatggccttcgacagagacggcgagaaggccgacatcagcgccaacgtgtaccccgacatcaacatcatcaccggcgccctgaagctgtacttcagagacctgcccatccccgtgatcacctacgacacctacagcaagttcatcgacgccgccaagatcagcaacgccgacgagagactggaggccgtgcacgaggtgctgatgctgctgccccccgcccactacgagaccctgagatacctgatgatccacctgaagaaggtgaccatgaacgagaaggacaacttcatgaacgccgagaacctgggcatcgtgttcggccccaccctgatgagaccccccgaggacagcaccctgaccaccctgcacgacatgagataccagaagctgatcgtgcagatcctgatcgagaacgaggacgtgctgttctag

SEQ ID NO: 76524 - DNA, 1632 bp, Artificial Sequence
  Description of Artificial Sequence: Synthetic coding sequence
atgacccagacccacagagccaagagcgccagcagctgccccaacctgctggtgcccgagacctggccccaccaggtgagcgccagccacgccggcagaagcaagcagccccagggcggcatcctgaagatcaacgaggagcacagaagaggcgccatccaggacctgctggccagccccggcttcaccttcggcaagagagtggtgttcgacagccactgcctgaagagacagcacaccttcgccgacggcctgcacagcagctgcaccagcaacgccgaggagtaccagccccccatctggaagagctacctgtaccagctgcagcaggaggcccccagacccaagagaatcatctgccccagagaggtggagaacagacccaagtactacggcagagagttccacggcatcatcagcagagagcaggccgacgagctgctgggcggcgtggagggcgcctacatcctgagagagagccagagacagcccggctgctacaccctggccctgagattcggcaaccagaccctgaactacagactgttccacgacggcaagcacttcgtgggcgagaagagattcgagagcatccacgacctggtgaccgacggcctgatcaccctgtacatcgagaccaaggccgccgagtacatcagcaagatgaccaccaaccccatctacgagcacatcggctacgccaccctgctgagagagaaggtgagcagaagactgagcagaagcaagaacgagcccagaaagaccaacgtgacccacgaggagcacaccgccgtggagaagatcagcagcctggtgagaagagccgccctgacccacaacgacaaccacttcaactacgagaagacccacaacttcaaggtgcacaccttcagaggcccccactggtgcgagtactgcgccaacttcatgtggggcctgatcgcccagggcgtgagatgcagcgactgcggcctgaacgtgcacaagcagtgcagcaagcacgtgcccaacgactgccagcccgacctgaagagaatcaagaaggtgtactgctgcgacctgaccaccctggtgaaggcccacaacacccagagacccatggtggtggacatctgcatcagagagatcgaggccagaggcctgaagagcgagggcctgtacagagtgagcggcttcaccgagcacatcgaggacgtgaagatggccttcgacagagacggcgagaaggccgacatcagcgccaacgtgtaccccgacatcaacatcatcaccggcgccctgaagctgtacttcagagacctgcccatccccgtgatcacctacgacacctacagcaagttcatcgacgccgccaagatcagcaacgccgacgagagactggaggccgtgcacgaggtgctgatgctgctgccccccgcccactacgagaccctgagatacctgatgatccacctgaagaaggtgaccatgaacgagaaggacaacttcatgaacgccgagaacctgggcatcgtgttcggccccaccctgatgagaccccccgaggacagcaccctgaccaccctgcacgacatgagataccagaagctgatcgtgcagatcctgatcgagaacgaggacgtgctgttctag

SEQ ID NO: 76525 - DNA, 1362 bp, Artificial Sequence
  Description of Artificial Sequence: Synthetic coding sequence
atggacgccgaggagtaccagccccccatctggaagagctacctgtaccagctgcagcaggaggcccccagacccaagagaatcatctgccccagagaggtggagaacagacccaagtactacggcagagagttccacggcatcatcagcagagagcaggccgacgagctgctgggcggcgtggagggcgcctacatcctgagagagagccagagacagcccggctgctacaccctggccctgagattcggcaaccagaccctgaactacagactgttccacgacggcaagcacttcgtgggcgagaagagattcgagagcatccacgacctggtgaccgacggcctgatcaccctgtacatcgagaccaaggccgccgagtacatcagcaagatgaccaccaaccccatctacgagcacatcggctacgccaccctgctgagagagaaggtgagcagaagactgagcagaagcaagaacgagcccagaaagaccaacgtgacccacgaggagcacaccgccgtggagaagatcagcagcctggtgagaagagccgccctgacccacaacgacaaccacttcaactacgagaagacccacaacttcaaggtgcacaccttcagaggcccccactggtgcgagtactgcgccaacttcatgtggggcctgatcgcccagggcgtgagatgcagcgactgcggcctgaacgtgcacaagcagtgcagcaagcacgtgcccaacgactgccagcccgacctgaagagaatcaagaaggtgtactgctgcgacctgaccaccctggtgaaggcccacaacacccagagacccatggtggtggacatctgcatcagagagatcgaggccagaggcctgaagagcgagggcctgtacagagtgagcggcttcaccgagcacatcgaggacgtgaagatggccttcgacagagacggcgagaaggccgacatcagcgccaacgtgtaccccgacatcaacatcatcaccggcgccctgaagctgtacttcagagacctgcccatccccgtgatcacctacgacacctacagcaagttcatcgacgccgccaagatcagcaacgccgacgagagactggaggccgtgcacgaggtgctgatgctgctgccccccgcccactacgagaccctgagatacctgatgatccacctgaagaaggtgaccatgaacgagaaggacaacttcatgaacgccgagaacctgggcatcgtgttcggccccaccctgatgagaccccccgaggacagcaccctgaccaccctgcacgacatgagataccagaagctgatcgtgcagatcctgatcgagaacgaggacgtgctgttctag

SEQ ID NO: 76526 - DNA, 1152 bp, Artificial Sequence
  Description of Artificial Sequence: Synthetic coding sequence
atgggcgtgaaggccagccagaccggcttcgtggtgctggtgctgctgcagtgctgcagcgcctacaagctggtgtgctactacaccagctggagccagtacagagagggcgacggcagctgcttccccgacgccctggacagattcctgtgcacccacatcatctacagcttcgccaacatcagcaacgaccacatcgacacctgggagtggaacgacgtgaccctgtacggcatgctgaacaccctgaagaacagaaaccccaacctgaagaccctgctgagcgtgggcggctggaacttcggcagccagagattcagcaagatcgccagcaacacccagagcagaagaaccttcatcaagagcgtgccccccttcctgagaacccacggcttcgacggcctggacctggcctggctgtaccccggcagaagagacaagcagcacttcaccaccctgatcaaggagatgaaggccgagttcatcaaggaggcccagcccggcaagaagcagctgctgctgagcgccgccctgagcgccggcaaggtgaccatcgacagcagctacgacatcgccaagatcagccagcacctggacttcatcagcatcatgacctacgacttccacggcgcctggagaggcaccaccggccaccacagccccctgttcagaggccaggaggacgccagccccgacagattcagcaacaccgactacgccgtgggctacatgctgagactgggcgcccccgccagcaagctggtgatgggcatccccaccttcggcagaagcttcaccctggccagcagcgagaccggcgtgggcgcccccatcagcggccccggcatccccggcagattcaccaaggaggccggcaccctggcctactacgagatctgcgacttcctgagaggcgccaccgtgcacagaatcctgggccagcaggtgccctacgccaccaagggcaaccagtgggtgggctacgacgaccaggagagcgtgaagagcaaggtgcagtacctgaaggacagacagctggccggcgccatggtgtgggccctggacctggacgacttccagggcagcttctgcggccaggacctgagattccccctgaccaacgccatcaaggacgccctggccgccacctag

SEQ ID NO: 76527 - DNA, 459 bp, Artificial Sequence
  Description of Artificial Sequence: Synthetic coding sequence
tgactgctgctgagcgccgccctgagcgccggcaaggtgaccatcgacagcagctacgacatcgccaagatcagccagcacctggacttcatcagcatcatgacctacgacttccacggcgcctggagaggcaccaccggccaccacagccccctgttcagaggccaggaggacgccagccccgacagattcagcaacaccatctgcgacttcctgagaggcgccaccgtgcacagaatcctgggccagcaggtgccctacgccaccaagggcaaccagtgggtgggctacgacgaccaggagagcgtgaagagcaaggtgcagtacctgaaggacagacagctggccggcgccatggtgtgggccctggacctggacgacttccagggcagcttctgcggccaggacctgagattccccctgaccaacgccatcaaggacgccctggccgccacctag

SEQ ID NO: 76528 - DNA, 306 bp, Artificial Sequence
  Description of Artificial Sequence: Synthetic coding sequence
atggtgagcacccccgagaacagacagaccttcatcaccagcgtgatcaagttcctgagacagtacgagttcgacggcctggacttcgactgggagtaccccggcagcagaggcagccccccccaggacaagcacctgttcaccgtgctggtgcagatgagaaagctgaagtacagagaggacctgagcaacctgcccaagatcacccagctggtgggcatcatcaccagcagcgccgtgtggccccagagccccctgctgctgagcatcaccctgggctgccccctgctgctgagaaacgcctag

SEQ ID NO: 76529 - DNA, 1431 bp, Artificial Sequence
  Description of Artificial Sequence: Synthetic coding sequence
atgaccaagctgatcctgctgaccggcctggtgctgatcctgaacctgcagctgggcagcgcctaccagctgacctgctacttcaccaactgggcccagtacagacccggcctgggcagattcatgcccgacaacatcgacccctgcctgtgcacccacctgatctacgccttcgccggcagacagaacaacgagatcaccaccatcgagtggaacgacgtgaccctgtaccaggccttcaacggcctgaagaacaagaacagccagctgaagaccctgctggccatcggcggctggaacttcggcaccgcccccttcaccgccatggtgagcacccccgagaacagacagaccttcatcaccagcgtgatcaagttcctgagacagtacgagttcgacggcctggacttcgactgggagtaccccggcagcagaggcagccccccccaggacaagcacctgttcaccgtgctggtgcaggagatgagagaggccttcgagcaggaggccaagcagatcaacaagcccagactgatggtgaccgccgccgtggccgccggcatcagcaacatccagagcggctacgagatcccccagctgagccagtacctggactacatccacgtgatgacctacgacctgcacggcagctgggagggctacaccggcgagaacagccccctgtacaagtaccccaccgacaccggcagcaacgcctacctgaacgtggactacgtgatgaactactggaaggacaacggcgcccccgccgagaagctgatcgtgggcttccccacctacggccacaacttcatcctgagcaaccccagcaacaccggcatcggcgcccccaccagcggcgccggccccgccggcccctacgccaaggagagcggcatctgggcctactacgagatctgcaccttcctgaagaacggcgccacccagggctgggacgccccccaggaggtgccctacgcctaccagggcaacgtgtgggtgggctacgacaacatcaagagcttcgacatcaaggcccagtggctgaagcacaacaagttcggcggcgccatggtgtgggccatcgacctggacgacttcaccggcaccttctgcaaccagggcaagttccccctgatcagcaccctgaagaaggccctgggcctgcagagcgccagctgcaccgcccccgcccagcccatcgagcccatcaccgccgcccccagcggcagcggcaacggcagcggcagcagcagcagcggcggcagcagcggcggcagcggcttctgcgccgtgagagccaacggcctgtaccccgtggccaacaacagaaacgccttctggcactgcgtgaacggcgtgacctaccagcagaactgccaggccggcctggtgttcgacaccagctgcgactgctgcaactgggcctag

SEQ ID NO: 76530 - DNA, 948 bp, Artificial Sequence
  Description of Artificial Sequence: Synthetic coding sequence
atgagagaggccttcgagcaggaggccaagcagatcaacaagcccagactgatggtgaccgccgccgtggccgccggcatcagcaacatccagagcggctacgagatcccccagctgagccagtacctggactacatccacgtgatgacctacgacctgcacggcagctgggagggctacaccggcgagaacagccccctgtacaagtaccccaccgacaccggcagcaacgcctacctgaacgtggactacgtgatgaactactggaaggacaacggcgcccccgccgagaagctgatcgtgggcttccccacctacggccacaacttcatcctgagcaaccccagcaacaccggcatcggcgcccccaccagcggcgccggccccgccggcccctacgccaaggagagcggcatctgggcctactacgagatctgcaccttcctgaagaacggcgccacccagggctgggacgccccccaggaggtgccctacgcctaccagggcaacgtgtgggtgggctacgacaacatcaagagcttcgacatcaaggcccagtggctgaagcacaacaagttcggcggcgccatggtgtgggccatcgacctggacgacttcaccggcaccttctgcaaccagggcaagttccccctgatcagcaccctgaagaaggccctgggcctgcagagcgccagctgcaccgcccccgcccagcccatcgagcccatcaccgccgcccccagcggcagcggcaacggcagcggcagcagcagcagcggcggcagcagcggcggcagcggcttctgcgccgtgagagccaacggcctgtaccccgtggccaacaacagaaacgccttctggcactgcgtgaacggcgtgacctaccagcagaactgccaggccggcctggtgttcgacaccagctgcgactgctgcaactgggcctag

SEQ ID NO: 76531 - DNA, 1431 bp, Artificial Sequence; identical to SEQ ID NO: 76529
  Description of Artificial Sequence: Synthetic coding sequence

SEQ ID NO: 76532 - DNA, 1263 bp, Artificial Sequence
  Description of Artificial Sequence: Synthetic coding sequence
gagaccagcagcagcgtgcacgagcaggtggccgacagcggcgcccaggccgtggccttccagagcggcggcgagagcagcatcgtgtggaacagccagctgaagaccctgctggccatcggcggctggaacttcggcaccgcccccttcaccgccatggtgagcacccccgagaacagacagaccttcatcaccagcgtgatcaagttcctgagacagtacgagttcgacggcctggacttcgactgggagtaccccggcagcagaggcagccccccccaggacaagcacctgttcaccgtgctggtgcaggagatgagagaggccttcgagcaggaggccaagcagatcaacaagcccagactgatggtgaccgccgccgtggccgccggcatcagcaacatccagagcggctacgagatcccccagctgagccagtacctggactacatccacgtgatgacctacgacctgcacggcagctgggagggctacaccggcgagaacagccccctgtacaagtaccccaccgacaccggcagcaacgcctacctgaacgtggactacgtgatgaactactggaaggacaacggcgcccccgccgagaagctgatcgtgggcttccccacctacggccacaacttcatcctgagcaaccccagcaacaccggcatcggcgcccccaccagcggcgccggccccgccggcccctacgccaaggagagcggcatctgggcctactacgagatctgcaccttcctgaagaacggcgccacccagggctgggacgccccccaggaggtgccctacgcctaccagggcaacgtgtgggtgggctacgacaacatcaagagcttcgacatcaaggcccagtggctgaagcacaacaagttcggcggcgccatggtgtgggccatcgacctggacgacttcaccggcaccttctgcaaccagggcaagttccccctgatcagcaccctgaagaaggccctgggcctgcagagcgccagctgcaccgcccccgcccagcccatcgagcccatcaccgccgcccccagcggcagcggcaacggcagcggcagcagcagcagcggcggcagcagcggcggcagcggcttctgcgccgtgagagccaacggcctgtaccccgtggccaacaacagaaacgccttctggcactgcgtgaacggcgtgacctaccagcagaactgccaggccggcctggtgttcgacaccagctgcgactgctgcaactgggcctag

SEQ ID NO: 76533 - DNA, 1107 bp, Artificial Sequence
  Description of Artificial Sequence: Synthetic coding sequence
atggtgagcacccccgagaacagacagaccttcatcaccagcgtgatcaagttcctgagacagtacgagttcgacggcctggacttcgactgggagtaccccggcagcagaggcagccccccccaggacaagcacctgttcaccgtgctggtgcaggagatgagagaggccttcgagcaggaggccaagcagatcaacaagcccagactgatggtgaccgccgccgtggccgccggcatcagcaacatccagagcggctacgagatcccccagctgagccagtacctggactacatccacgtgatgacctacgacctgcacggcagctgggagggctacaccggcgagaacagccccctgtacaagtaccccaccgacaccggcagcaacgcctacctgaacgtggactacgtgatgaactactggaaggacaacggcgcccccgccgagaagctgatcgtgggcttccccacctacggccacaacttcatcctgagcaaccccagcaacaccggcatcggcgcccccaccagcggcgccggccccgccggcccctacgccaaggagagcggcatctgggcctactacgagatctgcaccttcctgaagaacggcgccacccagggctgggacgccccccaggaggtgccctacgcctaccagggcaacgtgtgggtgggctacgacaacatcaagagcttcgacatcaaggcccagtggctgaagcacaacaagttcggcggcgccatggtgtgggccatcgacctggacgacttcaccggcaccttctgcaaccagggcaagttccccctgatcagcaccctgaagaaggccctgggcctgcagagcgccagctgcaccgcccccgcccagcccatcgagcccatcaccgccgcccccagcggcagcggcaacggcagcggcagcagcagcagcggcggcagcagcggcggcagcggcttctgcgccgtgagagccaacggcctgtaccccgtggccaacaacagaaacgccttctggcactgcgtgaacggcgtgacctaccagcagaactgccaggccggcctggtgttcgacaccagctgcgactgctgcaactgggcctag

SEQ ID NO: 76534 - DNA, 948 bp, Artificial Sequence; identical to SEQ ID NO: 76530
  Description of Artificial Sequence: Synthetic coding sequence

SEQ ID NO: 76535 - DNA, 948 bp, Artificial Sequence; identical to SEQ ID NO: 76530
  Description of Artificial Sequence: Synthetic coding sequence

SEQ ID NO: 76536 - DNA, 864 bp, Artificial Sequence
  Description of Artificial Sequence: Synthetic coding sequence
atgagagaggccttcgagcaggaggccaagcagatcaacaagcccagactgatggtgaccgccgccgtggccgccggcatcagcaacatccagagcggctacgagatcccccagctgagccagtacctggactacatccacgtgatgacctacgacctgcacggcagctgggagggctacaccggcgagaacagccccctgtacaagtaccccaccgacaccggcagcaacgcctacctgaacgtggactacgtgatgaactactggaaggacaacggcgcccccgccgagaagctgatcgtgggcttccccacctacggccacaacttcatcctgagcaaccccagcaacaccggcatcggcgcccccaccagcggcgccggccccgccggcccctacgccaaggagagcggcatctgggcctactacgagatctgcaccttcctgaagaacggcgccacccagggctgggacgccccccaggaggtgccctacgcctaccagggcaacgtgtgggtgggctacgacaacatcaagagcttcgacatcaaggcccagtggctgaagcacaacaagttcggcggcgccatggtgtgggccatcgacctggacgacttcaccggcaccttctgcaaccagggcaagttccccctgatcagcaccctgaagaaggccctgggcctgcagagcgccagctgcaccgcccccgcccagcccatcgagcccatcaccgccgcccccagcggcagcggcaacggcagcggcagcagcagcagcggcggcagcagcggcggcagcggcttctgcgccgtgagagccaacggcctgtaccccgtggccaacaacagaaacgccttctggtag

SEQ ID NO: 76537 - DNA, 1158 bp, Artificial Sequence
  Description of Artificial Sequence: Synthetic coding sequence
atgagcagaccccagctgagaagatggagactggtgagcagcccccccagcggcgtgcccggcctggccctgctggccctgctggccctgctggccctgagactggccgccggcaccgactgcccctgccccgagcccgagctgtgcagacccatcagacaccaccccgacttcgaggtgttcgtgttcgacgtgggccagaagacctggaagagctacgactggagccagatcaccaccgtggccaccttcggcaagtacgacagcgagctgatgtgctacgcccacagcaagggcgccagagtggtgctgaagggcgacgtgagcctgaaggacatcatcgaccccgccttcagagccagctggatcgcccagaagctgaacctggccaagacccagtacatggacggcatcaacatcgacatcgagcaggaggtgaactgcctgagccccgagtacgacgccctgaccgccctggtgaaggagaccaccgacagcttccacagagagatcgagggcagccaggtgaccttcgacgtggcctggagccccaagaacatcgacagaagatgctacaactacaccggcatcgccgacgcctgcgacttcctgttcgtgatgagctacgacgagcagagccagatctggagcgagtgcatcgccgccgccaacgccccctacaaccagaccctgaccggctacaacgactacatcaagatgagcatcaaccccaagaagctggtgatgggcgtgccctggtacggctacgactacacctgcctgaacctgagcgaggaccacgtgtgcaccatcgccaaggtgcccttcagaggcgccccctgcagcgacgccgccggcagacaggtgccctacaagaccatcatgaagcagatcaacagcagcatcagcggcaacctgtgggacaaggaccagagagccccctactacaactacaaggaccccgccggccacttccaccaggtgtggtacgacaacccccagagcatcagcctgaaggccacctacatccagaactacagactgagaggcatcggcatgtggaacgccaactgcctggactacagcggcgacgccgtggccaagcagcagaccgaggagatgtgggaggtgctgaagcccaagctgctgcagagatag

SEQ ID NO: 76538 - DNA, 2967 bp, Artificial Sequence
  Description of Artificial Sequence: Synthetic coding sequence
atggagcagagcagaagccagcagagaggcggcgagcagagctggtggggcagcgacccccagtaccagtacatgcccttcgagcactgcaccagctacggcctgcccagcgagaacggcggcctgcagcacagactgagaaaggacgccggccccagacacaacgtgcaccccacccagatctacggccaccacaaggagcagttcagcgacagagagcaggacatcggcatgcccaagaagaccggcagcagcagcaccgtggacagcaaggacgaggaccactacagcaagtgccaggactgcatccacagactgggccaggtggtgagaagaaagctgggcgaggacggcatcttcctggtgctgctgggcctgctgatggccctggtgagctggagcatggactacgtgagcgccaagagcctgcaggcctacaagtggagctacgcccagatgcagcccagcctgcccctgcagttcctggtgtgggtgaccttccccctggtgctgatcctgttcagcgccctgttctgccacctgatcagcccccaggccgtgggcagcggcatccccgagatgaagaccatcctgagaggcgtggtgctgaaggagtacctgaccatgaaggccttcgtggccaaggtggtggccctgaccgccggcctgggcagcggcatccccgtgggcaaggagggccccttcgtgcacatcgccagcatctgcgccgccgtgctgagcaagttcatgagcgtgttctgcggcgtgtacgagcagccctactactacagcgacatcctgaccgtgggctgcgccgtgggcgtgggctgctgcttcggcacccccctgggcggcgtgctgttcagcatcgaggtgaccagcacctacttcgccgtgagaaactactggagaggcttcttcgccgccaccttcagcgccttcgtgttcagagtgctggccgtgtggaacaaggacgccgtgaccatcaccgccctgttcagaaccaacttcagaatggacttccccttcgacctgaaggagctgcccgccttcgccgccatcggcatctgctgcggcctgctgggcgccgtgttcgtgtacctgcacagacaggtgatgctgggcgtgagaaagcacaaggccctgagccagttcctggccaagcacagactgctgtaccccggcatcgtgaccttcgtgatcgccagcttcaccttcccccccggcatgggccagttcatggccggcgagctgatgcccagagaggccatcagcaccctgttcgacaacaacacctgggtgaagcacgccggcgaccccgagagcctgggccagagcgccgtgtggatccaccccagagtgaacgtggtgatcatcatcttcctgttcttcgtgatgaagttctggatgagcatcgtggccaccaccatgcccatcccctgcggcggcttcatgcccgtgttcgtgctgggcgccgccttcggcagactggtgggcgagatcatggccatgctgttccccgacggcatcctgttcgacgacatcatctacaagatcctgcccggcggctacgccgtgatcggcgccgccgccctgaccggcgccgtgagccacaccgtgagcaccgccgtgatctgcttcgagctgaccggccagatcgcccacatcctgcccatgatggtggccgtgatcctggccaacatggtggcccagagcctgcagcccagcctgtacgacagcatcatccaggtgaagaagctgccctacctgcccgacctgggctggaaccagctgagcaagtacaccatcttcgtggaggacatcatggtgagagacgtgaagttcgtgagcgccagctacacctacggcgagctgagaaccctgctgcagaccaccaccgtgaagaccctgcccctggtggacagcaaggacagcatgatcctgctgggcagcgtggagagaagcgagctgcaggccctgctgcagagacacctgtgccccgagagaagactgagagccgcccaggagatggccagaaagctgagcgagctgccctacgacggcaaggccagactggccggcgagggcctgcccggcgccccccccggcagacccgagagcttcgccttcgtggacgaggacgaggacgaggacctgagcggcaagagcgagctgccccccagcctggccctgcaccccagcaccaccgcccccctgagccccgaggagcccaacggccccctgcccggccacaagcagcagcccgaggcccccgagcccgccggccagagacccagcatcttccagagcctgctgcactgcctgctgggcagagccagacccaccaagaagaagaccacccaggacagcaccgacctggtggacaacatgagccccgaggagatcgaggcctgggagcaggagcagctgagccagcccgtgtgcttcgacagctgctgcatcgaccagagccccttccagctggtggagcagaccaccctgcacaagacccacaccctgttcagcctgctgggcctgcacctggcctacgtgaccagcatgggcaagctgagaggcgtgctggccctggaggagctgcagaaggccatcgagggccacaccaagagcggcgtgcagctgagaccccccctggccagcttcagaaacaccaccagcaccagaaagagcaccggcgccccccccagcagcgccgagaactggaacctgcccgaggacagacccggcgccaccggcaccggcgacgtgatcgccgccagccccgagacccccgtgcccagccccagccccgagccccccctgagcctggcccccggcaaggtggagggcgagctggaggagctggagctggtggagagccccggcctggaggaggagctggccgacatcctgcagggccccagcctgagaagcaccgacgaggaggacgaggacgagctgatcctgtag

SEQ ID NO: 76539 - DNA, 2697 bp, Artificial Sequence
  Description of Artificial Sequence: Synthetic coding sequence
atggccgccgccgccgccgaggagggcatggagcccagagccctgcagtacgagcagaccctgatgtacggcagatacacccaggacctgggcgccttcgccaaggaggaggccgccagaatcagactgggcggccccgagccctggaagggcccccccagcagcagagccgcccccgagctgctggagtacggcagaagcagatgcgccagatgcagagtgtgcagcgtgagatgccacaagttcctggtgagcagagtgggcgaggactggatcttcctggtgctgctgggcctgctgatggccctggtgagctgggtgatggactacgccatcgccgcctgcctgcaggcccagcagtggatgagcagaggcctgaacaccagcatcctgctgcagtacctggcctgggtgacctaccccgtggtgctgatcaccttcagcgccggcttcacccagatcctggccccccaggccgtgggcagcggcatccccgagatgaagaccatcctgagaggcgtggtgctgaaggagtacctgaccctgaagaccttcatcgccaaggtgatcggcctgacctgcgccctgggcagcggcatgcccctgggcaaggagggccccttcgtgcacatcgccagcatgtgcgccgccctgctgagcaagttcctgagcctgttcggcggcatctacgagaacgagagcagaaacaccgagatgctggccgccgcctgcgccgtgggcgtgggctgctgcttcgccgcccccatcggcggcgtgctgttcagcatcgaggtgaccagcaccttcttcgccgtgagaaactactggagaggcttcttcgccgccaccttcagcgccttcatcttcagagtgctggccgtgtggaacagagacgaggagaccatcaccgccctgttcaagaccagattcagactggacttccccttcgacctgcaggagctgcccgccttcgccgtgatcggcatcgccagcggcttcggcggcgccctgttcgtgtacctgaacagaaagatcgtgcaggtgatgagaaagcagaagaccatcaacagattcctgatgagaaagagactgctgttccccgccctggtgaccctgctgatcagcaccctgaccttcccccccggcttcggccagttcatggccggccagctgagccagaaggagaccctggtgaccctgttcgacaacagaacctgggtgagacagggcctggtggaggagctggagccccccagcaccagccaggcctggaacccccccagagccaacgtgttcctgaccctggtgatcttcatcctgatgaagttctggatgagcgccctggccaccaccatccccgtgccctgcggcgccttcatgcccgtgttcgtgatcggcgccgccttcggcagactggtgggcgagagcatggccgcctggttccccgacggcatccacaccgacagcagcacctacagaatcgtgcccggcggctacgccgtggtgggcgccgccgccctggccggcgccgtgacccacaccgtgagcaccgccgtgatcgtgttcgagctgaccggccagatcgcccacatcctgcccgtgatgatcgccgtgatcctggccaacgccgtggcccagagcctgcagcccagcctgtacgacagcatcatcagaatcaagaagctgccctacctgcccgagctgggctggggcagacaccagcagtacagagtgagagtggaggacatcatggtgagagacgtgccccacgtggccctgagctgcaccttcagagacctgagactggccctgcacagaaccaagggcagaatgctggccctggtggagagccccgagagcatgatcctgctgggcagcatcgagagaagccaggtggtggccctgctgggcgcccagctgagccccgccagaagaagacagcacatgcaggagagaagagccacccagaccagccccctgagcgaccaggagggcccccccacccccgaggccagcgtgtgcttccaggtgaacaccgaggacagcgccttccccgccgccagaggcgagacccacaagcccctgaagcccgccctgaagagaggccccagcgtgaccagaaacctgggcgagagccccaccggcagcgccgagagcgccggcatcgccctgagaagcctgttctgcggcagccccccccccgaggccgccagcgagaagctggagagctgcgagaagagaaagctgaagagagtgagaatcagcctggccagcgacgccgacctggagggcgagatgagccccgaggagatcctggagtgggaggagcagcagctggacgagcccgtgaacttcagcgactgcaagatcgaccccgcccccttccagctggtggagagaaccagcctgcacaagacccacaccatcttcagcctgctgggcgtggaccacgcctacgtgaccagcatcggcagactgatcggcatcgtgaccctgaaggagctgagaaaggccatcgagggcagcgtgaccgcccagggcgtgaaggtgagaccccccctggccagcttcagagacagcgccaccagcagcagcgacaccgagaccaccgaggtgcacgccctgtggggcccccacagcagacacggcctgcccagagagggcagccccagcgacagcgacgacaagtgccagtag

SEQ ID NO: 76540 - DNA, 381 bp, Artificial Sequence
  Description of Artificial Sequence: Synthetic coding sequence
atgagaaagagactgctgttccccgccctggtgaccctgctgatcagcaccctgaccttcccccccggcttcggccagttcatggccggccagctgagccagaaggagaccctggtgaccctgttcgacaacagaacctgggtgagacagggcctggtggaggagctggagccccccagcaccagccaggcctggaacccccccagagccaacgtgttcctgaccctggtgatcttcatcctgatgaagcacctgggcgtgtggtgggtgaaggcctggctgcccggcagccagatggagttcatcagaaccgccgcccccaccggcctgtgcctgggcgccaccctgtggagcggccagctgagatggcaggagagatag

SEQ ID NO: 76541 - DNA, 2601 bp, Artificial Sequence
  Description of Artificial Sequence: Synthetic coding sequence
atggagagcgagcagctgttccacagaggctactacagaaacagctacaacagcatcaccagcgccagcagcgacgaggagctgctggacggcgccggcgtgatcatggacttccagaccagcgaggacgacaacctgctggacggcgacaccgccgtgggcacccactacaccatgaccaacggcggcagcatcaacagcagcacccacctgctggacctgctggacgagcccatccccggcgtgggcacctacgacgacttccacaccatcgactgggtgagagagaagtgcaaggacagagagagacacagaagaatcaacagcaagaagaaggagagcgcctgggagatgaccaagagcctgtacgacgcctggagcggctggctggtggtgaccctgaccggcctggccagcggcgccctggccggcctgatcgacatcgccgccgactggatgaccgacctgaaggagggcatctgcctgagcgccctgtggtacaaccacgagcagtgctgctggggcagcaacgagaccaccttcgaggagagagacaagtgcccccagtggaagacctgggccgagctgatcatcggccaggccgagggccccggcagctacatcatgaactacatcatgtacatcttctgggccctgagcttcgccttcctggccgtgagcctggtgaaggtgttcgccccctacgcctgcggcagcggcatccccgagatcaagaccatcctgagcggcttcatcatcagaggctacctgggcaagtggaccctgatgatcaagaccatcaccctggtgctggccgtggccagcggcctgagcctgggcaaggagggccccctggtgcacgtggcctgctgctgcggcaacatcttcagctacctgttccccaagtacagcaccaacgaggccaagaagagagaggtgctgagcgccgccagcgccgccggcgtgagcgtggccttcggcgcccccatcggcggcgtgctgttcagcctggaggaggtgagctactacttccccctgaagaccctgtggagaagcttcttcgccgccctggtggccgccttcgtgctgagaagcatcaaccccttcggcaacagcagactggtgctgttctacgtggagtaccacaccccctggtacctgttcgagctgttccccttcatcctgctgggcgtgttcggcggcctgtggggcgccttcttcatcagagccaacatcgcctggtgcagaagaagaaagagcaccaagttcggcaagtaccccgtgctggaggtgatcatcgtggccgccatcaccgccgtgatcgccttccccaacccctacaccagactgaacaccagcgagctgatcaaggagctgttcaccgactgcggccccctggagagcagcagcctgtgcgactacagaaacgacatgaacgccagcaagatcgtggacgacatccccgacagacccgccggcatcggcgtgtacagcgccatctggcagctgtgcctggccctgatcttcaagatcatcatgaccgtgttcaccttcggcatcaaggtgcccagcggcctgttcatccccagcatggccatcggcgccatcgccggcagaatcgtgggcatcgccgtggagcagctggcctactaccaccacgactggttcatcttcaaggagtggtgcgaggtgggcgccgactgcatcacccccggcctgtacgccatggtgggcgccgccgcctgcctgggcggcgtgaccagaatgaccgtgagcctggtggtgatcgtgttcgagctgaccggcggcctggagtacatcgtgcccctgatggccgccgtgatgaccagcaagtgggtgggcgacgccttcggcagagagggcatctacgaggcccacatcagactgaacggctaccccttcctggacgccaaggaggagttcacccacaccaccctggccgccgacgtgatgagacccagaagaaacgacccccccctggccgtgctgacccaggacaacatgaccgtggacgacatcgagaacatgatcaacgagaccagctacaacggcttccccgtgatcatgagcaaggagagccagagactggtgggcttcgccctgagaagagacctgaccatcgccatcgagagcgccagaaagaagcaggagggcatcgtgggcagcagcagagtgtgcttcgcccagcacacccccagcctgcccgccgagagccccagacccctgaagctgagaagcatcctggacatgagccccttcaccgtgaccgaccacacccccatggagatcgtggtggacatcttcagaaagctgggcctgagacagtgcctggtgacccacaacggcatcgtgctgggcatcatcaccaagaagaacatcctggagcacctggagcagctgaagcagcacgtggagcccctggcccccccctggcactacaacaagaagagatacccccccgcctacggccccgacggcaagcccagacccagattcaacaacgtgcagctgaacctgaccgacgaggagagagaggagaccgaggaggaggtgtacctgctgaacagcaccaccctgtag

SEQ ID NO: 76542 - DNA, 2376 bp, Artificial Sequence
  Description of Artificial Sequence: Synthetic coding sequence
atggagagcgagcagctgttccacagaggctactacagaaacagctacaacagcatcaccagcgccagcagcgacgaggagctgctggacggcgccggcgtgatcatggacttccagaccagcgaggacgacaacctgctggacggcgacaccgccgtgggcacccactacaccatgaccaacggcggcagcatcaacagcagcacccacctgctggacctgctggacgagcccatccccggcgtgggcacctacgacgacttccacaccatcgactgggtgagagagaagtgcaaggacagagagagacacagaagaatcaacagcaagaagaaggagagcgcctgggagatgaccaagagcctgtacgacgcctggagcggctggctggtggtgaccctgaccggcctggccagcggcgccctggccggcctgatcgacatcgccgccgactggatgaccgacctgaaggagggcatctgcctgagcgccctgtggtacaaccacgagcagtgctgctggggcagcaacgagaccaccttcgaggagagagacaagtgcccccagtggaagacctgggccgagctgatcatcggccaggccgagggccccggcagctacatcatgaactacatcatgtacatcttctgggccctgagcttcgccttcctggccgtgagcctggtgaaggtgttcgccccctacgcctgcggcagcggcatccccgagatcaagaccatcctgagcggcttcatcatcagaggctacctgggcaagtggaccctgatgatcaagaccatcaccctggtgctggccgtggccagcggcctgagcctgggcaaggagggccccctggtgcacgtggcctgctgctgcggcaacatcttcagctacctgttccccaagtacagcaccaacgaggccaagaagagagaggtgagctactacttccccctgaagaccctgtggagaagcttcttcgccgccctggtggccgccttcgtgctgagaagcatcaaccccttcggcaacagcagactggtgctgttctacgtggagtaccacaccccctggtacctgttcgagctgttccccttcatcctgctgggcgtgttcggcggcctgtggggcgccttcttcatcagagccaacatcgcctggtgcagaagaagaaagagcaccaagttcggcaagtaccccgtgctggaggtgatcatcgtggccgccatcaccgccgtgatcgccttccccaacccctacaccagactgaacaccagcgagctgatcaaggagctgttcaccgactgcggccccctggagagcagcagcctgtgcgactacagaaacgacatgaacgccagcaagatcgtggacgacatccccgacagacccgccggcatcggcgtgtacagcgccatctggcagctgtgcctggccctgatcttcaagatcatcatgaccgtgttcaccttcggcatcaaggtgcccagcggcctgttcatccccagcatggccatcggcgccatcgccggcagaatcgtgggcatcgccgtggagcagctggcctactaccaccacgactggttcatcttcaaggagtggtgcgaggtgggcgccgactgcatcacccccggcctgtacgccatggtgggcgccgccgcctgcctgggcggcgtgaccagaatgaccgtgagcctggtggtgatcgtgttcgagctgaccggcggcctggagtacatcgtgcccctgatggccgccgtgatgaccagcaagtgggtgggcgacgccttcggcagagagggcatctacgaggcccacatcagactgaacggctaccccttcctggacgccaaggaggagttcacccacaccaccctggccgccgacgtgatgagacccagaagaaacgacccccccctggccgtgctgacccaggacaacatgaccgtggacgacatcgagaacatgatcaacgagaccagctacaacggcttccccgtgatcatgagcaaggagagccagagactggtgggcttcgccctgagaagagacctgaccatcgccatcgagagcgccagaaagaagcaggagggcatcgtgggcagcagcagagtgtgcttcgcccagcacacccccagcctgcccgccgagagccccagacccctgaagctgagaagcatcctggacatgagccccttcaccgtgaccgaccacacccccatggagatcgtggtggacatcttcagaaagctgggcctgagacagtgcctggtgacccacaacggcagactgctgggcatcatcaccaagaaggacatcctgagacacatggcccagaccgccaaccaggaccccgccagcatcatgttcaactag

SEQ ID NO: 76543 - DNA, 2406 bp, Artificial Sequence
  Description of Artificial Sequence: Synthetic coding sequence
atggtgaccctgcagctgggcgagagccactacgtggtgcaggccggcctgcagctgctgggcagcagcaacccccccgccctggccagccaggtggccgagatcaccggcacccactacaccatgaccaacggcggcagcatcaacagcagcacccacctgctggacctgctggacgagcccatccccggcgtgggcacctacgacgacttccacaccatcgactgggtgagagagaagtgcaaggacagagagagacacagaagaatcaacagcaagaagaaggagagcgcctgggagatgaccaagagcctgtacgacgcctggagcggctggctggtggtgaccctgaccggcctggccagcggcgccctggccggcctgatcgacatcgccgccgactggatgaccgacctgaaggagggcatctgcctgagcgccctgtggtacaaccacgagcagtgctgctggggcagcaacgagaccaccttcgaggagagagacaagtgcccccagtggaagacctgggccgagctgatcatcggccaggccgagggccccggcagctacatcatgaactacatcatgtacatcttctgggccctgagcttcgccttcctggccgtgagcctggtgaaggtgttcgccccctacgcctgcggcagcggcatccccgagatcaagaccatcctgagcggcttcatcatcagaggctacctgggcaagtggaccctgatgatcaagaccatcaccctggtgctggccgtggccagcggcctgagcctgggcaaggagggccccctggtgcacgtggcctgctgctgcggcaacatcttcagctacctgttccccaagtacagcaccaacgaggccaagaagagagaggtgctgagcgccgccagcgccgccggcgtgagcgtggccttcggcgcccccatcggcggcgtgctgttcagcctggaggaggtgagctactacttccccctgaagaccctgtggagaagcttcttcgccgccctggtggccgccttcgtgctgagaagcatcaaccccttcggcaacagcagactggtgctgttctacgtggagtaccacaccccctggtacctgttcgagctgttccccttcatcctgctgggcgtgttcggcggcctgtggggcgccttcttcatcagagccaacatcgcctggtgcagaagaagaaagagcaccaagttcggcaagtaccccgtgctggaggtgatcatcgtggccgccatcaccgccgtgatcgccttccccaacccctacaccagactgaacaccagcgagctgatcaaggagctgttcaccgactgcggccccctggagagcagcagcctgtgcgactacagaaacgacatgaacgccagcaagatcgtggacgacatccccgacagacccgccggcatcggcgtgtacagcgccatctggcagctgtgcctggccctgatcttcaagatcatcatgaccgtgttcaccttcggcatcaaggtgcccagcggcctgttcatccccagcatggccatcggcgccatcgccggcagaatcgtgggcatcgccgtggagcagctggcctactaccaccacgactggttcatcttcaaggagtggtgcgaggtgggcgccgactgcatcacccccggcctgtacgccatggtgggcgccgccgcctgcctgggcggcgtgaccagaatgaccgtgagcctggtggtgatcgtgttcgagctgaccggcggcctggagtacatcgtgcccctgatggccgccgtgatgaccagcaagtgggtgggcgacgccttcggcagagagggcatctacgaggcccacatcagactgaacggctaccccttcctggacgccaaggaggagttcacccacaccaccctggccgccgacgtgatgagacccagaagaaacgacccccccctggccgtgctgacccaggacaacatgaccgtggacgacatcgagaacatgatcaacgagaccagctacaacggcttccccgtgatcatgagcaaggagagccagagactggtgggcttcgccctgagaagagacctgaccatcgccatcgagagcgccagaaagaagcaggagggcatcgtgggcagcagcagagtgtgcttcgcccagcacacccccagcctgcccgccgagagccccagacccctgaagctgagaagcatcctggacatgagccccttcaccgtgaccgaccacacccccatggagatcgtggtggacatcttcagaaagctgggcctgagacagtgcctggtgacccacaacggcagactgctgggcatcatcaccaagaaggacatcctgagacacatggcccagaccgccaaccaggaccccgccagcatcatgttcaactag

SEQ ID NO: 76544 - DNA, 522 bp, Artificial Sequence
  Description of Artificial Sequence: Synthetic coding sequence
atggagagcgagcagctgttccacagaggctactacagaaacagctacaacagcatcaccagcgccagcagcgacgaggagctgctggacggcgccggcgtgatcatggacttccagaccagcgaggacgacaacctgctggacggcgacaccgccgtgggcacccactacaccatgaccaacggcggcagcatcaacagcagcacccacctgctggacctgctggacgagcccatccccggcgtgggcacctacgacgacttccacaccatcgactgggtgagagagaagtgcaaggacagagagagacacagaagaatcaacagcaagaagaaggagagcgcctgggagatgaccaagagcctgtacgacgcctggagcggctggctggtggtgaccctgaccggcctggccagcggcgccctggccggcctgatcgacatcgccgccgactggatgaccgacctgaaggagggcatctgcctgagcgccctgtggtacaaccacgagcagtgctgctag

SEQ ID NO: 76545 - DNA, 420 bp, Artificial Sequence
  Description of Artificial Sequence: Synthetic coding sequence
atggagagcgagcagctgttccacagaggctactacagaaacagctacaacagcatcaccagcgccagcagcgacgaggagctgctggacggcgccggcgtgatcatggacttccagaccagcgaggacgacaacctgctggacggcgacaccgccgtgggcacccactacaccatgaccaacggcggcagcatcaacagcagcacccacctgctggacctgctggacgagcccatccccggcgtgggcacctacgacgacttccacaccatcgactgggtgagagagaagtgcaaggacagagagagacacagaagaatcaacagcaagaagaaggagagcgcctgggagatgaccaagagcctgtacgacgcctggagcggctggctggtggtgaccctgaccggcctggccagctag

SEQ ID NO: 76546 - DNA, 2457 bp, Artificial Sequence
  Description of Artificial Sequence: Synthetic coding sequence
atggagagcgagcagctgttccacagaggctactacagaaacagctacaacagcatcaccagcgccagcagcgacgaggagctgctggacggcgccggcgtgatcatggacttccagaccagcgaggacgacaacctgctggacggcgacaccgccgtgggcacccactacaccatgaccaacggcggcagcatcaacagcagcacccacctgctggacctgctggacgagcccatccccggcgtgggcacctacgacgacttccacaccatcgactgggtgagagagaagtgcaaggacagagagagacacagaagaatcaacagcaagaagaaggagagcgcctgggagatgaccaagagcctgtacgacgcctggagcggctggctggtggtgaccctgaccggcctggccagcggcgccctggccggcctgatcgacatcgccgccgactggatgaccgacctgaaggagggcatctgcctgagcgccctgtggtacaaccacgagcagtgctgctggggcagcaacgagaccaccttcgaggagagagacaagtgcccccagtggaagacctgggccgagctgatcatcggccaggccgagggccccggcagctacatcatgaactacatcatgtacatcttctgggccctgagcttcgccttcctggccgtgagcctggtgaaggtgttcgccccctacgcctgcggcagcggcatccccgagatcaagaccatcctgagcggcttcatcatcagaggctacctgggcaagtggaccctgatgatcaagaccatcaccctggtgctggccgtggccagcggcctgagcctgggcaaggagggccccctggtgcacgtggcctgctgctgcggcaacatcttcagctacctgttccccaagtacagcaccaacgaggccaagaagagagaggtgctgagcgccgccagcgccgccggcgtgagcgtggccttcggcgcccccatcggcggcgtgctgttcagcctggaggaggtgagctactacttccccctgaagaccctgtggagaagcttcttcgccgccctggtggccgccttcgtgctgagaagcatcaaccccttcggcaacagcagactggtgctgttctacgtggagtaccacaccccctggtacctgttcgagctgttccccttcatcctgctgggcgtgttcggcggcctgtggggcgccttcttcatcagagccaacatcgcctggtgcagaagaagaaagagcaccaagttcggcaagtaccccgtgctggaggtgatcatcgtggccgccatcaccgccgtgatcgccttccccaacccctacaccagactgaacaccagcgagctgatcaaggagctgttcaccgactgcggccccctggagagcagcagcctgtgcgactacagaaacgacatgaacgccagcaagatcgtggacgacatccccgacagacccgccggcatcggcgtgtacagcgccatctggcagctgtgcctggccctgatcttcaagatcatcatgaccgtgttcaccttcggcatcaaggtgcccagcggcctgttcatccccagcatggccatcggcgccatcgccggcagaatcgtgggcatcgccgtggagcagctggcctactaccaccacgactggttcatcttcaaggagtggtgcgaggtgggcgccgactgcatcacccccggcctgtacgccatggtgggcgccgccgcctgcctgggcggcgtgaccagaatgaccgtgagcctggtggtgatcgtgttcgagctgaccggcggcctggagtacatcgtgcccctgatggccgccgtgatgaccagcaagtgggtgggcgacgccttcggcagagagggcatctacgaggcccacatcagactgaacggctaccccttcctggacgccaaggaggagttcacccacaccaccctggccgccgacgtgatgagacccagaagaaacgacccccccctggccgtgctgacccaggacaacatgaccgtggacgacatcgagaacatgatcaacgagaccagctacaacggcttccccgtgatcatgagcaaggagagccagagactggtgggcttcgccctgagaagagacctgaccatcgccatcgagagcgccagaaagaagcaggagggcatcgtgggcagcagcagagtgtgcttcgcccagcacacccccagcctgcccgccgagagccccagacccctgaagctgagaagcatcctggacatgagccccttcaccgtgaccgaccacacccccatggagatcgtggtggacatcttcagaaagctgggcctgagacagtgcctggtgacccacaacggcagactgctgggcatcatcaccaagaaggacatcctgagacacatggcccagaccgccaaccaggaccccgccagcatcatgttcaactag

SEQ ID NO: 76547 - DNA, 576 bp, Artificial Sequence
  Description of Artificial Sequence: Synthetic coding sequence
atggagagcgagcagctgttccacagaggctactacagaaacagctacaacagcatcaccagcgccagcagcgacgaggagctgctggacggcgccggcgtgatcatggacttccagaccagcgaggacgacaacctgctggacggcgacaccgccgtgggcacccactacaccatgaccaacggcggcagcatcaacagcagcacccacctgctggacctgctggacgagcccatccccggcgtgggcacctacgacgacttccacaccatcgactgggtgagagagaagtgcaaggacagagagagacacagaagaatcaacagcaagaagaaggagagcgcctgggagatgaccaagagcctgtacgacgcctggagcggctggctggtggtgaccctgaccggcctggccagcggcgccctggccggcctgatcgacatcgccgccgactggatgaccgacctgaaggagggcatctgcctgagcgccctgtggtacaaccacgagcagtgctgctggggcagcaacgagaccaccttcgagaagaagaagaagaagaagaagaaggcctag

SEQ ID NO: 76548 - DNA, 2190 bp, Artificial Sequence
  Description of Artificial Sequence: Synthetic coding sequence
atggtgaacgccggcgccatgagcggcagcggcaacctgatggacttcctggacgagcccttccccgacgtgggcacctacgaggacttccacaccatcgactggctgagagagaagagcagagacaccgacagacacagaaagatcaccagcaagagcaaggagagcatctgggagttcatcaagagcctgctggacgcctggagcggctgggtggtgatgctgctgatcggcctgctggccggcaccctggccggcgtgatcgacctggccgtggactggatgaccgacctgaaggagggcgtgtgcctgagcgccttctggtacagccacgagcagtgctgctggaccagcaacgagaccaccttcgaggacagagacaagtgccccctgtggcagaagtggagcgagctgctggtgaaccagagcgagggcgccagcgcctacatcctgaactacctgatgtacatcctgtgggccctgctgttcgccttcctggccgtgagcctggtgagagtgttcgccccctacgcctgcggcagcggcatccccgagatcaagaccatcctgagcggcttcatcatcagaggctacctgggcaagtggaccctgctgatcaagaccgtgaccctggtgctggtggtgagcagcggcctgagcctgggcaaggagggccccctggtgcacgtggcctgctgctgcggcaacttcttcagcagcctgttcagcaagtacagcaagaacgagggcaagagaagagaggtgctgagcgccgccgccgccgccggcgtgagcgtggccttcggcgcccccatcggcggcgtgctgttcagcctggaggaggtgagctactacttccccctgaagaccctgtggagaagcttcttcgccgccctggtggccgccttcaccctgagaagcatcaaccccttcggcaacagcagactggtgctgttctacgtggagtaccacaccccctggagaagaaagaccaccagactgggcaagtaccccgtgctggaggtgatcgtggtgaccgccatcaccgccatcatcgcctaccccaacccctacaccagacagagcaccagcgagctgatcagcgagctgttcaacgactgcggcgccctggagagcagccagctgtgcgactacatcaacgaccccaacatgaccagacccgtggacgacatccccgacagacccgccggcgtgggcgtgtacaccgccatgtggcagctggccctggccctgatcttcaagatcgtggtgaccatcttcaccttcggcatgaagatccccagcggcctgttcatccccagcatggccgtgggcgccatcgccggcagaatggtgggcatcggcgtggagcagctggcctaccaccaccacgactggatcatcttcagaaactggtgcagacccggcgccgactgcgtgacccccggcctgtacgccatggtgggcgccgccgcctgcctgggcggcgtgaccagaatgaccgtgagcctggtggtgatcatgttcgagctgaccggcggcctggagtacatcgtgcccctgatggccgccgccgtgaccagcaagtgggtggccgacgccttcggcaaggagggcatctacgaggcccacatccacctgaacggctaccccttcctggacgtgaaggacgagttcacccacagaaccctggccaccgacgtgatgagacccagaagaggcgagccccccctgagcgtgctgacccaggacagcatgaccgtggaggacgtggagaccctgatcaaggagaccgactacaacggcttccccgtggtggtgagcagagacagcgagagactgatcggcttcgcccagagaagagagctgatcctggccatcaagaacgccagacagagacaggagggcatcgtgagcaacagcatcatgtacttcaccgaggagccccccgagctgcccgccaacagcccccaccccctgaagctgagaagaatcctgaacctgagccccttcaccgtgaccgaccacacccccatggagaccgtggtggacatcttcagaaagctgggcctgagacagtgcctggtgaccagaagcggcagactgctgggcatcatcaccaagaaggacgtgctgagacacatggcccagatggccaaccaggaccccgagagcatcatgttcaactag

SEQ ID NO: 76549 - DNA, 2283 bp, Artificial Sequence
  Description of Artificial Sequence: Synthetic coding sequence
atggtgaacgccggcgccatgagcggcagcggcaacctgatggacttcctggacgagcccttccccgacgtgggcacctacgaggacttccacaccatcgactggctgagagagaagagcagagacaccgacagacacagaaagatcaccagcaagagcaaggagagcatctgggagttcatcaagagcctgctggacgcctggagcggctgggtggtgatgctgctgatcggcctgctggccggcaccctggccggcgtgatcgacctggccgtggactggatgaccgacctgaaggagggcgtgtgcctgagcgccttctggtacagccacgagcagtgctgctggaccagcaacgagaccaccttcgaggacagagacaagtgccccctgtggcagaagtggagcgagctgctggtgaaccagagcgagggcgccagcgcctacatcctgaactacctgatgtacatcctgtgggccctgctgttcgccttcctggccgtgagcctggtgagagtgttcgccccctacgcctgcggcagcggcatccccgagatcaagaccatcctgagcggcttcatcatcagaggctacctgggcaagtggaccctgctgatcaagaccgtgaccctggtgctggtggtgagcagcggcctgagcctgggcaaggagggccccctggtgcacgtggcctgctgctgcggcaacttcttcagcagcctgttcagcaagtacagcaagaacgagggcaagagaagagaggtgctgagcgccgccgccgccgccggcgtgagcgtggccttcggcgcccccatcggcggcgtgctgttcagcctggaggaggtgagctactacttccccctgaagaccctgtggagaagcttcttcgccgccctggtggccgccttcaccctgagaagcatcaaccccttcggcaacagcagactggtgctgttctacgtggagtaccacaccccctggtacatggccgagctgttccccttcatcctgctgggcgtgttcggcggcctgtggggcaccctgttcatcagatgcaacatcgcctggtgcagaagaagaaagaccaccagactgggcaagtaccccgtgctggaggtgatcgtggtgaccgccatcaccgccatcatcgcctaccccaacccctacaccagacagagcaccagcgagctgatcagcgagctgttcaacgactgcggcgccctggagagcagccagctgtgcgactacatcaacgaccccaacatgaccagacccgtggacgacatccccgacagacccgccggcgtgggcgtgtacaccgccatgtggcagctggccctggccctgatcttcaagatcgtggtgaccatcttcaccttcggcatgaagatccccagcggcctgttcatccccagcatggccgtgggcgccatcgccggcagaatggtgggcatcggcgtggagcagctggcctaccaccaccacgactggatcatcttcagaaactggtgcagacccggcgccgactgcgtgacccccggcctgtacgccatggtgggcgccgccgcctgcctgggcggcgtgaccagaatgaccgtgagcctggtggtgatcatgttcgagctgaccggcggcctggagtacatcgtgcccctgatggccgccgccgtgaccagcaagtgggtggccgacgccttcggcaaggagggcatctacgaggcccacatccacctgaacggctaccccttcctggacgtgaaggacgagttcacccacagaaccctggccaccgacgtgatgagacccagaagaggcgagccccccctgagcgtgctgacccaggacagcatgaccgtggaggacgtggagaccctgatcaaggagaccgactacaacggcttccccgtggtggtgagcagagacagcgagagactgatcggcttcgcccagagaagagagctgatcctggccatcaagaacgccagacagagacaggagggcatcgtgagcaacagcatcatgtacttcaccgaggagccccccgagctgcccgccaacagcccccaccccctgaagctgagaagaatcctgaacctgagccccttcaccgtgaccgaccacacccccatggagaccgtggtggacatcttcagaaagctgggcctgagacagtgcctggtgaccagaagcggcagactgctgggcatcatcaccaagaaggacgtgctgagacacatggcccagatggccaaccaggaccccgagagcatcatgttcaactag

SEQ ID NO: 76550 - DNA, 2001 bp, Artificial Sequence
  Description of Artificial Sequence: Synthetic coding sequence
atgaccgacctgaaggagggcgtgtgcctgagcgccttctggtacagccacgagcagtgctgctggaccagcaacgagaccaccttcgaggacagagacaagtgccccctgtggcagaagtggagcgagctgctggtgaaccagagcgagggcgccagcgcctacatcctgaactacctgatgtacatcctgtgggccctgctgttcgccttcctggccgtgagcctggtgagagtgttcgccccctacgcctgcggcagcggcatccccgagatcaagaccatcctgagcggcttcatcatcagaggctacctgggcaagtggaccctgctgatcaagaccgtgaccctggtgctggtggtgagcagcggcctgagcctgggcaaggagggccccctggtgcacgtggcctgctgctgcggcaacttcttcagcagcctgttcagcaagtacagcaagaacgagggcaagagaagagaggtgctgagcgccgccgccgccgccggcgtgagcgtggccttcggcgcccccatcggcggcgtgctgttcagcctggaggaggtgagctactacttccccctgaagaccctgtggagaagcttcttcgccgccctggtggccgccttcaccctgagaagcatcaaccccttcggcaacagcagactggtgctgttctacgtggagtaccacaccccctggtacatggccgagctgttccccttcatcctgctgggcgtgttcggcggcctgtggggcaccctgttcatcagatgcaacatcgcctggtgcagaagaagaaagaccaccagactgggcaagtaccccgtgctggaggtgatcgtggtgaccgccatcaccgccatcatcgcctaccccaacccctacaccagacagagcaccagcgagctgatcagcgagctgttcaacgactgcggcgccctggagagcagccagctgtgcgactacatcaacgaccccaacatgaccagacccgtggacgacatccccgacagacccgccggcgtgggcgtgtacaccgccatgtggcagctggccctggccctgatcttcaagatcgtggtgaccatcttcaccttcggcatgaagatccccagcggcctgttcatccccagcatggccgtgggcgccatcgccggcagaatggtgggcatcggcgtggagcagctggcctaccaccaccacgactggatcatcttcagaaactggtgcagacccggcgccgactgcgtgacccccggcctgtacgccatggtgggcgccgccgcctgcctgggcggcgtgaccagaatgaccgtgagcctggtggtgatcatgttcgagctgaccggcggcctggagtacatcgtgcccctgatggccgccgccgtgaccagcaagtgggtggccgacgccttcggcaaggagggcatctacgaggcccacatccacctgaacggctaccccttcctggacgtgaaggacgagttcacccacagaaccctggccaccgacgtgatgagacccagaagaggcgagccccccctgagcgtgctgacccaggacagcatgaccgtggaggacgtggagaccctgatcaaggagaccgactacaacggcttccccgtggtggtgagcagagacagcgagagactgatcggcttcgcccagagaagagagctgatcctggccatcaagaacgccagacagagacaggagggcatcgtgagcaacagcatcatgtacttcaccgaggagccccccgagctgcccgccaacagcccccaccccctgaagctgagaagaatcctgaacctgagccccttcaccgtgaccgaccacacccccatggagaccgtggtggacatcttcagaaagctgggcctgagacagtgcctggtgaccagaagcggcagactgctgggcatcatcaccaagaaggacgtgctgagacacatggcccagatggccaaccaggaccccgagagcatcatgttcaactag

SEQ ID NO: 76551 - DNA, 459 bp, Artificial Sequence
  Description of Artificial Sequence: Synthetic coding sequence
atggtgaacgccggcgccatgagcggcagcggcaacctgatggacttcctggacgagcccttccccgacgtgggcacctacgaggacttccacaccatcgactggctgagagagaagagcagagacaccgacagacacagaaagatcaccagcaagagcaaggagagcatctgggagttcatcaagagcctgctggacgcctggagcggctgggtggtgatgctgctgatcggcctgctggccggcaccctggccggcgtgatcgacctggccgtggactggatgaccgacctgaaggagggcgtgtgcctgagcgccttctggtacagccacgagcagtgctgctggaccagcaacgagaccaccttcgaggacagagacaagtgccccctgtggcagaagtggagcgagctgctggtgaaccagagcgaggtgctgagcgccgccgccgccgcctag

SEQ ID NO: 76552 - DNA, 2241 bp, Artificial Sequence
  Description of Artificial Sequence: Synthetic coding sequence
atggacttcctggaggagcccatccccggcgtgggcacctacgacgacttcaacaccatcgactgggtgagagagaagagcagagacagagacagacacagagagatcaccaacaagagcaaggagagcacctgggccctgatccacagcgtgagcgacgccttcagcggctggctgctgatgctgctgatcggcctgctgagcggcagcctggccggcctgatcgacatcagcgcccactggatgaccgacctgaaggagggcatctgcaccggcggcttctggttcaaccacgagcactgctgctggaacagcgagcacgtgaccttcgaggagagagacaagtgccccgagtggaacagctggagccagctgatcatcagcaccgacgagggcgccttcgcctacatcgtgaactacttcatgtacgtgctgtgggccctgctgttcgccttcctggccgtgagcctggtgaaggtgttcgccccctacgcctgcggcagcggcatccccgagatcaagaccatcctgagcggcttcatcatcagaggctacctgggcaagtggaccctggtgatcaagaccatcaccctggtgctggccgtgagcagcggcctgagcctgggcaaggagggccccctggtgcacgtggcctgctgctgcggcaacatcctgtgccactgcttcaacaagtacagaaagaacgaggccaagagaagagaggtgctgagcgccgccgccgccgccggcgtgagcgtggccttcggcgcccccatcggcggcgtgctgttcagcctggaggaggtgagctactacttccccctgaagaccctgtggagaagcttcttcgccgccctggtggccgccttcaccctgagaagcatcaaccccttcggcaacagcagactggtgctgttctacgtggagttccacaccccctggcacctgttcgagctggtgcccttcatcctgctgggcatcttcggcggcctgtggggcgccctgttcatcagaaccaacatcgcctggtgcagaaagagaaagaccacccagctgggcaagtaccccgtgatcgaggtgctggtggtgaccgccatcaccgccatcctggccttccccaacgagtacaccagaatgagcaccagcgagctgatcagcgagctgttcaacgactgcggcctgctggacagcagcaagctgtgcgactacgagaacagattcaacaccagcaagggcggcgagctgcccgacagacccgccggcgtgggcgtgtacagcgccatgtggcagctggccctgaccctgatcctgaagatcgtgatcaccatcttcaccttcggcatgaagatccccagcggcctgttcatccccagcatggccgtgggcgccatcgccggcagactgctgggcgtgggcatggagcagctggcctactaccaccaggagtggaccgtgttcaacagctggtgcagccagggcgccgactgcatcacccccggcctgtacgccatggtgggcgccgccgcctgcctgggcggcgtgaccagaatgaccgtgagcctggtggtgatcatgttcgagctgaccggcggcctggagtacatcgtgcccctgatggccgccgccatgaccagcaagtgggtggccgacgccctgggcagagagggcatctacgacgcccacatcagactgaacggctaccccttcctggaggccaaggaggagttcgcccacaagaccctggccatggacgtgatgaagcccagaagaaacgaccccctgctgaccgtgctgacccaggacagcatgaccgtggaggacgtggagaccatcatcagcgagaccacctacagcggcttccccgtggtggtgagcagagagagccagagactggtgggcttcgtgctgagaagagacctgatcatcagcatcgagaacgccagaaagaagcaggacggcgtggtgagcaccagcatcatctacttcaccgagcacagcccccccctgcccccctacaccccccccaccctgaagctgagaaacatcctggacctgagccccttcaccgtgaccgacctgacccccatggagatcgtggtggacatcttcagaaagctgggcctgagacagtgcctggtgacccacaacggcagactgctgggcatcatcaccaagaaggacgtgctgaagcacatcgcccagatggccaaccaggaccccgacagcatcctgttcaactag

SEQ ID NO: 76553 - DNA, 2451 bp, Artificial Sequence
  Description of Artificial Sequence: Synthetic coding sequence
atggccatgtggcagggcgccatggacaacagaggcttccagcagggcagcttcagcagcttccagaacagcagcagcgacgaggacctgatggacatccccgccaccgccatggacttcagcatgagagacgacgtgccccccctggacagagaggtgggcgaggacaagagctacaacggcggcggcatcggcagcagcaacagaatcatggacttcctggaggagcccatccccggcgtgggcacctacgacgacttcaacaccatcgactgggtgagagagaagagcagagacagagacagacacagagagatcaccaacaagagcaaggagagcacctgggccctgatccacagcgtgagcgacgccttcagcggctggctgctgatgctgctgatcggcctgctgagcggcagcctggccggcctgatcgacatcagcgcccactggatgaccgacctgaaggagggcatctgcaccggcggcttctggttcaaccacgagcactgctgctggaacagcgagcacgtgaccttcgaggagagagacaagtgccccgagtggaacagctggagccagctgatcatcagcaccgacgagggcgccttcgcctacatcgtgaactacttcatgtacgtgctgtgggccctgctgttcgccttcctggccgtgagcctggtgaaggtgttcgccccctacgcctgcggcagcggcatccccgagatcaagaccatcctgagcggcttcatcatcagaggctacctgggcaagtggaccctggtgatcaagaccatcaccctggtgctggccgtgagcagcggcctgagcctgggcaaggagggccccctggtgcacgtggcctgctgctgcggcaacatcctgtgccactgcttcaacaagtacagaaagaacgaggccaagagaagagaggtgctgagcgccgccgccgccgccggcgtgagcgtggccttcggcgcccccatcggcggcgtgctgttcagcctggaggaggtgagctactacttccccctgaagaccctgtggagaagcttcttcgccgccctggtggccgccttcaccctgagaagcatcaaccccttcggcaacagcagactggtgctgttctacgtggagttccacaccccctggcacctgttcgagctggtgcccttcatcctgctgggcatcttcggcggcctgtggggcgccctgttcatcagaaccaacatcgcctggtgcagaaagagaaagaccacccagctgggcaagtaccccgtgatcgaggtgctggtggtgaccgccatcaccgccatcctggccttccccaacgagtacaccagaatgagcaccagcgagctgatcagcgagctgttcaacgactgcggcctgctggacagcagcaagctgtgcgactacgagaacagattcaacaccagcaagggcggcgagctgcccgacagacccgccggcgtgggcgtgtacagcgccatgtggcagctggccctgaccctgatcctgaagatcgtgatcaccatcttcaccttcggcatgaagatccccagcggcctgttcatccccagcatggccgtgggcgccatcgccggcagactgctgggcgtgggcatggagcagctggcctactaccaccaggagtggaccgtgttcaacagctggtgcagccagggcgccgactgcatcacccccggcctgtacgccatggtgggcgccgccgcctgcctgggcggcgtgaccagaatgaccgtgagcctggtggtgatcatgttcgagctgaccggcggcctggagtacatcgtgcccctgatggccgccgccatgaccagcaagtgggtggccgacgccctgggcagagagggcatctacgacgcccacatcagactgaacggctaccccttcctggaggccaaggaggagttcgcccacaagaccctggccatggacgtgatgaagcccagaagaaacgaccccctgctgaccgtgctgacccaggacagcatgaccgtggaggacgtggagaccatcatcagcgagaccacctacagcggcttccccgtggtggtgagcagagagagccagagactggtgggcttcgtgctgagaagagacctgatcatcagcatcgagaacgccagaaagaagcaggacggcgtggtgagcaccagcatcatctacttcaccgagcacagcccccccctgcccccctacaccccccccaccctgaagctgagaaacatcctggacctgagccccttcaccgtgaccgacctgacccccatggagatcgtggtggacatcttcagaaagctgggcctgagacagtgcctggtgacccacaacggcagactgctgggcatcatcaccaagaaggacgtgctgaagcacatcgcccagatggccaaccaggaccccgacagcatcctgttcaactag

SEQ ID NO: 76554 - DNA, 2451 bp, Artificial Sequence; identical to SEQ ID NO: 76553
  Description of Artificial Sequence: Synthetic coding sequence

SEQ ID NO: 76555 - DNA, 2241 bp, Artificial Sequence; identical to SEQ ID NO: 76552
  Description of Artificial Sequence: Synthetic coding sequence

SEQ ID NO: 76556 - DNA, 1947 bp, Artificial Sequence
  Description of Artificial Sequence: Synthetic coding sequence
atgaacatcgtggccggcaccctgagcatgagccccctgaagagagacaagtgccccgagtggaacagctggagccagctgatcatcagcaccgacgagggcgccttcgcctacatcgtgaactacttcatgtacgtgctgtgggccctgctgttcgccttcctggccgtgagcctggtgaaggtgttcgccccctacgcctgcggcagcggcatccccgagatcaagaccatcctgagcggcttcatcatcagaggctacctgggcaagtggaccctggtgatcaagaccatcaccctggtgctggccgtgagcagcggcctgagcctgggcaaggagggccccctggtgcacgtggcctgctgctgcggcaacatcctgtgccactgcttcaacaagtacagaaagaacgaggccaagagaagagaggtgctgagcgccgccgccgccgccggcgtgagcgtggccttcggcgcccccatcggcggcgtgctgttcagcctggaggaggtgagctactacttccccctgaagaccctgtggagaagcttcttcgccgccctggtggccgccttcaccctgagaagcatcaaccccttcggcaacagcagactggtgctgttctacgtggagttccacaccccctggcacctgttcgagctggtgcccttcatcctgctgggcatcttcggcggcctgtggggcgccctgttcatcagaaccaacatcgcctggtgcagaaagagaaagaccacccagctgggcaagtaccccgtgatcgaggtgctggtggtgaccgccatcaccgccatcctggccttccccaacgagtacaccagaatgagcaccagcgagctgatcagcgagctgttcaacgactgcggcctgctggacagcagcaagctgtgcgactacgagaacagattcaacaccagcaagggcggcgagctgcccgacagacccgccggcgtgggcgtgtacagcgccatgtggcagctggccctgaccctgatcctgaagatcgtgatcaccatcttcaccttcggcatgaagatccccagcggcctgttcatccccagcatggccgtgggcgccatcgccggcagactgctgggcgtgggcatggagcagctggcctactaccaccaggagtggaccgtgttcaacagctggtgcagccagggcgccgactgcatcacccccggcctgtacgccatggtgggcgccgccgcctgcctgggcggcgtgaccagaatgaccgtgagcctggtggtgatcatgttcgagctgaccggcggcctggagtacatcgtgcccctgatggccgccgccatgaccagcaagtgggtggccgacgccctgggcagagagggcatctacgacgcccacatcagactgaacggctaccccttcctggaggccaaggaggagttcgcccacaagaccctggccatggacgtgatgaagcccagaagaaacgaccccctgctgaccgtgctgacccaggacagcatgaccgtggaggacgtggagaccatcatcagcgagaccacctacagcggcttccccgtggtggtgagcagagagagccagagactggtgggcttcgtgctgagaagagacctgatcatcagcatcgagaacgccagaaagaagcaggacggcgtggtgagcaccagcatcatctacttcaccgagcacagcccccccctgcccccctacaccccccccaccctgaagctgagaaacatcctggacctgagccccttcaccgtgaccgacctgacccccatggagatcgtggtggacatcttcagaaagctgggcctgagacagtgcctggtgacccacaacggcagactgctgggcatcatcaccaagaaggacgtgctgaagcacatcgcccagatggccaaccaggaccccgacagcatcctgttcaactag

SEQ ID NO: 76557 - DNA, 1062 bp, Artificial Sequence
  Description of Artificial Sequence: Synthetic coding sequence
atggccggctgcagaggcagcctgtgctgctgctgcagatggtgctgctgctgcggcgagagagagaccagaacccccgaggagctgaccatcctgggcgagacccaggaggaggaggacgagatcctgcccagaaaggactacgagagcctggactacgacagatgcatcaacgacccctacctggaggtgctggagaccatggacaacaagaagggcagaagatacgaggccgtgaagtggatggtggtgttcgccatcggcgtgtgcaccggcctggtgggcctgttcgtggacttcttcgtgagactgttcacccagctgaagttcggcgtggtgcagaccagcgtggaggagtgcagccagaagggctgcctggccctgagcctgctggagctgctgggcttcaacctgaccttcgtgttcctggccagcctgctggtgctgatcgagcccgtggccgccggcagcggcatccccgaggtgaagtgctacctgaacggcgtgaaggtgcccggcatcgtgagactgagaaccctgctgtgcaaggtgctgggcgtgctgttcagcgtggccggcggcctgttcgtggagaaggagggccccatgatccacagcggcagcgtggtgggcgccggcctgccccagttccagagcatcagcctgagaaagatccagttcaacttcccctacttcagaagcgacagagacaagagagacttcgtgagcgccggcgccgccgccggcgtggccgccgccttcggcgcccccatcggcggcaccctgttcagcctggaggagggcagcagcttctggaaccagggcctgacctggaaggtgctgttctgcagcatgagcgccaccttcaccctgaacttcttcagaagcggcatccagttcggcagctggggcagcttccagctgcccggcctgctgaacttcggcgagttcaagagcctgagagagcccccctgcgtgagcggcaaccacagaggcggcgtgtgcggcctggacggcgtgagaagaatgcccaccgacgtgctgttcgagagcaacagatag

SEQ ID NO: 76558 - DNA, 2610 bp, Artificial Sequence
  Description of Artificial Sequence: Synthetic coding sequence
atggccggctgcagaggcagcctgtgctgctgctgcagatggtgctgctgctgcggcgagagagagaccagaacccccgaggagctgaccatcctgggcgagacccaggaggaggaggacgagatcctgcccagaaaggactacgagagcctggactacgacagatgcatcaacgacccctacctggaggtgctggagaccatggacaacaagaagggcagaagatacgaggccgtgaagtggatggtggtgttcgccatcggcgtgtgcaccggcctggtgggcctgttcgtggacttcttcgtgagactgttcacccagctgaagttcggcgtggtgcagaccagcgtggaggagtgcagccagaagggctgcctggccctgagcctgctggagctgctgggcttcaacctgaccttcgtgttcctggccagcctgctggtgctgatcgagcccgtggccgccggcagcggcatccccgaggtgaagtgctacctgaacggcgtgaaggtgcccggcatcgtgagactgagaaccctgctgtgcaaggtgctgggcgtgctgttcagcgtggccggcggcctgttcgtggagaaggagggccccatgatccacagcggcagcgtggtgggcgccggcctgccccagttccagagcatcagcctgagaaagatccagttcaacttcccctacttcagaagcgacagagacaagagagacttcgtgagcgccggcgccgccgccggcgtggccgccgccttcggcgcccccatcggcggcaccctgttcagcctggaggagggcagcagcttctggaaccagggcctgacctggaaggtgctgttctgcagcatgagcgccaccttcaccctgaacttcttcagaagcggcatccagttcggcagctggggcagcttccagctgcccggcctgctgaacttcggcgagttcaagtgcagcgacagcgacaagaagtgccacctgtggaccgccatggacctgggcttcttcgtggtgatgggcgtgatcggcggcctgctgggcgccaccttcaactgcctgaacaagagactggccaagtacagaatgagaaacgtgcaccccaagcccaagctggtgagagtgctggagagcctgctggtgagcctggtgaccaccgtggtggtgttcgtggccagcatggtgctgggcgagtgcagacagatgagcagcagcagccagatcggcaacgacagcttccagctgcaggtgaccgaggacgtgaacagcagcatcaagaccttcttctgccccaacgacacctacaacgacatggccaccctgttcttcaacccccaggagagcgccatcctgcagctgttccaccaggacggcaccttcagccccgtgaccctggccctgttcttcgtgctgtacttcctgctggcctgctggacctacggcatcagcgtgcccagcggcctgttcgtgcccagcctgctgtgcggcgccgccttcggcagactggtggccaacgtgctgaagagctacatcggcctgggccacatctacagcggcaccttcgccctgatcggcgccgccgccttcctgggcggcgtggtgagaatgaccatcagcctgaccgtgatcctgatcgagagcaccaacgagatcacctacggcctgcccatcatggtgaccctgatggtggccaagtggaccggcgacttcttcaacaagggcatctacgacatccacgtgggcctgagaggcgtgcccctgctggagtgggagaccgaggtggagatggacaagctgagagccagcgacatcatggagcccaacctgacctacgtgtacccccacaccagaatccagagcctggtgagcatcctgagaaccaccgtgcaccacgccttccccgtggtgaccgagaacagaggcaacgagaaggagttcatgaagggcaaccagctgatcagcaacaacatcaagttcaagaagagcagcatcctgaccagagccggcgagcagagaaagagaagccagagcatgaagagctaccccagcagcgagctgagaaacatgtgcgacgagcacatcgccagcgaggagcccgccgagaaggaggacctgctgcagcagatgctggagagaagatacaccccctaccccaacctgtaccccgaccagagccccagcgaggactggaccatggaggagagattcagacccctgaccttccacggcctgatcctgagaagccagctggtgaccctgctggtgagaggcgtgtgctacagcgagagccagagcagcgccagccagcccagactgagctacgccgagatggccgaggactaccccagataccccgacatccacgacctggacctgaccctgctgaaccccagaatgatcgtggacgtgaccccctacatgaaccccagccccttcaccgtgagccccaacacccacgtgagccaggtgttcaacctgttcagaaccatgggcctgagacacctgcccgtggtgaacgccgtgggcgagatcgtgggcatcatcaccagacacaacctgacctacgagttcctgcaggccagactgagacagcactaccagaccatctag

SEQ ID NO: 76559 - DNA, 2544 bp, Artificial Sequence
  Description of Artificial Sequence: Synthetic coding sequence
atggccggctgcagaggcagcctgtgctgctgctgcagatggtgctgctgctgcggcgagagagagaccagaacccccgaggagctgaccatcctgggcgagacccaggaggaggaggacgagatcctgcccagaaaggactacgagaagggcagaagatacgaggccgtgaagtggatggtggtgttcgccatcggcgtgtgcaccggcctggtgggcctgttcgtggacttcttcgtgagactgttcacccagctgaagttcggcgtggtgcagaccagcgtggaggagtgcagccagaagggctgcctggccctgagcctgctggagctgctgggcttcaacctgaccttcgtgttcctggccagcctgctggtgctgatcgagcccgtggccgccggcagcggcatccccgaggtgaagtgctacctgaacggcgtgaaggtgcccggcatcgtgagactgagaaccctgctgtgcaaggtgctgggcgtgctgttcagcgtggccggcggcctgttcgtggagaaggagggccccatgatccacagcggcagcgtggtgggcgccggcctgccccagttccagagcatcagcctgagaaagatccagttcaacttcccctacttcagaagcgacagagacaagagagacttcgtgagcgccggcgccgccgccggcgtggccgccgccttcggcgcccccatcggcggcaccctgttcagcctggaggagggcagcagcttctggaaccagggcctgacctggaaggtgctgttctgcagcatgagcgccaccttcaccctgaacttcttcagaagcggcatccagttcggcagctggggcagcttccagctgcccggcctgctgaacttcggcgagttcaagtgcagcgacagcgacaagaagtgccacctgtggaccgccatggacctgggcttcttcgtggtgatgggcgtgatcggcggcctgctgggcgccaccttcaactgcctgaacaagagactggccaagtacagaatgagaaacgtgcaccccaagcccaagctggtgagagtgctggagagcctgctggtgagcctggtgaccaccgtggtggtgttcgtggccagcatggtgctgggcgagtgcagacagatgagcagcagcagccagatcggcaacgacagcttccagctgcaggtgaccgaggacgtgaacagcagcatcaagaccttcttctgccccaacgacacctacaacgacatggccaccctgttcttcaacccccaggagagcgccatcctgcagctgttccaccaggacggcaccttcagccccgtgaccctggccctgttcttcgtgctgtacttcctgctggcctgctggacctacggcatcagcgtgcccagcggcctgttcgtgcccagcctgctgtgcggcgccgccttcggcagactggtggccaacgtgctgaagagctacatcggcctgggccacatctacagcggcaccttcgccctgatcggcgccgccgccttcctgggcggcgtggtgagaatgaccatcagcctgaccgtgatcctgatcgagagcaccaacgagatcacctacggcctgcccatcatggtgaccctgatggtggccaagtggaccggcgacttcttcaacaagggcatctacgacatccacgtgggcctgagaggcgtgcccctgctggagtgggagaccgaggtggagatggacaagctgagagccagcgacatcatggagcccaacctgacctacgtgtacccccacaccagaatccagagcctggtgagcatcctgagaaccaccgtgcaccacgccttccccgtggtgaccgagaacagaggcaacgagaaggagttcatgaagggcaaccagctgatcagcaacaacatcaagttcaagaagagcagcatcctgaccagagccggcgagcagagaaagagaagccagagcatgaagagctaccccagcagcgagctgagaaacatgtgcgacgagcacatcgccagcgaggagcccgccgagaaggaggacctgctgcagcagatgctggagagaagatacaccccctaccccaacctgtaccccgaccagagccccagcgaggactggaccatggaggagagattcagacccctgaccttccacggcctgatcctgagaagccagctggtgaccctgctggtgagaggcgtgtgctacagcgagagccagagcagcgccagccagcccagactgagctacgccgagatggccgaggactaccccagataccccgacatccacgacctggacctgaccctgctgaaccccagaatgatcgtggacgtgaccccctacatgaaccccagccccttcaccgtgagccccaacacccacgtgagccaggtgttcaacctgttcagaaccatgggcctgagacacctgcccgtggtgaacgccgtgggcgagatcgtgggcatcatcaccagacacaacctgacctacgagttcctgcaggccagactgagacagcactaccagaccatctag

SEQ ID NO: 76560 - DNA, 963 bp, Artificial Sequence
  Description of Artificial Sequence: Synthetic coding sequence
atggccggctgcagaggcagcctgtgctgctgctgcagatggtgctgctgctgcggcgagagagagaccagaacccccgaggagctgaccatcctgggcgagacccaggaggaggaggacgagatcctgcccagaaaggactacgagagcctggactacgacagatgcatcaacgacccctacctggaggtgctggagaccatggacaacaagaagggcagaagatacgaggccgtgaagtggatggtggtgttcgccatcggcgtgtgcaccggcctggtgggcctgttcgtggacttcttcgtgagactgttcacccagctgaagttcggcgtggtgcagaccagcgtggaggagtgcagccagaagggctgcctggccctgagcctgctggagctgctgggcttcaacctgaccttcgtgttcctggccagcctgctggtgctgatcgagcccgtggccgccggcagcggcatccccgaggtgaagtgctacctgaacggcgtgaaggtgcccggcatcgtgagactgagaaccctgctgtgcaaggtgctgggcgtgctgttcagcgtggccggcggcctgttcgtggagaaggagggccccatgatccacagcggcagcgtggtgggcgccggcctgccccagttccagagcatcagcctgagaaagatccagttcaacttcccctacttcagaagcgacagatacggcaagagacaggagagactgtgcatcagcagaagcggctgctggagctgctgcagcttcagaggcgccaacagaggctacctggtgcagagcagaggcggcttcgtgctgctggagcccagagcccacgtggagagcgccctgctgttccacgtgtgccacctgcacccccagctgctgcccttctgggacagcgtgtggaagctgggcttcctgcccgccccctggatcgccgagctgtggagagtgtag

SEQ ID NO: 76561 - DNA, 927 bp, Artificial Sequence
  Description of Artificial Sequence: Synthetic coding sequence
atggccggctgcagaggcagcctgtgctgctgctgcagatggtgctgctgctgcggcgagagagagaccagaacccccgaggagctgaccatcctgggcgagacccaggaggaggaggacgagatcctgcccagaaaggactacgagagcctggactacgacagatgcatcaacgacccctacctggaggtgctggagaccatggacaacaagaagggcagaagatacgaggccgtgaagtggatggtggtgttcgccatcggcgtgtgcaccggcctggtgggcctgttcgtggacttcttcgtgagactgttcacccagctgaagttcggcgtggtgcagaccagcgtggaggagtgcagccagaagggctgcctggccctgagcctgctggagctgctgggcttcaacctgaccttcgtgttcctggccagcctgctggtgctgatcgagcccgtggccgccggcagcggcatccccgaggtgaagtgctacctgaacggcgtgaaggtgcccggcatcgtgagactgagaaccctgctgtgcaaggtgctgggcgtgctgttcagcgtggccggcggcctgttcgtggagaaggagggccccatgatccacagcggcagcgtggtgggcgccggcctgccccagttccagagcatcagcctgagaaagatccagttcaacttcccctacttcagaagcgacagaagcggctgctggagctgctgcagcttcagaggcgccaacagaggctacctggtgcagagcagaggcggcttcgtgctgctggagcccagagcccacgtggagagcgccctgctgttccacgtgtgccacctgcacccccagctgctgcccttctgggacagcgtgtggaagctgggcttcctgcccgccccctggatcgccgagctgtggagagtgtag

SEQ ID NO: 76562 - DNA, 1062 bp, Artificial Sequence; identical to SEQ ID NO: 76557
  Description of Artificial Sequence: Synthetic coding sequence

SEQ ID NO: 76563 - DNA, 2862 bp, Artificial Sequence
  Description of Artificial Sequence: Synthetic coding sequence
atggccggctgcagaggcagcctgtgctgctgctgcagatggtgctgctgctgcggcgagagagagaccagaacccccgaggagctgaccatcctgggcgagacccaggaggaggaggacgagatcctgcccagaaaggactacgagagcctggactacgacagatgcatcaacgacccctacctggaggtgctggagaccatggacaacaagaagggcagaagatacgaggccgtgaagtggatggtggtgttcgccatcggcgtgtgcaccggcctggtgggcctgttcgtggacttcttcgtgagactgttcacccagctgaagttcggcgtggtgcagaccagcgtggaggagtgcagccagaagggctgcctggccctgagcctgctggagctgctgggcttcaacctgaccttcgtgttcctggccagcctgctggtgctgatcgagcccgtggccgccggcagcggcatccccgaggtgaagtgctacctgaacggcgtgaaggtgcccggcatcgtgagactgagaaccctgctgtgcaaggtgctgggcgtgctgttcagcgtggccggcggcctgttcgtggagaaggagggccccatgatccacagcggcagcgtggtgggcgccggcctgccccagttccagagcatcagcctgagaaagatccagttcaacttcccctacttcagaagcgacagagacaagagagacttcgtgagcgccggcgccgccgccggcgtggccgccgccttcggcgcccccatcggcggcaccctgttcagcctggaggagggcagcagcttctggaaccagggcctgacctggaaggtgctgttctgcagcatgagcgccaccttcaccctgaacttcttcagaagcggcatccagttcggcagctggggcagcttccagctgcccggcctgctgaacttcggcgagttcaagtgcagcgacagcgacaagaagtgccacctgtggaccgccatggacctgggcttcttcgtggtgatgggcgtgatcggcggcctgctgggcgccaccttcaactgcctgaacaagagactggccaagtacagaatgagaaacgtgcaccccaagcccaagctggtgagagtgctggagagcctgctggtgagcctggtgaccaccgtggtggtgttcgtggccagcatggtgctgggcgagtgcagacagatgagcagcagcagccagatcggcaacgacagcttccagctgcaggtgaccgaggacgtgaacagcagcatcaagaccttcttctgccccaacgacacctacaacgacatggccaccctgttcttcaacccccaggagagcgccatcctgcagctgttccaccaggacggcaccttcagccccgtgaccctggccctgttcttcgtgctgtacttcctgctggcctgctggacctacggcatcagcgtgcccagcggcctgttcgtgcccagcctgctgtgcggcgccgccttcggcagactggtggccaacgtgctgaagagctacatcggcctgggccacatctacagcggcaccttcgccctgatcggcgccgccgccttcctgggcggcgtggtgagaatgaccatcagcctgaccgtgatcctgatcgagagcaccaacgagatcacctacggcctgcccatcatggtgaccctgatggtggccaagtggaccggcgacttcttcaacaagggcatctacgacatccacgtgggcctgagaggcgtgcccctgctggagtgggagaccgaggtggagatggacaagctgagagccagcgacatcatggagcccaacctgacctacgtgtacccccacaccagaatccagagcctggtgagcatcctgagaaccaccgtgcaccacgccttccccgtggtgaccgagaacagaggcaacgagaaggagttcatgaagggcaaccagctgatcagcaacaacatcaagttcaagaagagcagcatcctgaccagagccggcgagcagagaaagagaagccagagcatgaagagctaccccagcagcgagctgagaaacatgtgcgacgagcacatcgccagcgaggagcccgccgagaaggaggacctgctgcagcagatgctggagagaagatacaccccctaccccaacctgtaccccgaccagagccccagcgaggactggaccatggaggagagattcagacccctgaccttccacggcctgatcctgagaagccagctggtgaccctgctggtgagaggcgtgtgctacagcgagagccagagcagcgccagccagcccagactgagctacgccgagatggccgaggactaccccagataccccgacatccacgacctggacctgaccctgctgaaccccagaatgatcgtggacgtgaccccctacatgaaccccagccccttcaccgtgagccccaacacccacgtgagccaggtgttcaacctgttcagaaccatgggcctgagacacctgcccgtggtgaacgccgtgggcgaggtgagcgaggcccccgccctgcccccccccctgagagaggaccccctggccagatgctgcctgtgcacccaggccagccaccagaagagaagacaccccaccagaagaggcgagtgcggccccaccctggccctgaaccccgccagactgccctgcaccagagaccccttcccctgcctgcccgccgacggcaccagcgtgcccctggccgtgctgagcagccagagcagagccagcaccagactgtgcctgccccccgagatgctgctgttcaccccctaccactggtgcagcctggtgctgcacctgagaagagacctgagaatcagatag

SEQ ID NO: 76564 - DNA, 369 bp, Artificial Sequence
  Description of Artificial Sequence: Synthetic coding sequence
atggccggctgcagaggcagcctgtgctgctgctgcagatggtgctgctgctgcggcgagagagagaccagaacccccgaggagctgaccatcctgggcgagacccaggaggaggaggacgagatcctgcccagaaaggactacgagagcctggactacgacagatgcatcaacgacccctacctggaggtgctggagaccatggacaacaagaagggcagaagatacgaggccgtgaagtggatggtggtgttcgccatcggcgtgtgcaccggcctggtgggcctgttcgtggacttcttcgtgagactgttcacccagctgaagttcggcgtggtgcagacctacaagttccagatgaagatgtag

SEQ ID NO: 76565 - DNA, 2277 bp, Artificial Sequence
  Description of Artificial Sequence: Synthetic coding sequence
agccccagaagcgccctgttcagagtgggccacatgagcagcgtggagctggacgacgagctgctggaccccgacatggaccccccccaccccttccccaaggagatcccccacaacgagaagctgctgagcctgaagtacgagagcctggactacgacaacagcgagaaccagctgttcctggaggaggagagaagaatcaaccacaccgccttcagaaccgtggagatcaagagatgggtgatctgcgccctgatcggcatcctgaccggcctggtggcctgcttcatcgacatcgtggtggagaacctggccggcctgaagtacagagtgatcaagggcaacatcgacaagttcaccgagaagggcggcctgagcttcagcctgctgctgtgggccaccctgaacgccgccttcgtgctggtgggcagcgtgatcgtggccttcatcgagcccgtggccgccggcagcggcatcccccagatcaagtgcttcctgaacggcgtgaagatcccccacgtggtgagactgaagaccctggtgatcaaggtgagcggcgtgatcctgagcgtggtgggcggcctggccgtgggcaaggagggccccatgatccacagcggcagcgtgatcgccgccggcatcagccagggcagaagcaccagcctgaagagagacttcaagatcttcgagtacttcagaagagacaccgagaagagagacttcgtgagcgccggcgccgccgccggcgtgagcgccgccttcggcgcccccgtgggcggcgtgctgttcagcctggaggagggcgccagcttctggaaccagttcctgacctggagaatcttcttcgccagcatgatcagcaccttcaccctgaacttcgtgctgagcatctaccacggcaacatgtgggacctgagcagccccggcctgatcaacttcggcagattcgacagcgagaagatggcctacaccatccacgagatccccgtgttcatcgccatgggcgtggtgggcggcgtgctgggcgccgtgttcaacgccctgaactactggctgaccatgttcagaatcagatacatccacagaccctgcctgcaggtgatcgaggccgtgctggtggccgccgtgaccgccaccgtggccttcgtgctgatctacagcagcagagactgccagcccctgcagggcggcagcatgagctaccccctgcagctgttctgcgccgacggcgagtacaacagcatggccgccgccttcttcaacacccccgagaagagcgtggtgagcctgttccacgacccccccggcagctacaaccccctgaccctgggcctgttcaccctggtgtacttcttcctggcctgctggacctacggcctgaccgtgagcgccggcgtgttcatccccagcctgctgatcggcgccgcctggggcagactgttcggcatcagcctgagctacctgaccggcgccgccatctgggccgaccccggcaagtacgccctgatgggcgccgccgcccagctgggcggcatcgtgagaatgaccctgagcctgaccgtgatcatgatggaggccaccagcaacgtgacctacggcttccccatcatgctggtgctgatgaccgccaagatcgtgggcgacgtgttcatcgagggcctgtacgacatgcacatccagctgcagagcgtgcccttcctgcactgggaggcccccgtgaccagccacagcctgaccgccagagaggtgatgagcacccccgtgacctgcctgagaagaagagagaaggtgggcgtgatcgtggacgtgctgagcgacaccgccagcaaccacaacggcttccccgtggtggagcacgccgacgacacccagcccgccagactgcagggcctgatcctgagaagccagctgatcgtgctgctgaagcacaaggtgttcgtggagagaagcaacctgggcctggtgcagagaagactgagactgaaggacttcagagacgcctaccccagattcccccccatccagagcatccacgtgagccaggacgagagagagtgcaccatggacctgagcgagttcatgaaccccagcccctacaccgtgccccaggaggccagcctgcccagagtgttcaagctgttcagagccctgggcctgagacacctggtggtggtggacaacagaaaccaggtggtgggcctggtgaccagaaaggacctggccagatacagactgggcaagagaggcctggaggagctgagcctggcccagacctag

SEQ ID NO: 76566 - DNA, 2418 bp, Artificial Sequence
  Description of Artificial Sequence: Synthetic coding sequence
atggccaacgtgagcaagaaggtgagctggagcggcagagacagagacgacgaggaggccgcccccctgctgagaagaaccgccagacccggcggcggcacccccctgctgaacggcgccggccccggcgccgccagacagagccccagaagcgccctgttcagagtgggccacatgagcagcgtggagctggacgacgagctgctggaccccgacatggaccccccccaccccttccccaaggagatcccccacaacgagaagctgctgagcctgaagtacgagagcctggactacgacaacagcgagaaccagctgttcctggaggaggagagaagaatcaaccacaccgccttcagaaccgtggagatcaagagatgggtgatctgcgccctgatcggcatcctgaccggcctggtggcctgcttcatcgacatcgtggtggagaacctggccggcctgaagtacagagtgatcaagggcaacatcgacaagttcaccgagaagggcggcctgagcttcagcctgctgctgtgggccaccctgaacgccgccttcgtgctggtgggcagcgtgatcgtggccttcatcgagcccgtggccgccggcagcggcatcccccagatcaagtgcttcctgaacggcgtgaagatcccccacgtggtgagactgaagaccctggtgatcaaggtgagcggcgtgatcctgagcgtggtgggcggcctggccgtgggcaaggagggccccatgatccacagcggcagcgtgatcgccgccggcatcagccagggcagaagcaccagcctgaagagagacttcaagatcttcgagtacttcagaagagacaccgagaagagagacttcgtgagcgccggcgccgccgccggcgtgagcgccgccttcggcgcccccgtgggcggcgtgctgttcagcctggaggagggcgccagcttctggaaccagttcctgacctggagaatcttcttcgccagcatgatcagcaccttcaccctgaacttcgtgctgagcatctaccacggcaacatgtgggacctgagcagccccggcctgatcaacttcggcagattcgacagcgagaagatggcctacaccatccacgagatccccgtgttcatcgccatgggcgtggtgggcggcgtgctgggcgccgtgttcaacgccctgaactactggctgaccatgttcagaatcagatacatccacagaccctgcctgcaggtgatcgaggccgtgctggtggccgccgtgaccgccaccgtggccttcgtgctgatctacagcagcagagactgccagcccctgcagggcggcagcatgagctaccccctgcagctgttctgcgccgacggcgagtacaacagcatggccgccgccttcttcaacacccccgagaagagcgtggtgagcctgttccacgacccccccggcagctacaaccccctgaccctgggcctgttcaccctggtgtacttcttcctggcctgctggacctacggcctgaccgtgagcgccggcgtgttcatccccagcctgctgatcggcgccgcctggggcagactgttcggcatcagcctgagctacctgaccggcgccgccatctgggccgaccccggcaagtacgccctgatgggcgccgccgcccagctgggcggcatcgtgagaatgaccctgagcctgaccgtgatcatgatggaggccaccagcaacgtgacctacggcttccccatcatgctggtgctgatgaccgccaagatcgtgggcgacgtgttcatcgagggcctgtacgacatgcacatccagctgcagagcgtgcccttcctgcactgggaggcccccgtgaccagccacagcctgaccgccagagaggtgatgagcacccccgtgacctgcctgagaagaagagagaaggtgggcgtgatcgtggacgtgctgagcgacaccgccagcaaccacaacggcttccccgtggtggagcacgccgacgacacccagcccgccagactgcagggcctgatcctgagaagccagctgatcgtgctgctgaagcacaaggtgttcgtggagagaagcaacctgggcctggtgcagagaagactgagactgaaggacttcagagacgcctaccccagattcccccccatccagagcatccacgtgagccaggacgagagagagtgcaccatggacctgagcgagttcatgaaccccagcccctacaccgtgccccaggaggccagcctgcccagagtgttcaagctgttcagagccctgggcctgagacacctggtggtggtggacaacagaaaccaggtggtgggcctggtgaccagaaaggacctggccagatacagactgggcaagagaggcctggaggagctgagcctggcccagacctag

SEQ ID NO: 76567 - DNA, 2244 bp, Artificial Sequence
  Description of Artificial Sequence: Synthetic coding sequence
atgagcagcgtggagctggacgacgagctgctggaccccgacatggaccccccccaccccttccccaaggagatcccccacaacgagaagctgctgagcctgaagtacgagagcctggactacgacaacagcgagaaccagctgttcctggaggaggagagaagaatcaaccacaccgccttcagaaccgtggagatcaagagatgggtgatctgcgccctgatcggcatcctgaccggcctggtggcctgcttcatcgacatcgtggtggagaacctggccggcctgaagtacagagtgatcaagggcaacatcgacaagttcaccgagaagggcggcctgagcttcagcctgctgctgtgggccaccctgaacgccgccttcgtgctggtgggcagcgtgatcgtggccttcatcgagcccgtggccgccggcagcggcatcccccagatcaagtgcttcctgaacggcgtgaagatcccccacgtggtgagactgaagaccctggtgatcaaggtgagcggcgtgatcctgagcgtggtgggcggcctggccgtgggcaaggagggccccatgatccacagcggcagcgtgatcgccgccggcatcagccagggcagaagcaccagcctgaagagagacttcaagatcttcgagtacttcagaagagacaccgagaagagagacttcgtgagcgccggcgccgccgccggcgtgagcgccgccttcggcgcccccgtgggcggcgtgctgttcagcctggaggagggcgccagcttctggaaccagttcctgacctggagaatcttcttcgccagcatgatcagcaccttcaccctgaacttcgtgctgagcatctaccacggcaacatgtgggacctgagcagccccggcctgatcaacttcggcagattcgacagcgagaagatggcctacaccatccacgagatccccgtgttcatcgccatgggcgtggtgggcggcgtgctgggcgccgtgttcaacgccctgaactactggctgaccatgttcagaatcagatacatccacagaccctgcctgcaggtgatcgaggccgtgctggtggccgccgtgaccgccaccgtggccttcgtgctgatctacagcagcagagactgccagcccctgcagggcggcagcatgagctaccccctgcagctgttctgcgccgacggcgagtacaacagcatggccgccgccttcttcaacacccccgagaagagcgtggtgagcctgttccacgacccccccggcagctacaaccccctgaccctgggcctgttcaccctggtgtacttcttcctggcctgctggacctacggcctgaccgtgagcgccggcgtgttcatccccagcctgctgatcggcgccgcctggggcagactgttcggcatcagcctgagctacctgaccggcgccgccatctgggccgaccccggcaagtacgccctgatgggcgccgccgcccagctgggcggcatcgtgagaatgaccctgagcctgaccgtgatcatgatggaggccaccagcaacgtgacctacggcttccccatcatgctggtgctgatgaccgccaagatcgtgggcgacgtgttcatcgagggcctgtacgacatgcacatccagctgcagagcgtgcccttcctgcactgggaggcccccgtgaccagccacagcctgaccgccagagaggtgatgagcacccccgtgacctgcctgagaagaagagagaaggtgggcgtgatcgtggacgtgctgagcgacaccgccagcaaccacaacggcttccccgtggtggagcacgccgacgacacccagcccgccagactgcagggcctgatcctgagaagccagctgatcgtgctgctgaagcacaaggtgttcgtggagagaagcaacctgggcctggtgcagagaagactgagactgaaggacttcagagacgcctaccccagattcccccccatccagagcatccacgtgagccaggacgagagagagtgcaccatggacctgagcgagttcatgaaccccagcccctacaccgtgccccaggaggccagcctgcccagagtgttcaagctgttcagagccctgggcctgagacacctggtggtggtggacaacagaaaccaggtggtgggcctggtgaccagaaaggacctggccagatacagactgggcaagagaggcctggaggagctgagcctggcccagacctag

SEQ ID NO: 76568 - DNA, 2346 bp, Artificial Sequence
  Description of Artificial Sequence: Synthetic coding sequence
atggccaacgtgagcaagaaggtgagctggagcggcagagacagagacgacgaggaggccgcccccctgctgagaagaaccgccagacccggcggcggcacccccctgctgaacggcgccggccccggcgccgccagacaggacatggaccccccccaccccttccccaaggagatcccccacaacgagaagctgctgagcctgaagtacgagagcctggactacgacaacagcgagaaccagctgttcctggaggaggagagaagaatcaaccacaccgccttcagaaccgtggagatcaagagatgggtgatctgcgccctgatcggcatcctgaccggcctggtggcctgcttcatcgacatcgtggtggagaacctggccggcctgaagtacagagtgatcaagggcaacatcgacaagttcaccgagaagggcggcctgagcttcagcctgctgctgtgggccaccctgaacgccgccttcgtgctggtgggcagcgtgatcgtggccttcatcgagcccgtggccgccggcagcggcatcccccagatcaagtgcttcctgaacggcgtgaagatcccccacgtggtgagactgaagaccctggtgatcaaggtgagcggcgtgatcctgagcgtggtgggcggcctggccgtgggcaaggagggccccatgatccacagcggcagcgtgatcgccgccggcatcagccagggcagaagcaccagcctgaagagagacttcaagatcttcgagtacttcagaagagacaccgagaagagagacttcgtgagcgccggcgccgccgccggcgtgagcgccgccttcggcgcccccgtgggcggcgtgctgttcagcctggaggagggcgccagcttctggaaccagttcctgacctggagaatcttcttcgccagcatgatcagcaccttcaccctgaacttcgtgctgagcatctaccacggcaacatgtgggacctgagcagccccggcctgatcaacttcggcagattcgacagcgagaagatggcctacaccatccacgagatccccgtgttcatcgccatgggcgtggtgggcggcgtgctgggcgccgtgttcaacgccctgaactactggctgaccatgttcagaatcagatacatccacagaccctgcctgcaggtgatcgaggccgtgctggtggccgccgtgaccgccaccgtggccttcgtgctgatctacagcagcagagactgccagcccctgcagggcggcagcatgagctaccccctgcagctgttctgcgccgacggcgagtacaacagcatggccgccgccttcttcaacacccccgagaagagcgtggtgagcctgttccacgacccccccggcagctacaaccccctgaccctgggcctgttcaccctggtgtacttcttcctggcctgctggacctacggcctgaccgtgagcgccggcgtgttcatccccagcctgctgatcggcgccgcctggggcagactgttcggcatcagcctgagctacctgaccggcgccgccatctgggccgaccccggcaagtacgccctgatgggcgccgccgcccagctgggcggcatcgtgagaatgaccctgagcctgaccgtgatcatgatggaggccaccagcaacgtgacctacggcttccccatcatgctggtgctgatgaccgccaagatcgtgggcgacgtgttcatcgagggcctgtacgacatgcacatccagctgcagagcgtgcccttcctgcactgggaggcccccgtgaccagccacagcctgaccgccagagaggtgatgagcacccccgtgacctgcctgagaagaagagagaaggtgggcgtgatcgtggacgtgctgagcgacaccgccagcaaccacaacggcttccccgtggtggagcacgccgacgacacccagcccgccagactgcagggcctgatcctgagaagccagctgatcgtgctgctgaagcacaaggtgttcgtggagagaagcaacctgggcctggtgcagagaagactgagactgaaggacttcagagacgcctaccccagattcccccccatccagagcatccacgtgagccaggacgagagagagtgcaccatggacctgagcgagttcatgaaccccagcccctacaccgtgccccaggaggccagcctgcccagagtgttcaagctgttcagagccctgggcctgagacacctggtggtggtggacaacagaaaccaggtggtgggcctggtgaccagaaaggacctggccagatacagactgggcaagagaggcctggaggagctgagcctggcccagacctag

SEQ ID NO: 76569 - DNA, 1545 bp, Artificial Sequence
  Description of Artificial Sequence: Synthetic coding sequence
atggtgctggacctggacctgttcagagtggacaagggcggcgaccccgccctgatcagagagacccaggagaagagattcaaggaccccggcctggtggaccagctggtgaaggccgacagcgagtggagaagatgcagattcagagccgacaacctgaacaagctgaagaacctgtgcagcaagaccatcggcgagaagatgaagaagaaggagcccgtgggcgacgacgagagcgtgcccgagaacgtgctgagcttcgacgacctgaccgccgacgccctggccaacctgaaggtgagccagatcaagaaggtgagactgctgatcgacgaggccatcctgaagtgcgacgccgagagaatcaagctggaggccgagagattcgagaacctgagagagatcggcaacctgctgcaccccagcgtgcccatcagcaacgacgaggacgtggacaacaaggtggagagaatctggggcgactgcaccgtgagaaagaagtacagccacgtggacctggtggtgatggtggacggcttcgagggcgagaagggcgccgtggtggccggcagcagaggctacttcctgaagggcgtgctggtgttcctggagcaggccctgatccagtacgccctgagaaccctgggcagcagaggctacatccccatctacacccccttcttcatgagaaaggaggtgatgcaggaggtggcccagctgagccagttcgacgaggagctgtacaaggtgatcggcaagggcagcgagaagagcgacgacaacagctacgacgagaagtacctgatcgccaccagcgagcagcccatcgccgccctgcacagagacgagtggctgagacccgaggacctgcccatcaagtacgccggcctgagcacctgcttcagacaggaggtgggcagccacggcagagacaccagaggcatcttcagagtgcaccagttcgagaagatcgagcagttcgtgtacagcagcccccacgacaacaagagctgggagatgttcgaggagatgatcaccaccgccgaggagttctaccagagcctgggcatcccctaccacatcgtgaacatcgtgagcggcagcctgaaccacgccgccagcaagaagctggacctggaggcctggttccccggcagcggcgccttcagagagctggtgagctgcagcaactgcaccgactaccaggccagaagactgagaatcagatacggccagaccaagaagatgatggacaaggtggagttcgtgcacatgctgaacgccaccatgtgcgccaccaccagaaccatctgcgccatcctggagaactaccagaccgagaagggcatcaccgtgcccgagaagctgaaggagttcatgccccccggcctgcaggagctgatccccttcgtgaagcccgcccccatcgagcaggagcccagcaagaagcagaagaagcagcacgagggcagcaagaagaaggccgccgccagagacgtgaccctggagaacagactgcagaacatggaggtgaccgacgcctag

SEQ ID NO: 76570 - DNA, 2745 bp, Artificial Sequence
  Description of Artificial Sequence: Synthetic coding sequence
atgggccccttcaagagcagcgtgttcatcctgatcctgcacctgctggagggcgccctgagcaacagcctgatccagctgaacaacaacggctacgagggcatcgtggtggccatcgaccccaacgtgcccgaggacgagaccctgatccagcagatcaaggacatggtgacccaggccagcctgtacctgctggaggccaccggcaagagattctacttcaagaacgtggccatcctgatccccgagacctggaagaccaaggccgactacgtgagacccaagctggagacctacaagaacgccgacgtgctggtggccgagagcaccccccccggcaacgacgagccctacaccgagcagatgggcaactgcggcgagaagggcgagagaatccacctgacccccgacttcatcgccggcaagaagctggccgagtacggcccccagggcagagccttcgtgcacgagtgggcccacctgagatggggcgtgttcgacgagtacaacaacgacgagaagttctacctgagcaacggcagaatccaggccgtgagatgcagcgccggcatcaccggcaccaacgtggtgaagaagtgccagggcggcagctgctacaccaagagatgcaccttcaacaaggtgaccggcctgtacgagaagggctgcgagttcgtgctgcagagcagacagaccgagaaggccagcatcatgttcgcccagcacgtggacagcatcgtggagttctgcaccgagcagaaccacaacaaggaggcccccaacaagcagaaccagaagtgcaacctgagaagcacctgggaggtgatcagagacagcgaggacttcaagaagaccacccccatgaccacccagccccccaaccccaccttcagcctgctgcagatcggccagagaatcgtgtgcctggtgctggacaagagcggcagcatggccaccggcaacagactgaacagactgaaccaggccggccagctgttcctgctgcagaccgtggagctgggcagctgggtgggcatggtgaccttcgacagcgccgcccacgtgcagaacgagctgatccagatcaacagcggcagcgacagagacaccctggccaagagactgcccgccgccgccagcggcggcaccagcatctgcagcggcctgagaagcgccttcaccgtgatcagaaagaagtaccccaccgacggcagcgagatcgtgctgctgaccgacggcgaggacaacaccatcagcggctgcttcaacgaggtgaagcagagcggcgccatcatccacaccgtggccctgggccccagcgccgcccaggagctggaggagctgagcaagatgaccggcggcctgcagacctacgccagcgaccaggtgcagaacaacggcctgatcgacgccttcggcgccctgagcagcggcaacggcgccgtgagccagagaagcatccagctggagagcaagggcctgaccctgcagaacagccagtggatgaacggcaccgtgatcgtggacagcaccgtgggcaaggacaccctgttcctgatcacctggaccatgcagcccccccagatcctgctgtgggaccccagcggccagaagcagggcggcttcgtggtggacaagaacaccaagatggcctacctgcagatccccggcatcgccaaggtgggcacctggaagtacagcctgcaggccagcagccagaccctgaccctgaccgtgaccagcagagccagcaacgccaccctgccccccatcaccgtgaccagcaagaccaacaaggacaccagcaagttccccagccccctggtggtgtacgccaacatcagacagggcgccagccccatcctgagagccagcgtgaccgccctgatcgagagcgtgaacggcaagaccgtgaccctggagctgctggacaacggcgccggcgccgacgccaccaaggacgacggcgtgtacagcagatacttcaccacctacgacaccaacggcagatacagcgtgaaggtgagagccctgggcggcgtgaacgccgccagaagaagagtgatcccccagcagagcggcgccctgtacatccccggctggatcgagaacgacgagatccagtggaacccccccagacccgagatcaacaaggacgacgtgcagcacaagcaggtgtgcttcagcagaaccagcagcggcggcagcttcgtggccagcgacgtgcccaacgcccccatccccgacctgttcccccccggccagatcaccgacctgaaggccgagatccacggcggcagcctgatcaacctgacctggaccgcccccggcgacgactacgaccacggcaccgcccacaagtacatcatcagaatcagcaccagcatcctggacctgagagacaagttcaacgagagcctgcaggtgaacaccaccgccctgatccccaaggaggccaacagcgaggaggtgttcctgttcaagcccgagaacatcaccttcgagaacggcaccgacctgttcatcgccatccaggccgtggacaaggtggacctgaagagcgagatcagcaacatcgccagagtgagcctgttcatccccccccagaccccccccgagacccccagccccgacgagaccagcgccccctgccccaacatccacatcaacagcaccatccccggcatccacatcctgaagatcatgtggaagtggatcggcgagctgcagctgagcatcgcctag

SEQ ID NO: 76571 - DNA, 987 bp, Artificial Sequence
  Description of Artificial Sequence: Synthetic coding sequence
atgaccacccagccccccaaccccaccttcagcctgctgcagatcggccagagaatcgtgtgcctggtgctggacaagagcggcagcatggccaccggcaacagactgaacagactgaaccaggccggccagctgttcctgctgcagaccgtggagctgggcagctgggtgggcatggtgaccttcgacagcgccgcccacgtgcagaacgagctgatccagatcaacagcggcagcgacagagacaccctggccaagagactgcccgccgccgccagcggcggcaccagcatctgcagcggcctgagaagcgccttcaccgtgatcagaaagaagtaccccaccgacggcagcgagatcgtgctgctgaccgacggcgaggacaacaccatcagcggctgcttcaacgaggtgaagcagagcggcgccatcatccacaccgtggccctgggccccagcgccgcccaggagctggaggagctgagcaagatgaccggcggcctgcagacctacgccagcgaccaggtgcagaacaacggcctgatcgacgccttcggcgccctgagcagcggcaacggcgccgtgagccagagaagcatccagctggagagcaagggcctgaccctgcagaacagccagtggatgaacggcaccgtgatcgtggacagcaccgtgggcaaggacaccctgttcctgatcacctggaccatgcagcccccccagatcctgctgtgggaccccagcggccagaagcagggcggcttcgtggtggacaagaacaccaagatggcctacctgcagatccccggcatcgccaaggtgggcacctggaagtacagcctgcaggccagcagccagaccctgaccctgaccgtgaccagcagagccagcaacgccaccctgccccccatcaccgtgaccagcaagaccaacaaggacaccagcaacctgcccaacagccagggccagtgccacagccccgactag

SEQ ID NO: 76572 - DNA, 2064 bp, Artificial Sequence
  Description of Artificial Sequence: Synthetic coding sequence
atggaggagctggtgggcctgagagagggcttcagcggcgaccccgtgaccctgcaggagctgtggggcccctgcccccacatcagaagagccatccagggcggcctggagtggctgaagcagaaggtgttcagactgggcgaggactggtacttcctgatgaccctgggcgtgctgatggccctggtgagctacgccatgaacttcgccatcggctgcgtggtgagagcccaccagtggctgtacagagagatcggcgacagccacctgctgagatacctgagctggaccgtgtaccccgtggccctggtgagcttcagcagcggcttcagccagagcatcacccccagcagcggcggcagcggcatccccgagctgaagaccatgctggccggcgtgatcctggaggactacctggacatcaagaacttcggcgccaaggtggtgggcctgagctgcaccctggccaccggcagcaccctgttcctgggcaaggtgggccccttcgtgcacctgagcgtgatgatcgccgcctacctgggcagagtgagaaccaccaccatcggcgagcccgagaacaagagcaagcagaacgagatgctggtggccgccgccgccgtgggcgtggccaccgtgttcgccgcccccttcagcggcgtgctgttcagcatcgaggtgatgagcagccacttcagcgtgagagactactggagaggcttcttcgccgccacctgcggcgccttcatcttcagactgctggccgtgttcaacagcgagcaggagaccatcaccagcctgtacaagaccagcttcagagtggacgtgcccttcgacctgcccgagatcttcttcttcgtggccctgggcggcatctgcggcgtgctgagctgcgcctacctgttctgccagagaaccttcctgagcttcatcaagaccaacagatacagcagcaagctgctggccaccagcaagcccgtgtacagcgccctggccaccctgctgctggccagcatcacctacccccccggcgtgggccacttcctggccagcagactgagcatgaagcagcacctggacagcctgttcgacaaccacagctgggccctgatgacccagaacagcagccccccctggcccgaggagctggacccccagcacctgtggtgggagtggtaccaccccagattcaccatcttcggcaccctggccttcttcctggtgatgaagttctggatgctgatcctggccaccaccatccccatgcccgccggctacttcatgcccatcttcatcctgggcgccgccatcggcagactgctgggcgaggccctggccgtggccttccccgagggcatcgtgaccggcggcgtgaccaaccccatcatgcccggcggctacgccctggccggcgccgccgccttcagcggcgccgtgacccacaccatcagcaccgccctgctggccttcgagctgaccggccagatcgtgcacgccctgcccgtgctgatggccgtgctggccgccaacgccatcgcccagagctgccagcccagcttctacgacggcaccatcatcgtgaagaagctgccctacctgcccagaatcctgggcagaaacatcggcagccaccacgtgagagtggagcacttcatgaaccacagcatcaccaccctggccaaggacacccccctggaggaggtggtgaaggtggtgaccagcaccgacgtgaccgagtaccccctggtggagagcaccgagagccagatcctggtgggcatcgtgcagagagcccagctggtgcaggccctgcaggccgagccccccagcagagcccccggccaccagcagtgcctgcaggacatcctggccagaggctgccccaccgagcccgtgaccctgaccctgttcagcgagaccaccctgcaccaggcccagaacctgttcaagctgctgaacctgcagagcctgttcgtgaccagcagaggcagagccgtgggctgcgtgagctgggtggagatgaagaaggccatcagcaacctgaccaacccccccgcccccaagtag

SEQ ID NO: 76573 - DNA, 2061 bp, Artificial Sequence
  Description of Artificial Sequence: Synthetic coding sequence
atggaggagctggtgggcctgagagagggcttcagcggcgaccccgtgaccctgcaggagctgtggggcccctgcccccacatcagaagagccatccagggcggcctggagtggctgaagcagaaggtgttcagactgggcgaggactggtacttcctgatgaccctgggcgtgctgatggccctggtgagctacgccatgaacttcgccatcggctgcgtggtgagagcccaccagtggctgtacagagagatcggcgacagccacctgctgagatacctgagctggaccgtgtaccccgtggccctggtgagcttcagcagcggcttcagccagagcatcacccccagcagcggcggcagcggcatccccgagctgaagaccatgctggccggcgtgatcctggaggactacctggacatcaagaacttcggcgccaaggtggtgggcctgagctgcaccctggccaccggcagcaccctgttcctgggcaaggtgggccccttcgtgcacctgagcgtgatgatcgccgcctacctgggcagagtgagaaccaccaccatcggcgagcccgagaacaagagcaagcagaacgagatgctggtggccgccgccgccgtgggcgtggccaccgtgttcgccgcccccttcagcggcgtgctgttcagcatcgaggtgatgagcagccacttcagcgtgagagactactggagaggcttcttcgccgccacctgcggcgccttcatcttcagactgctggccgtgttcaacagcgagcaggagaccatcaccagcctgtacaagaccagcttcagagtggacgtgcccttcgacctgcccgagatcttcttcttcgtggccctgggcggcatctgcggcgtgctgagctgcgcctacctgttctgccagagaaccttcctgagcttcatcaagaccaacagatacagcagcaagctgctggccaccagcaagcccgtgtacagcgccctggccaccctgctgctggccagcatcacctacccccccggcgtgggccacttcctggccagcagactgagcatgaagcagcacctggacagcctgttcgacaaccacagctgggccctgatgacccagaacagcagccccccctggcccgaggagctggacccccagcacctgtggtgggagtggtaccaccccagattcaccatcttcggcaccctggccttcttcctggtgatgaagttctggatgctgatcctggccaccaccatccccatgcccgccggctacttcatgcccatcttcatcctgggcgccgccatcggcagactgctgggcgaggccctggccgtggccttccccgagggcatcgtgaccggcggcgtgaccaaccccatcatgcccggcggctacgccctggccggcgccgccgccttcagcggcgccgtgacccacaccatcagcaccgccctgctggccttcgagctgaccggccagatcgtgcacgccctgcccgtgctgatggccgtgctggccgccaacgccatcgcccagagctgccagcccagcttctacgacggcaccatcatcgtgaagaagctgccctacctgcccagaatcctgggcagaaacatcggcagccaccacgtgagagtggagcacttcatgaaccacagcatcaccaccctggccaaggacacccccctggaggaggtggtgaaggtggtgaccagcaccgacgtgaccgagtaccccctggtggagagcaccgagagccagatcctggtgggcatcgtgcagagagcccagctggtgcaggccctgcaggccgagccccccagcagagcccccggccaccagtgcctgcaggacatcctggccagaggctgccccaccgagcccgtgaccctgaccctgttcagcgagaccaccctgcaccaggcccagaacctgttcaagctgctgaacctgcagagcctgttcgtgaccagcagaggcagagccgtgggctgcgtgagctgggtggagatgaagaaggccatcagcaacctgaccaacccccccgcccccaagtag

SEQ ID NO: 76574 - DNA, 2061 bp, Artificial Sequence; identical to SEQ ID NO: 76573
  Description of Artificial Sequence: Synthetic coding sequence

SEQ ID NO: 76575 - DNA, 1935 bp, Artificial Sequence
  Description of Artificial Sequence: Synthetic coding sequence
atggaggagctggtgggcctgagagagggcttcagcggcgaccccgtgaccctgcaggagctgtggggcccctgcccccacatcagaagagccatccagggcggcctggagtggctgaagcagaaggtgttcagactgggcgaggactggtacttcctgatgaccctgggcgtgctgatggccctggtgagctacgccatgaacttcgccatcggctgcgtggtgagaggcagcggcatccccgagctgaagaccatgctggccggcgtgatcctggaggactacctggacatcaagaacttcggcgccaaggtggtgggcctgagctgcaccctggccaccggcagcaccctgttcctgggcaaggtgggccccttcgtgcacctgagcgtgatgatcgccgcctacctgggcagagtgagaaccaccaccatcggcgagcccgagaacaagagcaagcagaacgagatgctggtggccgccgccgccgtgggcgtggccaccgtgttcgccgcccccttcagcggcgtgctgttcagcatcgaggtgatgagcagccacttcagcgtgagagactactggagaggcttcttcgccgccacctgcggcgccttcatcttcagactgctggccgtgttcaacagcgagcaggagaccatcaccagcctgtacaagaccagcttcagagtggacgtgcccttcgacctgcccgagatcttcttcttcgtggccctgggcggcatctgcggcgtgctgagctgcgcctacctgttctgccagagaaccttcctgagcttcatcaagaccaacagatacagcagcaagctgctggccaccagcaagcccgtgtacagcgccctggccaccctgctgctggccagcatcacctacccccccggcgtgggccacttcctggccagcagactgagcatgaagcagcacctggacagcctgttcgacaaccacagctgggccctgatgacccagaacagcagccccccctggcccgaggagctggacccccagcacctgtggtgggagtggtaccaccccagattcaccatcttcggcaccctggccttcttcctggtgatgaagttctggatgctgatcctggccaccaccatccccatgcccgccggctacttcatgcccatcttcatcctgggcgccgccatcggcagactgctgggcgaggccctggccgtggccttccccgagggcatcgtgaccggcggcgtgaccaaccccatcatgcccggcggctacgccctggccggcgccgccgccttcagcggcgccgtgacccacaccatcagcaccgccctgctggccttcgagctgaccggccagatcgtgcacgccctgcccgtgctgatggccgtgctggccgccaacgccatcgcccagagctgccagcccagcttctacgacggcaccatcatcgtgaagaagctgccctacctgcccagaatcctgggcagaaacatcggcagccaccacgtgagagtggagcacttcatgaaccacagcatcaccaccctggccaaggacacccccctggaggaggtggtgaaggtggtgaccagcaccgacgtgaccgagtaccccctggtggagagcaccgagagccagatcctggtgggcatcgtgcagagagcccagctggtgcaggccctgcaggccgagccccccagcagagcccccggccaccagcagtgcctgcaggacatcctggccagaggctgccccaccgagcccgtgaccctgaccctgttcagcgagaccaccctgcaccaggcccagaacctgttcaagctgctgaacctgcagagcctgttcgtgaccagcagaggcagagccgtgggctgcgtgagctgggtggagatgaagaaggccatcagcaacctgaccaacccccccgcccccaagtag

SEQ ID NO: 76576 - DNA, 1389 bp, Artificial Sequence
  Description of Artificial Sequence: Synthetic coding sequence
atggaggagttcgtgggcctgagagagggcagcagcggcaaccccgtgaccctgcaggagctgtggggcccctgccccagaatcagaagaggcatcagaggcggcctggagtggctgaagcagaagctgttcagactgggcgaggactggtacttcctgatgaccctgggcgtgctgatggccctggtgagctgcgccatggacctggccgtggagagcgtggtgagagcccaccagtggctgtacagagagatcggcgacagccacctgctgagatacctgagctggaccgtgtaccccgtggccctggtgagcttcagcagcggcttcagccagagcatcacccccagcagcggcggcagcggcatccccgaggtgaagaccatgctggccggcgtggtgctggaggactacctggacatcaagaacttcggcgccaaggtggtgggcctgagctgcaccctggcctgcggcagcaccctgttcctgggcaaggtgggccccttcgtgcacctgagcgtgatgatggccgcctacctgggcagagtgagaaccaccaccatcggcgagcccgagaacaagagcaagcccgtgtacagcgccctggccaccctggtgctggccagcatcacctacccccccagcgccggcagattcctggccagcagactgagcatgaagcagcacctggacagcctgttcgacaaccacagctgggccctgatgacccagaacagcagccccccctggcccgaggagctggacccccagcacctgtggtgggagtggtaccaccccagattcaccatcttcggcaccctggccttcttcctggtgatgaagttctggatgctgatcctggccaccaccatccccatgcccgccggctacttcatgcccatcttcgtgtacggcgccgccatcggcagactgttcggcgagaccctgagcttcatcttccccgagggcatcgtggccggcggcatcaccaaccccatcatgcccggcggctacgccctggccggcgccgccgccttcagcggcgccgtgacccacaccatcagcaccgccctgctggccttcgaggtgaccggccagatcgtgcacgccctgcccgtgctgatggccgtgctggccgccaacgccatcgcccagagctgccagcccagcttctacgacggcaccgtgatcgtgaagaagctgccctacctgcccagaatcctgggcagaaacatcggcagccacagagtgagagtggagcacttcatgaaccacagcatcaccaccctggccatcaccctgatgaacgacgagatcggcgtgcactgccaccagggccaggcccagatgcccagcggcgtggtgtggttccccgtgagaggcagctag

SEQ ID NO: 76577 - DNA, 1554 bp, Artificial Sequence
  Description of Artificial Sequence: Synthetic coding sequence
atgccctgcccccccctgctgagcgtgcccgtgagagccgccggcgagcaggacagatgggtgagagaggaggtgacctggggcggcggccccaccgtgaccggcggctggggctggagagcccacctgagaagcgtgagcccccccggcgtgctgttcagcatcgaggtgatgagcagccacttcagcgtgtgggactactggagaggcttcttcgccgccacctgcggcgccttcatgttcagactgctggccgtgttcaacagcgagcaggagaccatcaccagcctgtacaagaccagcttcagagtggacgtgcccttcgacctgcccgagatcttcttcttcgtggccctgggcggcctgtgcggcatcctgggcagcgcctacctgttctgccagagaatcttcttcggcttcatcagaaacaacagattcagcagcaagctgctggccaccagcaagcccgtgtacagcgccctggccaccctggtgctggccagcatcacctacccccccagcgccggcagattcctggccagcagactgagcatgaagcagcacctggacagcctgttcgacaaccacagctgggccctgatgacccagaacagcagccccccctggcccgaggagctggacccccagcacctgtggtgggagtggtaccaccccagattcaccatcttcggcaccctggccttcttcctggtgatgaagttctggatgctgatcctggccaccaccatccccatgcccgccggctacttcatgcccatcttcgtgtacggcgccgccatcggcagactgttcggcgagaccctgagcttcatcttccccgagggcatcgtggccggcggcatcaccaaccccatcatgcccggcggctacgccctggccggcgccgccgccttcagcggcgccgtgacccacaccatcagcaccgccctgctggccttcgaggtgaccggccagatcgtgcacgccctgcccgtgctgatggccgtgctggccgccaacgccatcgcccagagctgccagcccagcttctacgacggcaccgtgatcgtgaagaagctgccctacctgcccagaatcctgggcagaaacatcggcagccacagagtgagagtggagcacttcatgaaccacagcatcaccaccctggccaaggacatgcccctggaggaggtggtgaaggtggtgaccagcaccgacgtggccaagtaccccctggtggagagcaccgagagccagatcctggtgggcatcgtgagaagagcccagctggtgcaggccctgaaggccgagccccccagctgggcccccggccaccagtgcctgcaggacatcctggccgccggctgccccaccgagcccgtgaccctgaagctgagccccgagaccagcctgcacgaggcccacaacctgttcgagctgctgaacctgcacagcctgttcgtgaccagcagaggcagagccgtgggctgcgtgagctgggtggagatgaagaaggccatcagcaacctgaccaacccccccgcccccaagtag

SEQ ID NO: 76578 - DNA, 468 bp, Artificial Sequence
  Description of Artificial Sequence: Synthetic coding sequence
atggccgtgctggccgccaacgccatcgcccagagctgccagcccagcttctacgacggcaccgtgatcgtgaagaagctgccctacctgcccagaatcctgggcagaaacatcggcagccacagagtgagagtggagcacttcatgaaccacagcatcaccaccctggccaaggacatgcccctggaggaggtggtgaaggtggtgaccagcaccgacgtggccaagtaccccctggtggagagcaccgagagccagatcctggtgggcatcgtgagaagagcccagctggtgcaggccctgaaggccgagccccccagctgggcccccggccaccagtgcctgcaggacatcctggccgccggctgccccaccgagcccgtgaccctgaagctgagccccgagaccagcctgcacgaggcccagatgcccagcggcgtggtgtggttccccgtgagaggcagctag

SEQ ID NO: 76579 - DNA, 2064 bp, Artificial Sequence
  Description of Artificial Sequence: Synthetic coding sequence
atggaggagttcgtgggcctgagagagggcagcagcggcaaccccgtgaccctgcaggagctgtggggcccctgccccagaatcagaagaggcatcagaggcggcctggagtggctgaagcagaagctgttcagactgggcgaggactggtacttcctgatgaccctgggcgtgctgatggccctggtgagctgcgccatggacctggccgtggagagcgtggtgagagcccaccagtggctgtacagagagatcggcgacagccacctgctgagatacctgagctggaccgtgtaccccgtggccctggtgagcttcagcagcggcttcagccagagcatcacccccagcagcggcggcagcggcatccccgaggtgaagaccatgctggccggcgtggtgctggaggactacctggacatcaagaacttcggcgccaaggtggtgggcctgagctgcaccctggcctgcggcagcaccctgttcctgggcaaggtgggccccttcgtgcacctgagcgtgatgatggccgcctacctgggcagagtgagaaccaccaccatcggcgagcccgagaacaagagcaagcagaacgagatgctggtggccgccgccgccgtgggcgtggccaccgtgttcgccgcccccttcagcggcgtgctgttcagcatcgaggtgatgagcagccacttcagcgtgtgggactactggagaggcttcttcgccgccacctgcggcgccttcatgttcagactgctggccgtgttcaacagcgagcaggagaccatcaccagcctgtacaagaccagcttcagagtggacgtgcccttcgacctgcccgagatcttcttcttcgtggccctgggcggcctgtgcggcatcctgggcagcgcctacctgttctgccagagaatcttcttcggcttcatcagaaacaacagattcagcagcaagctgctggccaccagcaagcccgtgtacagcgccctggccaccctggtgctggccagcatcacctacccccccagcgccggcagattcctggccagcagactgagcatgaagcagcacctggacagcctgttcgacaaccacagctgggccctgatgacccagaacagcagccccccctggcccgaggagctggacccccagcacctgtggtgggagtggtaccaccccagattcaccatcttcggcaccctggccttcttcctggtgatgaagttctggatgctgatcctggccaccaccatccccatgcccgccggctacttcatgcccatcttcgtgtacggcgccgccatcggcagactgttcggcgagaccctgagcttcatcttccccgagggcatcgtggccggcggcatcaccaaccccatcatgcccggcggctacgccctggccggcgccgccgccttcagcggcgccgtgacccacaccatcagcaccgccctgctggccttcgaggtgaccggccagatcgtgcacgccctgcccgtgctgatggccgtgctggccgccaacgccatcgcccagagctgccagcccagcttctacgacggcaccgtgatcgtgaagaagctgccctacctgcccagaatcctgggcagaaacatcggcagccacagagtgagagtggagcacttcatgaaccacagcatcaccaccctggccaaggacatgcccctggaggaggtggtgaaggtggtgaccagcaccgacgtggccaagtaccccctggtggagagcaccgagagccagatcctggtgggcatcgtgagaagagcccagctggtgcaggccctgaaggccgagccccccagctgggcccccggccaccagcagtgcctgcaggacatcctggccgccggctgccccaccgagcccgtgaccctgaagctgagccccgagaccagcctgcacgaggcccacaacctgttcgagctgctgaacctgcacagcctgttcgtgaccagcagaggcagagccgtgggctgcgtgagctgggtggagatgaagaaggccatcagcaacctgaccaacccccccgcccccaagtag

SEQ ID NO: 76580 - DNA, 441 bp, Artificial Sequence
  Description of Artificial Sequence: Synthetic coding sequence
gcccagagctgccagcccagcttctacgacggcaccgtgatcgtgaagaagctgccctacctgcccagaatcctgggcagaaacatcggcagccacagagtgagagtggagcacttcatgaaccacagcatcaccaccctggccaaggacatgcccctggaggaggtggtgaaggtggtgaccagcaccgacgtggccaagtaccccctggtggagagcaccgagagccagatcctggtgggcatcgtgagaagagcccagctggtgcaggccctgaaggccgagccccccagctgggcccccggccaccagtgcctgcaggacatcctggccgccggctgccccaccgagcccgtgaccctgaagctgagccccgagaccagcctgcacgaggcccagatgcccagcggcgtggtgtggttccccgtgagaggcagctag

SEQ ID NO: 76581 - DNA, 2646 bp, Artificial Sequence
  Description of Artificial Sequence: Synthetic coding sequence
atggccgccgccgccgccgaggagggcatggagcccagagccctgcagtacgagcagaccctgatgtacggcagatacacccaggacctgggcgccttcgccaaggaggaggccgccagaatcagactgggcggccccgagccctggaagggcccccccagcagcagagccgcccccgagctgctggagtacggcagaagcagatgcgccagatgcagagtgtgcagcgtgagatgccacaagttcctggtgagcagagtgggcgaggactggatcttcctggtgctgctgggcctgctgatggccctggtgagctgggtgatggactacgccatcgccgcctgcctgcaggcccagcagtggatgagcagaggcctgaacaccagcatcctgctgcagtacctggcctgggtgacctaccccgtggtgctgatcaccttcagcgccggcttcacccagatcctggccccccaggccgtgggcagcggcatccccgagatgaagaccatcctgagaggcgtggtgctgaaggagtacctgaccctgaagaccttcatcgccaaggtgatcggcctgacctgcgccctgggcagcggcatgcccctgggcaaggagggccccttcgtgcacatcgccagcatgtgcgccgccctgctgagcaagttcctgagcctgttcggcggcatctacgagaacgagagcagaaacaccgagatgctggccgccgcctgcgccgtgggcgtgggctgctgcttcgccgcccccatcggcggcgtgctgttcagcatcgaggtgaccagcaccttcttcgccgtgagaaactactggagaggcttcttcgccgccaccttcagcgccttcatcttcagagtgctggccgtgtggaacagagacgaggagaccatcaccgccctgttcaagaccagattcagactggacttccccttcgacctgcaggagctgcccgccttcgccgtgatcggcatcgccagcggcttcggcggcgccctgttcgtgtacctgaacagaaagatcgtgcaggtgatgagaaagcagaagaccatcaacagattcctgatgagaaagagactgctgttccccgccctggtgaccctgctgatcagcaccctgaccttcccccccggcttcggccagttcatggccggccagctgagccagaaggagaccctggtgaccctgttcgacaacagaacctgggtgagacagggcctggtggaggagctggagccccccagcaccagccaggcctggaacccccccagagccaacgtgttcctgaccctggtgatcttcatcctgatgaagttctggatgagcgccctggccaccaccatccccgtgccctgcggcgccttcatgcccgtgttcgtgatcgacggcatccacaccgacagcagcacctacagaatcgtgcccggcggctacgccgtggtgggcgccgccgccctggccggcgccgtgacccacaccgtgagcaccgccgtgatcgtgttcgagctgaccggccagatcgcccacatcctgcccgtgatgatcgccgtgatcctggccaacgccgtggcccagagcctgcagcccagcctgtacgacagcatcatcagaatcaagaagctgccctacctgcccgagctgggctggggcagacaccagcagtacagagtgagagtggaggacatcatggtgagagacgtgccccacgtggccctgagctgcaccttcagagacctgagactggccctgcacagaaccaagggcagaatgctggccctggtggagagccccgagagcatgatcctgctgggcagcatcgagagaagccaggtggtggccctgctgggcgcccagctgagccccgccagaagaagacagcacatgcaggagagaagagccacccagaccagccccctgagcgaccaggagggcccccccacccccgaggccagcgtgtgcttccaggtgaacaccgaggacagcgccttccccgccgccagaggcgagacccacaagcccctgaagcccgccctgaagagaggccccagcgtgaccagaaacctgggcgagagccccaccggcagcgccgagagcgccggcatcgccctgagaagcctgttctgcggcagccccccccccgaggccgccagcgagaagctggagagctgcgagaagagaaagctgaagagagtgagaatcagcctggccagcgacgccgacctggagggcgagatgagccccgaggagatcctggagtgggaggagcagcagctggacgagcccgtgaacttcagcgactgcaagatcgaccccgcccccttccagctggtggagagaaccagcctgcacaagacccacaccatcttcagcctgctgggcgtggaccacgcctacgtgaccagcatcggcagactgatcggcatcgtgaccctgaaggagctgagaaaggccatcgagggcagcgtgaccgcccagggcgtgaaggtgagaccccccctggccagcttcagagacagcgccaccagcagcagcgacaccgagaccaccgaggtgcacgccctgtggggcccccacagcagacacggcctgcccagagagggcagccccagcgacagcgacgacaagtgccagtag

SEQ ID NO: 76582 - DNA, 2565 bp, Artificial Sequence
  Description of Artificial Sequence: Synthetic coding sequence
atggccgccgccgccgccgaggagggcatggagcccagagccctgcagtacgagcagaccctgatgtacggcagatacacccaggacctgggcgccttcgccaaggaggaggccgccagaatcagactgggcggccccgagccctggaagggcccccccagcagcagagccgcccccgagctgctggagtacggcagaagcagatgcgccagatgcagagcccagcagtggatgagcagaggcctgaacaccagcatcctgctgcagtacctggcctgggtgacctaccccgtggtgctgatcaccttcagcgccggcttcacccagatcctggccccccaggccgtgggcagcggcatccccgagatgaagaccatcctgagaggcgtggtgctgaaggagtacctgaccctgaagaccttcatcgccaaggtgatcggcctgacctgcgccctgggcagcggcatgcccctgggcaaggagggccccttcgtgcacatcgccagcatgtgcgccgccctgctgagcaagttcctgagcctgttcggcggcatctacgagaacgagagcagaaacaccgagatgctggccgccgcctgcgccgtgggcgtgggctgctgcttcgccgcccccatcggcggcgtgctgttcagcatcgaggtgaccagcaccttcttcgccgtgagaaactactggagaggcttcttcgccgccaccttcagcgccttcatcttcagagtgctggccgtgtggaacagagacgaggagaccatcaccgccctgttcaagaccagattcagactggacttccccttcgacctgcaggagctgcccgccttcgccgtgatcggcatcgccagcggcttcggcggcgccctgttcgtgtacctgaacagaaagatcgtgcaggtgatgagaaagcagaagaccatcaacagattcctgatgagaaagagactgctgttccccgccctggtgaccctgctgatcagcaccctgaccttcccccccggcttcggccagttcatggccggccagctgagccagaaggagaccctggtgaccctgttcgacaacagaacctgggtgagacagggcctggtggaggagctggagccccccagcaccagccaggcctggaacccccccagagccaacgtgttcctgaccctggtgatcttcatcctgatgaagttctggatgagcgccctggccaccaccatccccgtgccctgcggcgccttcatgcccgtgttcgtgatcggcgccgccttcggcagactggtgggcgagagcatggccgcctggttccccgacggcatccacaccgacagcagcacctacagaatcgtgcccggcggctacgccgtggtgggcgccgccgccctggccggcgccgtgacccacaccgtgagcaccgccgtgatcgtgttcgagctgaccggccagatcgcccacatcctgcccgtgatgatcgccgtgatcctggccaacgccgtggcccagagcctgcagcccagcctgtacgacagcatcatcagaatcaagaagctgccctacctgcccgagctgggctggggcagacaccagcagtacagagtgagagtggaggacatcatggtgagagacgtgccccacgtggccctgagctgcaccttcagagacctgagactggccctgcacagaaccaagggcagaatgctggccctggtggagagccccgagagcatgatcctgctgggcagcatcgagagaagccaggtggtggccctgctgggcgcccagctgagccccgccagaagaagacagcacatgcaggagagaagagccacccagaccagccccctgagcgaccaggagggcccccccacccccgaggccagcgtgtgcttccaggtgaacaccgaggacagcgccttccccgccgccagaggcgagacccacaagcccctgaagcccgccctgaagagaggccccagcgtgaccagaaacctgggcgagagccccaccggcagcgccgagagcgccggcatcgccctgagaagcctgttctgcggcagccccccccccgaggccgccagcgagaagctggagagctgcgagaagagaaagctgaagagagtgagaatcagcctggccagcgacgccgacctggagggcgagatgagccccgaggagatcctggagtgggaggagcagcagctggacgagcccgtgaacttcagcgactgcaagatcgaccccgcccccttccagctggtggagagaaccagcctgcacaagacccacaccatcttcagcctgctgggcgtggaccacgcctacgtgaccagcatcggcagactgatcggcatcgtgaccctgaaggagctgagaaaggccatcgagggcagcgtgaccgcccagggcgtgaaggtgagaccccccctggccagcttcagagacagcgccaccagcagcagcgacaccgagaccaccgaggtgcacgccctgtggggcccccacagcagacacggcctgcccagagagggcagccccagcgacagcgacgacaagtgccagtag

SEQ ID NO: 76583 - DNA, 2610 bp, Artificial Sequence
  Description of Artificial Sequence: Synthetic coding sequence
atggccgccgccgccgccgaggagggcatggagcccagagccctgcagtacgagcagaccctgatgtacggcagatacacccaggacctgggcgccttcgccaaggaggaggccgccagaatcagactgggcggccccgagccctggaagggcccccccagcagcagagccgcccccgagctgctggagtacggcagaagcagatgcgccagatgcagagtgtgcagcgtgagatgccacaagttcctggtgagcagagtgggcgaggactggatcttcctggtgctgctgggcctgctgatggccctggtgagctgggtgatggactacgccatcgccgcctgcctgcaggcccagcagtggatgagcagaggcctgaacaccagcatcctgctgcagtacctggcctgggtgacctaccccgtggtgctgatcaccttcagcgccggcttcacccagatcctggccccccaggccgtgggcagcggcatccccgagatgaagaccatcctgagaggcgtggtgctgaaggagtacctgaccctgaagaccttcatcgccaaggtgatcggcctgacctgcgccctgggcagcggcatgcccctgggcaaggagggccccttcgtgcacatcgccagcatgtgcgccgccctgctgagcaagttcctgagcctgttcggcggcatctacgagaacgagagcagaaacaccgagatgctggccgccgcctgcgccgtgggcgtgggctgctgcttcgccgcccccatcggcggcgtgctgttcagcatcgaggtgaccagcaccttcttcgccgtgagaaactactggagaggcttcttcgccgccaccttcagcgccttcatcttcagagtgctggccgtgtggaacagagacgaggagaccatcaccgccctgttcaagaccagattcagactggacttccccttcgacctgcaggagctgcccgccttcgccgtgatcggcatcgccagcggcttcggcggcgccctgttcgtgtacctgaacagaaagatcgtgcaggtgatgagaaagcagaagaccatcaacagattcctgatgagaaagagactgctgttccccgccctggtgaccctgctgatcagcaccctgaccttcccccccggcttcggccagttcatggccggccagctgagccagaaggagaccctggtgaccctgttcgacaacagaacctgggtgagacagggcctggtggaggagctggagccccccagcaccagccaggcctggaacccccccagagccaacgtgttcctgaccctggtgatcttcatcctgatgaagttctggatgagcgccctggccaccaccatccccgtgccctgcggcgccttcatgcccgtgttcgtgatcggcgccgccttcggcagactggtgggcgagagcatggccgcctggttccccgacggcatccacaccgacagcagcacctacagaatcgtgcccggcggctacgccgtggtgggcgccgccgccctggccggcgccgtgacccacaccgtgagcaccgccgtgatcgtgttcgagctgaccggccagatcgcccacatcctgcccgtgatgatcgccgtgatcctggccaacgccgtggcccagagcctgcagcccagcctgtacgacagcatcatcagaatcaagaagctgccctacctgcccgagctgggctggggcagacaccagcagtacagagtgagagtggaggacatcatggtgagagacgtgccccacgtggccctgagctgcaccttcagagacctgagactggccctgcacagaaccaagggcagaatgctggccctggtggagagccccgagagcatgatcctgctgggcagcatcgagagaagccaggtggtggccctgctgggcgcccagctgagccccgccagaagaagacagcacatgcaggagagaagagccacccagaccagccccctgagcgaccaggagggcccccccacccccgaggccagcgtgtgcttccaggtgaacaccgaggacagcgccttccccgccgccagaggcgagacccacaagcccctgaagcccgccctgaagagaggccccagcgtgaccagaaacctgggcgagagccccaccggcagcgccgagagcgccggcatcgccctgagaagcctgttctgcggcagccccccccccgaggccgccagcgagaagctggagagctgcgagaagagaaagctgaagagagtgagaatcagcctggccagcgacgccgacctggagggcgagatgagccccgaggagatcctggagtgggaggagcagcagctggacgagcccgtgaacttcagcgactgcaagatcgaccccgcccccttccagctggtggagagaaccagcctgcacaagctgagaaaggccatcgagggcagcgtgaccgcccagggcgtgaaggtgagaccccccctggccagcttcagagacagcgccaccagcagcagcgacaccgagaccaccgaggtgcacgccctgtggggcccccacagcagacacggcctgcccagagagggcagccccagcgacagcgacgacaagtgccagtag

SEQ ID NO: 76584 - DNA, 714 bp, Artificial Sequence
  Description of Artificial Sequence: Synthetic coding sequence
atgagcttcctgaagagcttccccccccccggccccgccgagggcctgctgagacagcagcccgacaccgaggccgtgctgaacggcaagggcctgggcaccggcaccctgtacatcgccgagagcagactgagctggctggacggcagcggcctgggcttcagcctggagtaccccaccatcagcctgcacgccctgagcagagacagaagcgactgcctgggcgagcacctgtacgtgatggtgaacgccaagttcgaggaggagagcaaggagcccgtggccgacgaggaggaggaggacagcgacgacgacgtggagcccatcaccgagttcagattcgtgcccagcgacaagagcgccctggaggccatgttcaccgccatgtgcgagtgccaggccctgcaccccgaccccgaggacgaggacagcgacgactacgacggcgaggagtacgacgtggaggcccacgagcagggccagggcgacatccccaccttctacacctacgaggagggcctgagccacctgaccgccgagggccaggccaccctggagagactggagggcatgctgagccagagcgtgagcagccagtacaacatggccggcgtgagaaccgaggacagcatcagagactacgaggacggcatggaggtggacaccacccccaccgtggccggccagttcgaggacgccgacgtggaccactag

SEQ ID NO: 76585 - DNA, 714 bp, Artificial Sequence; identical to SEQ ID NO: 76584
  Description of Artificial Sequence: Synthetic coding sequence

SEQ ID NO: 76586 - DNA, 504 bp, Artificial Sequence
  Description of Artificial Sequence: Synthetic coding sequence
atggtgctgctgctgaagggcgtgcccttcaccctgaccaccgtggacaccagaagaagccccgacgtgctgaaggacttcgcccccggcagccagctgcccatcctgctgtacgacagcgacgccaagaccgacaccctgcagatcgaggacttcctggaggagaccctgggcccccccgacttccccagcctggcccccagatacagagagagcaacaccgccggcaacgacgtgttccacaagttcagcgccttcatcaagaaccccgtgcccgcccaggacgaggccctgtaccagcagctgctgagagccctggccagactggacagctacctgagagcccccctggagcacgagctggccggcgagccccagctgagagagagcagaagaagattcctggacggcgacagactgaccctggccgactgcagcctgctgcccaagctgcacatcgtggacaccgtgtgcgcccacttcagacaggcccccatcccctag

SEQ ID NO: 76587 - DNA, 711 bp, Artificial Sequence
  Description of Artificial Sequence: Synthetic coding sequence
atggccgagaccaagctgcagctgttcgtgaaggccagcgaggacggcgagagcgtgggccactgccccagctgccagagactgttcatggtgctgctgctgaagggcgtgcccttcaccctgaccaccgtggacaccagaagaagccccgacgtgctgaaggacttcgcccccggcagccagctgcccatcctgctgtacgacagcgacgccaagaccgacaccctgcagatcgaggacttcctggaggagaccctgggcccccccgacttccccagcctggcccccagatacagagagagcaacaccgccggcaacgacgtgttccacaagttcagcgccttcatcaagaaccccgtgcccgcccaggacgaggccctgtaccagcagctgctgagagccctggccagactggacagctacctgagagcccccctggagcacgagctggccggcgagccccagctgagagagagcagaagaagattcctggacggcgacagactgaccctggccgactgcagcctgctgcccaagctgcacatcgtggacaccgtgtgcgcccacttcagacaggcccccatccccgccgagctgagaggcgtgagaagatacctggacagcgccatgcaggagaaggagttcaagtacacctgcccccacagcgccgagatcctggccgcctacagacccgccgtgcaccccagatag

SEQ ID NO: 76588 - DNA, 348 bp, Artificial Sequence
  Description of Artificial Sequence: Synthetic coding sequence
atgaacagcggcgtgtgcctgtgcgtgctgatggccgtgctggccgccggcgccctgacccagcccgtgccccccgccgaccccgccggcagcggcctgcagagagccgaggaggcccccagaagacagctgagagtgagccagagaaccgacggcgagagcagagcccacctgggcgccctgctggccagatacatccagcaggccagaaaggcccccagcggcagaatgagcatcgtgaagaacctgcagaacctggaccccagccacagaatcagcgacagagactacatgggctggatggacttcggcagaagaagcgccgaggagtacgagtaccccagctag

SEQ ID NO: 76589 - DNA, 348 bp, Artificial Sequence; identical to SEQ ID NO: 76588
  Description of Artificial Sequence: Synthetic coding sequence

SEQ ID NO: 76590 - DNA, 348 bp, Artificial Sequence; identical to SEQ ID NO: 76588
  Description of Artificial Sequence: Synthetic coding sequence

SEQ ID NO: 76591 - DNA, 1287 bp, Artificial Sequence
  Description of Artificial Sequence: Synthetic coding sequence
atggacgtggtggacagcctgctggtgaacggcagcaacatcacccccccctgcgagctgggcctggagaacgagaccctgttctgcctggaccagcccagacccagcaaggagtggcagcccgccgtgcagatcctgctgtacagcctgatcttcctgctgagcgtgctgggcaacaccctggtgatcaccgtgctgatcagaaacaagagaatgagaaccgtgaccaacatcttcctgctgagcctggccgtgagcgacctgatgctgtgcctgttctgcatgcccttcaacctgatccccaacctgctgaaggacttcatcttcggcagcgccgtgtgcaagaccaccacctacttcatgggcaccagcgtgagcgtgagcaccttcaacctggtggccatcagcctggagagatacggcgccatctgcaagcccctgcagagcagagtgtggcagaccaagagccacgccctgaaggtgatcgccgccacctggtgcctgagcttcaccatcatgaccccctaccccatctacagcaacctggtgcccttcaccaagaacaacaaccagaccgccaacatgtgcagattcctgctgcccaacgacgtgatgcagcagagctggcacaccttcctgctgctgatcctgttcctgatccccggcatcgtgatgatggtggcctacggcctgatcagcctggagctgtaccagggcatcaagttcgaggccagccagaagaagagcgccaaggagagaaagcccagcaccaccagcagcggcaagtacgaggacagcgacggctgctacctgcagaagaccagaccccccagaaagctggagctgagacagctgagcaccggcagcagcagcagagccaacagaatcagaagcaacagcagcgccgccaacctgatggccaagaagagagtgatcagaatgctgatcgtgatcgtggtgctgttcttcctgtgctggatgcccatcttcagcgccaacgcctggagagcctacgacaccgccagcgccgagagaagactgagcggcacccccatcagcttcatcctgctgctgagctacaccagcagctgcgtgaaccccatcatctactgcttcatgaacaagagattcagactgggcttcatggccaccttcccctgctgccccaaccccggcccccccggcgccagaggcgaggtgggcgaggaggaggagggcggcaccaccggcgccagcctgagcagattcagctacagccacatgagcgccagcgtgcccccccagtag

SEQ ID NO: 76592 - DNA, 1344 bp, Artificial Sequence
  Description of Artificial Sequence: Synthetic coding sequence
atggagctgctgaagctgaacagaagcgtgcagggcaccggccccggccccggcgccagcctgtgcagacccggcgcccccctgctgaacagcagcagcgtgggcaacctgagctgcgagccccccagaatcagaggcgccggcaccagagagctggagctggccatcagaatcaccctgtacgccgtgatcttcctgatgagcgtgggcggcaacatgctgatcatcgtggtgctgggcctgagcagaagactgagaaccgtgaccaacgccttcctgctgagcctggccgtgagcgacctgctgctggccgtggcctgcatgcccttcaccctgctgcccaacctgatgggcaccttcatcttcggcaccgtgatctgcaaggccgtgagctacctgatgggcgtgagcgtgagcgtgagcaccctgagcctggtggccatcgccctggagagatacagcgccatctgcagacccctgcaggccagagtgtggcagaccagaagccacgccgccagagtgatcgtggccacctggctgctgagcggcctgctgatggtgccctaccccgtgtacaccgtggtgcagcccgtgggccccagagtgctgcagtgcgtgcacagatggcccagcgccagagtgagacagacctggagcgtgctgctgctgctgctgctgttcttcatccccggcgtggtgatggccgtggcctacggcctgatcagcagagagctgtacctgggcctgagattcgacggcgacagcgacagcgacagccagagcagagtgagaaaccagggcggcctgcccggcgccgtgcaccagaacggcagatgcagacccgagaccggcgccgtgggcgaggacagcgacggctgctacgtgcagctgcccagaagcagacccgccctggagctgaccgccctgaccgcccccggccccggcagcggcagcagacccacccaggccaagctgctggccaagaagagagtggtgagaatgctgctggtgatcgtggtgctgttcttcctgtgctggctgcccgtgtacagcgccaacacctggagagccttcgacggccccggcgcccacagagccctgagcggcgcccccatcagcttcatccacctgctgagctacgccagcgcctgcgtgaaccccctggtgtactgcttcatgcacagaagattcagacaggcctgcctggagacctgcgccagatgctgccccagaccccccagagccagacccagagccctgcccgacgaggacccccccacccccagcatcgccagcctgagcagactgagctacaccaccatcagcaccctgggccccggctag

SEQ ID NO: 76593 - DNA, 1551 bp, Artificial Sequence
  Description of Artificial Sequence: Synthetic coding sequence
atggagctgctgaagctgaacagaagcgtgcagggcaccggccccggccccggcgccagcctgtgcagacccggcgcccccctgctgaacagcagcagcgtgggcaacctgagctgcgagccccccagaatcagaggcgccggcaccagagagctggagctggccatcagaatcaccctgtacgccgtgatcttcctgatgagcgtgggcggcaacatgctgatcatcgtggtgctgggcctgagcagaagactgagaaccgtgaccaacgccttcctgctgagcctggccgtgagcgacctgctgctggccgtggcctgcatgcccttcaccctgctgcccaacctgatgggcaccttcatcttcggcaccgtgatctgcaaggccgtgagctacctgatgggcgtgagcgtgagcgtgagcaccctgagcctggtggccatcgccctggagagatacagcgccatctgcagacccctgcaggccagagtgtggcagaccagaagccacgccgccagagtgatcgtggccacctggctgctgagcggcctgctgatggtgccctaccccgtgtacaccgtggtgcagcccgtgggccccagagtgctgcagtgcgtgcacagatggcccagcgccagagtgagacagacctggagcgtgctgctgctgctgctgctgttcttcatccccggcgtggtgatggccgtggcctacggcctgatcagcagagagctgtacctgggcctgagattcgacggcgacagcgacagcgacagccagagcagagtgagaaaccagggcggcctgcccggcggcgccggccccagagagcagaacctgggcgaggccgagctgtggagagccaccggccccgccggcgtgggcggcaccgagatgaaggtgagagtgagaagaaagctggagatggagctgagctgggagagaagaagcggcggcgactgggccggcgactggggcgacagccccttcagcctgaccgcccaccccctgtgcagcggcgccgtgcaccagaacggcagatgcagacccgagaccggcgccgtgggcgaggacagcgacggctgctacgtgcagctgcccagaagcagacccgccctggagctgaccgccctgaccgcccccggccccggcagcggcagcagacccacccaggccaagctgctggccaagaagagagtggtgagaatgctgctggtgatcgtggtgctgttcttcctgtgctggctgcccgtgtacagcgccaacacctggagagccttcgacggccccggcgcccacagagccctgagcggcgcccccatcagcttcatccacctgctgagctacgccagcgcctgcgtgaaccccctggtgtactgcttcatgcacagaagattcagacaggcctgcctggagacctgcgccagatgctgccccagaccccccagagccagacccagagccctgcccgacgaggacccccccacccccagcatcgccagcctgagcagactgagctacaccaccatcagcaccctgggccccggctag

SEQ ID NO: 76594 - DNA, 819 bp, Artificial Sequence
  Description of Artificial Sequence: Synthetic coding sequence
atgagctgccacaactgcagcgacccccaggtgctgtgcagcagcggccagctgttcctgcagcccctgtgggaccacctgagaagctgggaggccctgctgcagagccccttcttccccgtgatcttcagcatcaccacctacgtgggcttctgcctgcccttcgtggtgctggacatcctgtgcagctgggtgcccgccctgagaagatacaagatccaccccgacttcagccccagcgcccagcagctgctgccctgcctgggccagaccctgtaccagcacgtgatgttcgtgttccccgtgaccctgctgcactgggccagaagccccgccctgctgccccacgaggcccccgagctgctgctgctgctgcaccacatcctgttctgcctgctgctgttcgacatggagttcttcgtgtggcacctgctgcaccacaaggtgccctggctgtacagaaccttccacaaggtgcaccaccagaacagcagcagcttcgccctggccacccagtacatgagcgtgtgggagctgttcagcctgggcttcttcgacatgatgaacgtgaccctgctgggctgccaccccctgaccaccctgaccttccacgtggtgaacatctggctgagcgtggaggaccacagcggctacaacttcccctggagcacccacagactggtgcccttcggctggtacggcggcgtggtgcaccacgacctgcaccacagccacttcaactgcaacttcgccccctacttcacccactgggacaagatcctgggcaccctgagaaccgccagcgtgcccgccagatag

SEQ ID NO: 76595 - DNA, 1482 bp, Artificial Sequence
  Description of Artificial Sequence: Synthetic coding sequence
atgctggccgccaccgtgctgaccctggccctgctgggcaacgcccacgcctgcagcaagggcaccagccacgaggccggcatcgtgtgcagaatcaccaagcccgccctgctggtgctgaaccacgagaccgccaaggtgatccagaccgccttccagagagccagctaccccgacatcaccggcgagaaggccatgatgctgctgggccaggtgaagtacggcctgcacaacatccagatcagccacctgagcatcgccagcagccaggtggagctggtggaggccaagagcatcgacgtgagcatccagaacgtgagcgtggtgttcaagggcaccctgaagtacggctacaccaccgcctggtggctgggcatcgaccagagcatcgacttcgagatcgacagcgccatcgacctgcagatcaacacccagctgacctgcgacagcggcagagtgagaaccgacgcccccgactgctacctgagcttccacaagctgctgctgcacctgcagggcgagagagagcccggctggatcaagcagctgttcaccaacttcatcagcttcaccctgaagctggtgctgaagggccagatctgcaaggagatcaacgtgatcagcaacatcatggccgacttcgtgcagaccagagccgccagcatcctgagcgacggcgacatcggcgtggacatcagcctgaccggcgaccccgtgatcaccgccagctacctggagagccaccacaagggccacttcatctacaagaacgtgagcgaggacctgcccctgcccaccttcagccccaccctgctgggcgacagcagaatgctgtacttctggttcagcgagagagtgttccacagcctggccaaggtggccttccaggacggcagactgatgctgagcctgatgggcgacgagttcaaggccgtgctggagacctggggcttcaacaccaaccaggagatcttccaggaggtggtgggcggcttccccagccaggcccaggtgaccgtgcactgcctgaagatgcccaagatcagctgccagaacaagggcgtggtggtgaacagcagcgtgatggtgaagttcctgttccccagacccgaccagcagcacagcgtggcctacaccttcgaggaggacatcgtgaccaccgtgcaggccagctacagcaagaagaagctgttcctgagcctgctggacttccagatcacccccaagaccgtgagcaacctgaccgagagcagcagcgagagcgtgcagagcttcctgcagagcatgatcaccgccgtgggcatccccgaggtgatgagcagactggaggtggtgttcaccgccctgatgaacagcaagggcgtgagcctgttcgacatcatcaaccccgagatcatcaccagagacggcttcctgctgctgcagatggacttcggcttccccgagcacctgctggtggacttcctgcagagcctgagctag

SEQ ID NO: 76596 - DNA, 1302 bp, Artificial Sequence
  Description of Artificial Sequence: Synthetic coding sequence
atgctggccgccaccgtgctgaccctggccctgctgggcaacgcccacgcctgcagcaagggcaccagccacgaggccggcatcgtgtgcagaatcaccaagcccgccctgctggtgctgaaccacgagaccgccaaggtgatccagaccgccttccagagagccagctaccccgacatcaccggcgagaaggccatgatgctgctgggccaggtgaagtacggcctgcacaacatccagatcagccacctgagcatcgccagcagccaggtggagctggtggaggccaagagcatcgacgtgagcatccagaacgtgagcgtggtgttcaagggcaccctgaagtacggctacaccaccgcctggtggctgggcatcgaccagagcatcgacttcgagatcgacagcgccatcgacctgcagatcaacacccagctgacctgcgacagcggcagagtgagaaccgacgcccccgactgctacctgagcttccacaagctgctgctgcacctgcagggcgagagagagcccggctggatcaagcagctgttcaccaacttcatcagcttcaccctgaagctggtgctgaagggccagatctgcaaggagatcaacgtgatcagcaacatcatggccgacttcgtgcagaccagagccgccagcatcctgagcgacggcgacatcggcgtggacatcagcctgaccggcgaccccgtgatcaccgccagctacctggagagccaccacaaggccgtgctggagacctggggcttcaacaccaaccaggagatcttccaggaggtggtgggcggcttccccagccaggcccaggtgaccgtgcactgcctgaagatgcccaagatcagctgccagaacaagggcgtggtggtgaacagcagcgtgatggtgaagttcctgttccccagacccgaccagcagcacagcgtggcctacaccttcgaggaggacatcgtgaccaccgtgcaggccagctacagcaagaagaagctgttcctgagcctgctggacttccagatcacccccaagaccgtgagcaacctgaccgagagcagcagcgagagcgtgcagagcttcctgcagagcatgatcaccgccgtgggcatccccgaggtgatgagcagactggaggtggtgttcaccgccctgatgaacagcaagggcgtgagcctgttcgacatcatcaaccccgagatcatcaccagagacggcttcctgctgctgcagatggacttcggcttccccgagcacctgctggtggacttcctgcagagcctgagctag

SEQ ID NO: 76597 - DNA, 1374 bp, Artificial Sequence
  Description of Artificial Sequence: Synthetic coding sequence
atgaagaccaagttctgcaccggcggcgaggccgagcccagccccctgggcctgctgctgagctgcggcagcggcagcgccgcccccgcccccggcgtgggccagcagagagacgccgccagcgacctggagagcaagcagctgggcggccagcagccccccctggccctgcccccccccccccccctgcccctgcccctgcccctgccccagcccccccccccccagccccccgccgacgagcagcccgagcccagaaccagaagaagagcctacctgtggtgcaaggagttcctgcccggcgcctggagaggcctgagagaggacgagttccacatcagcgtgatcagaggcggcctgagcaacatgctgttccagtgcagcctgcccgacaccaccgccaccctgggcgacgagcccagaaaggtgctgctgagactgtacggcgccatcctgcagatgagaagctgcaacaaggagggcagcgagcaggcccagaaggagaacgagttccagggcgccgaggccatggtgctggagagcgtgatgttcgccatcctggccgagagaagcctgggccccaagctgtacggcatcttcccccagggcagactggagcagttcatccccagcagaagactggacaccgaggagctgagcctgcccgacatcagcgccgagatcgccgagaagatggccaccttccacggcatgaagatgcccttcaacaaggagcccaagtggctgttcggcaccatggagaagtacctgaaggaggtgctgagaatcaagttcaccgaggagagcagaatcaagaagctgcacaagctgctgagctacaacctgcccctggagctggagaacctgagaagcctgctggagagcacccccagccccgtggtgttctgccacaacgactgccaggagggcaacatcctgctgctggagggcagagagaacagcgagaagcagaagctgatgctgatcgacttcgagtacagcagctacaactacagaggcttcgacatcggcaaccacttctgcgagtggatgtacgactacagctacgagaagtaccccttcttcagagccaacatcagaaagtaccccaccaagaagcagcagctgcacttcatcagcagctacctgcccgccttccagaacgacttcgagaacctgagcaccgaggagaagagcatcatcaaggaggagatgctgctggaggtgaacagattcgccctggccagccacttcctgtggggcctgtggagcatcgtgcaggccaagatcagcagcatcgagttcggctacatggactacgcccaggccagattcgacgcctacttccaccagaagagaaagctgggcgtgtag

SEQ ID NO: 76598 - DNA, 1320 bp, Artificial Sequence
  Description of Artificial Sequence: Synthetic coding sequence
atgaagaccaagttctgcaccggcggcgaggccgagcccagccccctgggcctgctgctgagctgcggcagcggcagcgccgcccccgcccccggcgtgggccagcagagagacgccgccagcgacctggagagcaagcagctgggcggccagcagccccccctggccctgcccccccccccccccctgcccctgcccctgcccctgccccagcccccccccccccagccccccgccgacgagcagcccgagcccagaaccagaagaagagcctacctgtggtgcaaggagttcctgcccggcgcctggagaggcctgagagaggacgagttccacatcagcgtgatcagaggcggcctgagcaacatgctgttccagtgcagcctgcccgacaccaccgccaccctgggcgacgagcccagaaaggtgctgctgagactgtacggcgccatcctgcagatgggcgccgaggccatggtgctggagagcgtgatgttcgccatcctggccgagagaagcctgggccccaagctgtacggcatcttcccccagggcagactggagcagttcatccccagcagaagactggacaccgaggagctgagcctgcccgacatcagcgccgagatcgccgagaagatggccaccttccacggcatgaagatgcccttcaacaaggagcccaagtggctgttcggcaccatggagaagtacctgaaggaggtgctgagaatcaagttcaccgaggagagcagaatcaagaagctgcacaagctgctgagctacaacctgcccctggagctggagaacctgagaagcctgctggagagcacccccagccccgtggtgttctgccacaacgactgccaggagggcaacatcctgctgctggagggcagagagaacagcgagaagcagaagctgatgctgatcgacttcgagtacagcagctacaactacagaggcttcgacatcggcaaccacttctgcgagtggatgtacgactacagctacgagaagtaccccttcttcagagccaacatcagaaagtaccccaccaagaagcagcagctgcacttcatcagcagctacctgcccgccttccagaacgacttcgagaacctgagcaccgaggagaagagcatcatcaaggaggagatgctgctggaggtgaacagattcgccctggccagccacttcctgtggggcctgtggagcatcgtgcaggccaagatcagcagcatcgagttcggctacatggactacgcccaggccagattcgacgcctacttccaccagaagagaaagctgggcgtgtag

SEQ ID NO: 76599 - DNA, 1188 bp, Artificial Sequence
  Description of Artificial Sequence: Synthetic coding sequence
atggccgccgaggccaccgccgtggccggcagcggcgccgtgggcggctgcctggccaaggacggcctgcagcagagcaagtgccccgacaccacccccaagagaagaagagccagcagcctgagcagagacgccgagagaagagcctaccagtggtgcagagagtacctgggcggcgcctggagaagagtgcagcccgaggagctgagagtgtaccccgtgagcggcggcctgagcaacctgctgttcagatgcagcctgcccgaccacctgcccagcgtgggcgaggagcccagagaggtgctgctgagactgtacggcgccatcctgcagggcgtggacagcctggtgctggagagcgtgatgttcgccatcctggccgagagaagcctgggcccccagctgtacggcgtgttccccgagggcagactggagcagtacatccccagcagacccctgaagacccaggagctgagagagcccgtgctgagcgccgccatcgccaccaagatggcccagttccacggcatggagatgcccttcaccaaggagccccactggctgttcggcaccatggagagatacctgaagcagatccaggacctgccccccaccggcctgcccgagatgaacctgctggagatgtacagcctgaaggacgagatgggcaacctgagaaagctgctggagagcacccccagccccgtggtgttctgccacaacgacatccaggagggcaacatcctgctgctgagcgagcccgagaacgccgacagcctgatgctggtggacttcgagtacagcagctacaactacagaggcttcgacatcggcaaccacttctgcgagtgggtgtacgactacacccacgaggagtggcccttctacaaggccagacccaccgactaccccacccaggagcagcagctgcacttcatcagacactacctggccgaggccaagaagggcgagaccctgagccaggaggagcagagaaagctggaggaggacctgctggtggaggtgagcagatacgccctggccagccacttcttctggggcctgtggagcatcctgcaggccagcatgagcaccatcgagttcggctacctggactacgcccagagcagattccagttctacttccagcagaagggccagctgaccagcgtgcacagcagcagctag

SEQ ID NO: 76600 - DNA, 2247 bp, Artificial Sequence
  Description of Artificial Sequence: Synthetic coding sequence
atgggcctgagaaccgccaagaagagaggcctgggcggcggcggcaagtggaagagagaggagggcggcggcaccagaggcagaagagaggtgagacccgcctgcttcctgcagagcggcggcagaggcgaccccggcgacgtgggcggccccgccggcaaccccggctgcagcccccaccccagagccgccaccagacccccccccctgcccgcccacacccccgcccacacccccgagtggtgcggcgccgccagcgccgaggccgccgagcccagaagagccggcccccacctgtgcatccccgcccccggcctgaccaagacccccatcctggagaaggtgcccagaaagatggccgccaagacccccagcagcgaggagagcggcctgcccaagctgcccgtgccccccctgcagcagaccctggccacctacctgcagtgcatgagacacctggtgagcgaggagcagttcagaaagagccaggccatcgtgcagcagttcggcgcccccggcggcctgggcgagaccctgcagcagaagctgctggagagacaggagaagaccgccaactgggtgagcgagtactggctgaacgacatgtacctgaacaacagactggccctgcccgtgaacagcagccccgccgtgatcttcgccagacagcacttccccggcaccgacgaccagctgagattcgccgccagcctgatcagcggcgtgctgagctacaaggccctgctggacagccacagcatccccaccgactgcgccaagggccagctgagcggccagcccctgtgcatgaagcagtactacggcctgttcagcagctacagactgcccggccacacccaggacaccctggtggcccagaacagcagcatcatgcccgagcccgagcacgtgatcgtggcctgctgcaaccagttcttcgtgctggacgtggtgatcaacttcagaagactgagcgagggcgacctgttcacccagctgagaaagatcgtgaagatggccagcaacgaggacgagagactgccccccatcggcctgctgaccagcgacggcagaagcgagtgggccgaggccagaaccgtgctggtgaaggacagcaccaacagagacagcctggacatgatcgagagatgcatctgcctggtgtgcctggacgcccccggcggcgtggagctgagcgacacccacagagccctgcagctgctgcacggcggcggctacagcaagaacggcgccaacagatggtacgacaagagcctgcagttcgtggtgggcagagacggcacctgcggcgtggtgtgcgagcacagccccttcgacggcatcgtgctggtgcagtgcaccgagcacctgctgaagcacgtgacccagagcagcagaaagctgatcagagccgacagcgtgagcgagctgcccgcccccagaagactgagatggaagtgcagccccgagatccagggccacctggccagcagcgccgagaagctgcagagaatcgtgaagaacctggacttcatcgtgtacaagttcgacaactacggcaagaccttcatcaagaagcagaagtgcagccccgacgccttcatccaggtggccctgcagctggccttctacagactgcacagaagactggtgcccacctacgagagcgccagcatcagaagattccaggagggcagagtggacaacatcagaagcgccacccccgaggccctggccttcgtgagagccgtgaccgaccacaaggccgccgtgcccgccagcgagaagctgctgctgctgaaggacgccatcagagcccagaccgcctacaccgtgatggccatcaccggcatggccatcgacaaccacctgctggccctgagagagctggccagagccatgtgcaaggagctgcccgagatgttcatggacgagacctacctgatgagcaacagattcgtgctgagcaccagccaggtgcccaccaccaccgagatgttctgctgctacggccccgtggtgcccaacggctacggcgcctgctacaacccccagcccgagaccatcctgttctgcatcagcagcttccacagctgcaaggagaccagcagcagcaagttcgccaaggccgtggaggagagcctgatcgacatgagagacctgtgcagcctgctgccccccaccgagagcaagcccctggccaccaaggagaaggccaccagacccagccagggccaccagccctag

SEQ ID NO: 76601 - DNA, 1893 bp, Artificial Sequence
  Description of Artificial Sequence: Synthetic coding sequence
atggccgccaagacccccagcagcgaggagagcggcctgcccaagctgcccgtgccccccctgcagcagaccctggccacctacctgcagtgcatgagacacctggtgagcgaggagcagttcagaaagagccaggccatcgtgcagcagttcggcgcccccggcggcctgggcgagaccctgcagcagaagctgctggagagacaggagaagaccgccaactgggtgagcgagtactggctgaacgacatgtacctgaacaacagactggccctgcccgtgaacagcagccccgccgtgatcttcgccagacagcacttccccggcaccgacgaccagctgagattcgccgccagcctgatcagcggcgtgctgagctacaaggccctgctggacagccacagcatccccaccgactgcgccaagggccagctgagcggccagcccctgtgcatgaagcagtactacggcctgttcagcagctacagactgcccggccacacccaggacaccctggtggcccagaacagcagcatcatgcccgagcccgagcacgtgatcgtggcctgctgcaaccagttcttcgtgctggacgtggtgatcaacttcagaagactgagcgagggcgacctgttcacccagctgagaaagatcgtgaagatggccagcaacgaggacgagagactgccccccatcggcctgctgaccagcgacggcagaagcgagtgggccgaggccagaaccgtgctggtgaaggacagcaccaacagagacagcctggacatgatcgagagatgcatctgcctggtgtgcctggacgcccccggcggcgtggagctgagcgacacccacagagccctgcagctgctgcacggcggcggctacagcaagaacggcgccaacagatggtacgacaagagcctgcagttcgtggtgggcagagacggcacctgcggcgtggtgtgcgagcacagccccttcgacggcatcgtgctggtgcagtgcaccgagcacctgctgaagcacgtgacccagagcagcagaaagctgatcagagccgacagcgtgagcgagctgcccgcccccagaagactgagatggaagtgcagccccgagatccagggccacctggccagcagcgccgagaagctgcagagaatcgtgaagaacctggacttcatcgtgtacaagttcgacaactacggcaagaccttcatcaagaagcagaagtgcagccccgacgccttcatccaggtggccctgcagctggccttctacagactgcacagaagactggtgcccacctacgagagcgccagcatcagaagattccaggagggcagagtggacaacatcagaagcgccacccccgaggccctggccttcgtgagagccgtgaccgaccacaaggccgccgtgcccgccagcgagaagctgctgctgctgaaggacgccatcagagcccagaccgcctacaccgtgatggccatcaccggcatggccatcgacaaccacctgctggccctgagagagctggccagagccatgtgcaaggagctgcccgagatgttcatggacgagacctacctgatgagcaacagattcgtgctgagcaccagccaggtgcccaccaccaccgagatgttctgctgctacggccccgtggtgcccaacggctacggcgcctgctacaacccccagcccgagaccatcctgttctgcatcagcagcttccacagctgcaaggagaccagcagcagcaagttcgccaaggccgtggaggagagcctgatcgacatgagagacctgtgcagcctgctgccccccaccgagagcaagcccctggccaccaaggagaaggccaccagacccagccagggccaccagccctag

SEQ ID NO: 76602 - DNA, 1893 bp, Artificial Sequence; identical to SEQ ID NO: 76601
  Description of Artificial Sequence: Synthetic coding sequence

SEQ ID NO: 76603 - DNA, 1893 bp, Artificial Sequence; identical to SEQ ID NO: 76601
  Description of Artificial Sequence: Synthetic coding sequence

SEQ ID NO: 76604 - DNA, 2001 bp, Artificial Sequence
  Description of Artificial Sequence: Synthetic coding sequence
atgtggcccgagtgcagagacgaggccctgagcaccgtgggcccccacctgtgcatccccgcccccggcctgaccaagacccccatcctggagaaggtgcccagaaagatggccgccaagacccccagcagcgaggagagcggcctgcccaagctgcccgtgccccccctgcagcagaccctggccacctacctgcagtgcatgagacacctggtgagcgaggagcagttcagaaagagccaggccatcgtgcagcagttcggcgcccccggcggcctgggcgagaccctgcagcagaagctgctggagagacaggagaagaccgccaactgggtgagcgagtactggctgaacgacatgtacctgaacaacagactggccctgcccgtgaacagcagccccgccgtgatcttcgccagacagcacttccccggcaccgacgaccagctgagattcgccgccagcctgatcagcggcgtgctgagctacaaggccctgctggacagccacagcatccccaccgactgcgccaagggccagctgagcggccagcccctgtgcatgaagcagtactacggcctgttcagcagctacagactgcccggccacacccaggacaccctggtggcccagaacagcagcatcatgcccgagcccgagcacgtgatcgtggcctgctgcaaccagttcttcgtgctggacgtggtgatcaacttcagaagactgagcgagggcgacctgttcacccagctgagaaagatcgtgaagatggccagcaacgaggacgagagactgccccccatcggcctgctgaccagcgacggcagaagcgagtgggccgaggccagaaccgtgctggtgaaggacagcaccaacagagacagcctggacatgatcgagagatgcatctgcctggtgtgcctggacgcccccggcggcgtggagctgagcgacacccacagagccctgcagctgctgcacggcggcggctacagcaagaacggcgccaacagatggtacgacaagagcctgcagttcgtggtgggcagagacggcacctgcggcgtggtgtgcgagcacagccccttcgacggcatcgtgctggtgcagtgcaccgagcacctgctgaagcacgtgacccagagcagcagaaagctgatcagagccgacagcgtgagcgagctgcccgcccccagaagactgagatggaagtgcagccccgagatccagggccacctggccagcagcgccgagaagctgcagagaatcgtgaagaacctggacttcatcgtgtacaagttcgacaactacggcaagaccttcatcaagaagcagaagtgcagccccgacgccttcatccaggtggccctgcagctggccttctacagactgcacagaagactggtgcccacctacgagagcgccagcatcagaagattccaggagggcagagtggacaacatcagaagcgccacccccgaggccctggccttcgtgagagccgtgaccgaccacaaggccgccgtgcccgccagcgagaagctgctgctgctgaaggacgccatcagagcccagaccgcctacaccgtgatggccatcaccggcatggccatcgacaaccacctgctggccctgagagagctggccagagccatgtgcaaggagctgcccgagatgttcatggacgagacctacctgatgagcaacagattcgtgctgagcaccagccaggtgcccaccaccaccgagatgttctgctgctacggccccgtggtgcccaacggctacggcgcctgctacaacccccagcccgagaccatcctgttctgcatcagcagcttccacagctgcaaggagaccagcagcagcaagttcgccaaggccgtggaggagagcctgatcgacatgagagacctgtgcagcctgctgccccccaccgagagcaagcccctggccaccaaggagaaggccaccagacccagccagggccaccagccctag

SEQ ID NO: 76605 - DNA, 1638 bp, Artificial Sequence
  Description of Artificial Sequence: Synthetic coding sequence
atggccgccaagacccccagcagcgaggagagcggcctgcccaagctgcccgtgccccccctgcagcagaccctggccacctacctgcagtgcatgagacacctggtgagcgaggagcagttcagaaagagccaggccatcgtgcagcagttcggcgcccccggcggcctgggcgagaccctgcagcagaagctgctggagagacaggagaagaccgccaactgggtgagcgagtactggctgaacgacatgtacctgaacaacagactggccctgcccgtgaacagcagccccgccgtgatcttcgccagacagcacttccccggcaccgacgaccagctgagattcgccgccagcctgatcagcggcgtgctgagctacaaggccctgctggacagccacagcatccccaccgactgcgccaagggccagctgagcggccagcccctgtgcatgaagcagtactacggcctgttcagcagctacagactgcccggccacacccaggacaccctggtggcccagaacagcagcatcatgcccgagcccgagcacgtgatcgtggcctgctgcaaccagttcttcgtgctggacgtggtgatcaacttcagaagactgagcgagggcgacctgttcacccagctgagaaagatcgtgaagatggccagcaacgaggacgagagactgccccccatcggcctgctgaccagcgacggcagaagcgagtgggccgaggccagaaccgtgctggtgaaggacagcaccaacagagacagcctggacatgatcgagagatgcatctgcctggtgtgcctggacgcccccggcggcgtggagctgagcgacacccacagagccctgcagctgctgcacggcggcggctacagcaagaacggcgccaacagatggtacgacaagagcctgcagttcgtggtgggcagagacggcacctgcggcgtggtgtgcgagcacagccccttcgacggcatcgtgctggtgcagtgcaccgagcacctgctgaagcacgtgacccagagcagcagaaagctgatcagagccgacagcgtgagcgagctgcccgcccccagaagactgagatggaagtgcagccccgagatccagggccacctggccagcagcgccgagaagctgcagagaatcgtgaagaacctggacttcatcgtgtacaagttcgacaactacggcaagaccttcatcaagaagcagaagtgcagccccgacgccttcatccaggtggccctgcagctggccttctacagactgcacagaagactggtgcccacctacgagagcgccagcatcagaagattccaggagggcagagtggacaacatcagaagcgccacccccgaggccctggccttcgtgagagccgtgaccgaccacaaggccgccgtgcccgccagcgagaagctgctgctgctgaaggacgccatcagagcccagaccgcctacaccgtgatggccatcaccggcatggccatcgacaaccacctgctggccctgagagagctggccagagccatgtgcaaggagctgcccgagatgttcatggacgagacctacctgatgagcaacagattcgtgctgagcaccagccagctgtgctggccctag

SEQ ID NO: 76606 - DNA, 1383 bp, Artificial Sequence
  Description of Artificial Sequence: Synthetic coding sequence
atgaacaccagcgccccccccgccgtgagccccaacatcaccgtgctggcccccggcaagggcccctggcaggtggccttcatcggcatcaccaccggcctgctgagcctggccaccgtgaccggcaacctgctggtgctgatcagcttcaaggtgaacaccgagctgaagaccgtgaacaactacttcctgctgagcctggcctgcgccgacctgatcatcggcaccttcagcatgaacctgtacaccacctacctgctgatgggccactgggccctgggcaccctggcctgcgacctgtggctggccctggactacgtggccagcaacgccagcgtgatgaacctgctgctgatcagcttcgacagatacttcagcgtgaccagacccctgagctacagagccaagagaacccccagaagagccgccctgatgatcggcctggcctggctggtgagcttcgtgctgtgggcccccgccatcctgttctggcagtacctggtgggcgagagaaccgtgctggccggccagtgctacatccagttcctgagccagcccatcatcaccttcggcaccgccatggccgccttctacctgcccgtgaccgtgatgtgcaccctgtactggagaatctacagagagaccgagaacagagccagagagctggccgccctgcagggcagcgagacccccggcaagggcggcggcagcagcagcagcagcgagagaagccagcccggcgccgagggcagccccgagaccccccccggcagatgctgcagatgctgcagagcccccagactgctgcaggcctacagctggaaggaggaggaggaggaggacgagggcagcatggagagcctgaccagcagcgagggcgaggagcccggcagcgaggtggtgatcaagatgcccatggtggaccccgaggcccaggcccccaccaagcagccccccagaagcagccccaacaccgtgaagagacccaccaagaagggcagagacagagccggcaagggccagaagcccagaggcaaggagcagctggccaagagaaagaccttcagcctggtgaaggagaagaaggccgccagaaccctgagcgccatcctgctggccttcatcctgacctggaccccctacaacatcatggtgctggtgagcaccttctgcaaggactgcgtgcccgagaccctgtgggagctgggctactggctgtgctacgtgaacagcaccatcaaccccatgtgctacgccctgtgcaacaaggccttcagagacaccttcagactgctgctgctgtgcagatgggacaagagaagatggagaaagatccccaagagacccggcagcgtgcacagaacccccagcagacagtgctag

SEQ ID NO: 76607 - DNA, 405 bp, Artificial Sequence
  Description of Artificial Sequence: Synthetic coding sequence
atgaacaccagcgccccccccgccgtgagccccaacatcaccgtgctggcccccggcaagggcccctggcaggtggccttcatcggcatcaccaccggcctgctgagcctggccaccgtgaccggcaacctgctggtgctgatcagcttcaaggtgaacaccgagctgaagaccgtgaacaactacttcctgctgagcctggcctgcgccgacctgatcatcggcaccttcagcatgaacctgtacaccacctacctgctgatgggccactgggccctgggcaccctggcctgcgacctgtggctggccctggactacgtggccagcaacgccagcgtgatgaacctgctgctgatcagcttcgacagatacttcagcgtgaccagacccctgagctacagatag

SEQ ID NO: 76608 - DNA, 1365 bp, Artificial Sequence
  Description of Artificial Sequence: Synthetic coding sequence
atgaacaccagcgccccccccgccgtgagccccaacatcaccgtgctggcccccggcaagggcccctggcaggtggccttcatcggcatcaccaccggcctgctgagcctggccaccgtgaccggcaacctgctggtgctgatcagcttcaaggtgaacaccgagctgaagaccgtgaacaactacttcctgctgagcctggcctgcgccgacctgatcatcggcaccttcagcatgaacctgtacaccacctacctgctgatgggccactgggccctgggcaccctggcctgcgacctgtggctggccctggactacgtggccagcaacgccagcgtgatgaacctgctgctgatcagcttcgacagatacttcagcgtgaccagacccctgagctacagagccaagagaacccccagaagagccgccctgatgatcggcctggcctggctggtgagcttcgtgctgtgggcccccgccatcctgttctggcagtacctggtgggcgagagaaccgtgctggccggccagtgctacatccagttcctgagccagcccatcatcaccttcggcaccgccatggccgccttctacctgcccgtgaccgtgatgtgcaccctgtactggagaatctacagagagaccgagaacagagccagagagctggccgccctgcagggcagcgagacccccggcaagggcggcggcagcagcagcagcagcgagagaagccagcccggcgccgagggcagccccgagaccccccccggcagatgctgcagatgctgcagagcccccagactgctgcaggcctacagctggaaggaggaggaggaggaggacgagggcagcatggagagcctgaccagcagcgagggcgaggagcccggcagcgaggtggtgatcaagatgcccatggtggaccccgaggcccaggcccccaccaagcagccccccagaagcagccccaacaccgtgaagagacccaccaagaagggcagagacagagccggcaagggccagaagcccagaggcaaggagcagctggccaagagaaagaccttcagcctggtgaaggagaagaaggccgccagaaccctgagcgccatcctgctggccttcatcctgacctggaccccctacaacatcatggtgctggtgagcaccttctgcaaggactgcgtgcccgagaccctgtgggagctgggctactggctgtgctacgtgaacagcaccatcaaccccatgtgctacgccctgtgcaacaaggccttcagagacaccttcagactgctgctgctgtgcagatgggacaagagaagatggagaaagatccccaagagacccggcagcgtgcacagatag

SEQ ID NO: 76609 - DNA, 1401 bp, Artificial Sequence
  Description of Artificial Sequence: Synthetic coding sequence
atgaacaacagcaccaacagcagcaacaacagcctggccctgaccagcccctacaagaccttcgaggtggtgttcatcgtgctggtggccggcagcctgagcctggtgaccatcatcggcaacatcctggtgatggtgagcatcaaggtgaacagacacctgcagaccgtgaacaactacttcctgttcagcctggcctgcgccgacctgatcatcggcgtgttcagcatgaacctgtacaccctgtacaccgtgatcggctactggcccctgggccccgtggtgtgcgacctgtggctggccctggactacgtggtgagcaacgccagcgtgatgaacctgctgatcatcagcttcgacagatacttctgcgtgaccaagcccctgacctaccccgtgaagagaaccaccaagatggccggcatgatgatcgccgccgcctgggtgctgagcttcatcctgtgggcccccgccatcctgttctggcagttcatcgtgggcgtgagaaccgtggaggacggcgagtgctacatccagttcttcagcaacgccgccgtgaccttcggcaccgccatcgccgccttctacctgcccgtgatcatcatgaccgtgctgtactggcacatcagcagagccagcaagagcagaatcaagaaggacaagaaggagcccgtggccaaccaggaccccgtgagccccagcctggtgcagggcagaatcgtgaagcccaacaacaacaacatgcccagcagcgacgacggcctggagcacaacaagatccagaacggcaaggcccccagagaccccgtgaccgagaactgcgtgcagggcgaggagaaggagagcagcaacgacagcaccagcgtgagcgccgtggccagcaacatgagagacgacgagatcacccaggacgagaacaccgtgagcaccagcctgggccacagcaaggacgagaacagcaagcagacctgcatcagaatcggcaccaagacccccaagagcgacagctgcacccccaccaacaccaccgtggaggtggtgggcagcagcggccagaacggcgacgagaagcagaacatcgtggccagaaagatcgtgaagatgaccaagcagcccgccaagaagaagcccccccccagcagagagaagaaggtgaccagaaccatcctggccatcctgctggccttcatcatcacctgggccccctacaacgtgatggtgctgatcaacaccttctgcgccccctgcatccccaacaccgtgtggaccatcggctactggctgtgctacatcaacagcaccatcaaccccgcctgctacgccctgtgcaacgccaccttcaagaagaccttcaagcacctgctgatgtgccactacaagaacatcggcgccaccagatag

SEQ ID NO: 76610 - DNA, 1401 bp, Artificial Sequence; identical to SEQ ID NO: 76609
  Description of Artificial Sequence: Synthetic coding sequence

SEQ ID NO: 76611 - DNA, 1401 bp, Artificial Sequence; identical to SEQ ID NO: 76609
  Description of Artificial Sequence: Synthetic coding sequence

SEQ ID NO: 76612 - DNA, 1401 bp, Artificial Sequence; identical to SEQ ID NO: 76609
  Description of Artificial Sequence: Synthetic coding sequence

SEQ ID NO: 76613 - DNA, 1401 bp, Artificial Sequence; identical to SEQ ID NO: 76609
  Description of Artificial Sequence: Synthetic coding sequence

SEQ ID NO: 76614 - DNA, 1401 bp, Artificial Sequence; identical to SEQ ID NO: 76609
  Description of Artificial Sequence: Synthetic coding sequence

SEQ ID NO: 76615 - DNA, 1773 bp, Artificial Sequence
  Description of Artificial Sequence: Synthetic coding sequence
atgaccctgcacaacaacagcaccaccagccccctgttccccaacatcagcagcagctggatccacagccccagcgacgccggcctgccccccggcaccgtgacccacttcggcagctacaacgtgagcagagccgccggcaacttcagcagccccgacggcaccaccgacgaccccctgggcggccacaccgtgtggcaggtggtgttcatcgccttcctgaccggcatcctggccctggtgaccatcatcggcaacatcctggtgatcgtgagcttcaaggtgaacaagcagctgaagaccgtgaacaactacttcctgctgagcctggcctgcgccgacctgatcatcggcgtgatcagcatgaacctgttcaccacctacatcatcatgaacagatgggccctgggcaacctggcctgcgacctgtggctggccatcgactacgtggccagcaacgccagcgtgatgaacctgctggtgatcagcttcgacagatacttcagcatcaccagacccctgacctacagagccaagagaaccaccaagagagccggcgtgatgatcggcctggcctgggtgatcagcttcgtgctgtgggcccccgccatcctgttctggcagtacttcgtgggcaagagaaccgtgccccccggcgagtgcttcatccagttcctgagcgagcccaccatcaccttcggcaccgccatcgccgccttctacatgcccgtgaccatcatgaccatcctgtactggagaatctacaaggagaccgagaagagaaccaaggagctggccggcctgcaggccagcggcaccgaggccgagaccgagaacttcgtgcaccccaccggcagcagcagaagctgcagcagctacgagctgcagcagcagagcatgaagagaagcaacagaagaaagtacggcagatgccacttctggttcaccaccaagagctggaagcccagcagcgagcagatggaccaggaccacagcagcagcgacagctggaacaacaacgacgccgccgccagcctggagaacagcgccagcagcgacgaggaggacatcggcagcgagaccagagccatctacagcatcgtgctgaagctgcccggccacagcaccatcctgaacagcaccaagctgcccagcagcgacaacctgcaggtgcccgaggaggagctgggcatggtggacctggagagaaaggccgacaagctgcaggcccagaagagcgtggacgacggcggcagcttccccaagagcttcagcaagctgcccatccagctggagagcgccgtggacaccgccaagaccagcgacgtgaacagcagcgtgggcaagagcaccgccaccctgcccctgagcttcaaggaggccaccctggccaagagattcgccctgaagaccagaagccagatcaccaagagaaagagaatgagcctggtgaaggagaagaaggccgcccagaccctgagcgccatcctgctggccttcatcatcacctggaccccctacaacatcatggtgctggtgaacaccttctgcgacagctgcatccccaagaccttctggaacctgggctactggctgtgctacatcaacagcaccgtgaaccccgtgtgctacgccctgtgcaacaagaccttcagaaccaccttcaagatgctgctgctgtgccagtgcgacaagaagaagagaagaaagcagcagtaccagcagagacagagcgtgatcttccacaagagagcccccgagcaggccctgtag

SEQ ID NO: 76616 - DNA, 333 bp, Artificial Sequence
  Description of Artificial Sequence: Synthetic coding sequence
atgaccctgcacaacaacagcaccaccagccccctgttccccaacatcagcagcagctggatccacagccccagcgacgccggcctgccccccggcaccgtgacccacttcggcagctacaacgtgagcagagccgccggcaacttcagcagccccgacggcaccaccgacgaccccctgggcggccacaccgtgtggcaggtggtgttcatcgccttcctgaccggcatcctggccctggtgaccatcatcggcaacatcctggtgatcgtgagcttcaaggtgaacaagcagctgaagaccgtgaacaactacttcctgctgagcctgtag

SEQ ID NO: 76617 - DNA, 1440 bp, Artificial Sequence
  Description of Artificial Sequence: Synthetic coding sequence
atggccaacttcacccccgtgaacggcagcagcggcaaccagagcgtgagactggtgaccagcagcagccacaacagatacgagaccgtggagatggtgttcatcgccaccgtgaccggcagcctgagcctggtgaccgtggtgggcaacatcctggtgatgctgagcatcaaggtgaacagacagctgcagaccgtgaacaactacttcctgttcagcctggcctgcgccgacctgatcatcggcgccttcagcatgaacctgtacaccgtgtacatcatcaagggctactggcccctgggcgccgtggtgtgcgacctgtggctggccctggactacgtggtgagcaacgccagcgtgatgaacctgctgatcatcagcttcgacagatacttctgcgtgaccaagcccctgacctaccccgccagaagaaccaccaagatggccggcctgatgatcgccgccgcctgggtgctgagcttcgtgctgtgggcccccgccatcctgttctggcagttcgtggtgggcaagagaaccgtgcccgacaaccagtgcttcatccagttcctgagcaaccccgccgtgaccttcggcaccgccatcgccgccttctacctgcccgtggtgatcatgaccgtgctgtacatccacatcagcctggccagcagaagcagagtgcacaagcacagacccgagggccccaaggagaagaaggccaagaccctggccttcctgaagagccccctgatgaagcagagcgtgaagaagcccccccccggcgaggccgccagagaggagctgagaaacggcaagctggaggaggcccccccccccgccctgccccccccccccagacccgtggccgacaaggacaccagcaacgagagcagcagcggcagcgccacccagaacaccaaggagagacccgccaccgagctgagcaccaccgaggccaccacccccgccatgcccgccccccccctgcagcccagagccctgaaccccgccagcagatggagcaagatccagatcgtgaccaagcagaccggcaacgagtgcgtgaccgccatcgagatcgtgcccgccacccccgccggcatgagacccgccgccaacgtggccagaaagttcgccagcatcgccagaaaccaggtgagaaagaagagacagatggccgccagagagagaaaggtgaccagaaccatcttcgccatcctgctggccttcatcctgacctggaccccctacaacgtgatggtgctggtgaacaccttctgccagagctgcatccccgacaccgtgtggagcatcggctactggctgtgctacgtgaacagcaccatcaaccccgcctgctacgccctgtgcaacgccaccttcaagaagaccttcagacacctgctgctgtgccagtacagaaacatcggcaccgccagatag

SEQ ID NO: 76618 - DNA, 1599 bp, Artificial Sequence
  Description of Artificial Sequence: Synthetic coding sequence
atggagggcgacagctaccacaacgccaccaccgtgaacggcacccccgtgaaccaccagcccctggagagacacagactgtgggaggtgatcaccatcgccgccgtgaccgccgtggtgagcctgatcaccatcgtgggcaacgtgctggtgatgatcagcttcaaggtgaacagccagctgaagaccgtgaacaactactacctgctgagcctggcctgcgccgacctgatcatcggcatcttcagcatgaacctgtacaccacctacatcctgatgggcagatgggccctgggcagcctggcctgcgacctgtggctggccctggactacgtggccagcaacgccagcgtgatgaacctgctggtgatcagcttcgacagatacttcagcatcaccagacccctgacctacagagccaagagaacccccaagagagccggcatcatgatcggcctggcctggctgatcagcttcatcctgtgggcccccgccatcctgtgctggcagtacctggtgggcaagagaaccgtgcccctggacgagtgccagatccagttcctgagcgagcccaccatcaccttcggcaccgccatcgccgccttctacatccccgtgagcgtgatgaccatcctgtactgcagaatctacagagagaccgagaagagaaccaaggacctggccgacctgcagggcagcgacagcgtgaccaaggccgagaagagaaagcccgcccacagagccctgttcagaagctgcctgagatgccccagacccaccctggcccagagagagagaaaccaggccagctggagcagcagcagaagaagcaccagcaccaccggcaagcccagccaggccaccggccccagcgccaactgggccaaggccgagcagctgaccacctgcagcagctaccccagcagcgaggacgaggacaagcccgccaccgaccccgtgctgcaggtggtgtacaagagccagggcaaggagagccccggcgaggagttcagcgccgaggagaccgaggagaccttcgtgaaggccgagaccgagaagagcgactacgacacccccaactacctgctgagccccgccgccgcccacagacccaagagccagaagtgcgtggcctacaagttcagactggtggtgaaggccgacggcaaccaggagaccaacaacggctgccacaaggtgaagatcatgccctgccccttccccgtggccaaggagcccagcaccaagggcctgaaccccaaccccagccaccagatgaccaagagaaagagagtggtgctggtgaaggagagaaaggccgcccagaccctgagcgccatcctgctggccttcatcatcacctggaccccctacaacatcatggtgctggtgagcaccttctgcgacaagtgcgtgcccgtgaccctgtggcacctgggctactggctgtgctacgtgaacagcaccgtgaaccccatctgctacgccctgtgcaacagaaccttcagaaagaccttcaagatgctgctgctgtgcagatggaagaagaagaaggtggaggagaagctgtactggcagggcaacagcaagctgccctag

SEQ ID NO: 76619 - DNA, 1599 bp, Artificial Sequence; identical to SEQ ID NO: 76618
  Description of Artificial Sequence: Synthetic coding sequence

SEQ ID NO: 76620 - DNA, 69 bp, Artificial Sequence
  Description of Artificial Sequence: Synthetic coding sequence
atggagggcgacagctaccacaacgccaccaccgtgaacggcacccccgtgaaccaccagcccctgtag

SEQ ID NO: 76621 - DNA, 1449 bp, Artificial Sequence
  Description of Artificial Sequence: Synthetic coding sequence
atggagccctggcccctgctgctgctgttcagcctgtgcagcgccggcctggtgctgggcagcgagcacgagaccagactggtggccaagctgttcaaggactacagcagcgtggtgagacccgtggaggaccacagacaggtggtggaggtgaccgtgggcctgcagctgatccagctgatcaacgtggacgaggtgaaccagatcgtgaccaccaacgtgagactgaagcagggcgacatggtggacctgcccagacccagctgcgtgaccctgggcgtgcccctgttcagccacctgcagaacgagcagtgggtggactacaacctgaagtggaaccccgacgactacggcggcgtgaagaagatccacatccccagcgagaagatctggagacccgacctggtgctgtacaacaacgccgacggcgacttcgccatcgtgaagttcaccaaggtgctgctgcagtacaccggccacatcacctggaccccccccgccatcttcaagagctactgcgagatcatcgtgacccacttccccttcgacgagcagaactgcagcatgaagctgggcacctggacctacgacggcagcgtggtggccatcaaccccgagagcgaccagcccgacctgagcaacttcatggagagcggcgagtgggtgatcaaggagagcagaggctggaagcacagcgtgacctacagctgctgccccgacaccccctacctggacatcacctaccacttcgtgatgcagagactgcccctgtacttcatcgtgaacgtgatcatcccctgcctgctgttcagcttcctgaccggcctggtgttctacctgcccaccgacagcggcgagaagatgaccctgagcatcagcgtgctgctgagcctgaccgtgttcctgctggtgatcgtggagctgatccccagcaccagcagcgccgtgcccctgatcggcaagtacatgctgttcaccatggtgttcgtgatcgccagcatcatcatcaccgtgatcgtgatcaacacccaccacagaagccccagcacccacgtgatgcccaactgggtgagaaaggtgttcatcgacaccatccccaacatcatgttcttcagcaccatgaagagacccagcagagagaagcaggacaagaagatcttcaccgaggacatcgacatcagcgacatcagcggcaagcccggccccccccccatgggcttccacagccccctgatcaagcaccccgaggtgaagagcgccatcgagggcatcaagtacatcgccgagaccatgaagagcgaccaggagagcaacaacgccgccgccgagtggaagtacgtggccatggtgatggaccacatcctgctgggcgtgttcatgctggtgtgcatcatcggcaccctggccgtgttcgccggcagactgatcgagctgaaccagcagggctag

SEQ ID NO: 76622 - DNA, 1374 bp, Artificial Sequence
  Description of Artificial Sequence: Synthetic coding sequence
atggagccctggcccctgctgctgctgttcagcctgtgcagcgccggcctggtgctgggcagcgagcacgagaccagactggtggccaagctgttcaaggactacagcagcgtggtgagacccgtggaggaccacagacaggtggtggaggtgaccgtgggcctgcagctgatccagctgatcaacgtggacgaggtgaaccagatcgtgaccaccaacgtgagactgaagcagcagtgggtggactacaacctgaagtggaaccccgacgactacggcggcgtgaagaagatccacatccccagcgagaagatctggagacccgacctggtgctgtacaacaacgccgacggcgacttcgccatcgtgaagttcaccaaggtgctgctgcagtacaccggccacatcacctggaccccccccgccatcttcaagagctactgcgagatcatcgtgacccacttccccttcgacgagcagaactgcagcatgaagctgggcacctggacctacgacggcagcgtggtggccatcaaccccgagagcgaccagcccgacctgagcaacttcatggagagcggcgagtgggtgatcaaggagagcagaggctggaagcacagcgtgacctacagctgctgccccgacaccccctacctggacatcacctaccacttcgtgatgcagagactgcccctgtacttcatcgtgaacgtgatcatcccctgcctgctgttcagcttcctgaccggcctggtgttctacctgcccaccgacagcggcgagaagatgaccctgagcatcagcgtgctgctgagcctgaccgtgttcctgctggtgatcgtggagctgatccccagcaccagcagcgccgtgcccctgatcggcaagtacatgctgttcaccatggtgttcgtgatcgccagcatcatcatcaccgtgatcgtgatcaacacccaccacagaagccccagcacccacgtgatgcccaactgggtgagaaaggtgttcatcgacaccatccccaacatcatgttcttcagcaccatgaagagacccagcagagagaagcaggacaagaagatcttcaccgaggacatcgacatcagcgacatcagcggcaagcccggccccccccccatgggcttccacagccccctgatcaagcaccccgaggtgaagagcgccatcgagggcatcaagtacatcgccgagaccatgaagagcgaccaggagagcaacaacgccgccgccgagtggaagtacgtggccatggtgatggaccacatcctgctgggcgtgttcatgctggtgtgcatcatcggcaccctggccgtgttcgccggcagactgatcgagctgaaccagcagggctag

SEQ ID NO: 76623 - DNA, 1353 bp, Artificial Sequence
  Description of Artificial Sequence: Synthetic coding sequence
atgggcctgagaagccaccacctgagcctgggcctgctgctgctgttcctgctgcccgccgagtgcctgggcgccgagggcagactggccctgaagctgttcagagacctgttcgccaactacaccagcgccctgagacccgtggccgacaccgaccagaccctgaacgtgaccctggaggtgaccctgagccagatcatcgacatggacgagagaaaccaggtgctgaccctgtacctgtggatcagacaggagtggaccgacgcctacctgagatgggaccccaacgcctacggcggcctggacgccatcagaatccccagcagcctggtgtggagacccgacatcgtgctgtacaacaaggccgacgcccagccccccggcagcgccagcaccaacgtggtgctgagacacgacggcgccgtgagatgggacgcccccgccatcaccagaagcagctgcagagtggacgtggccgccttccccttcgacgcccagcactgcggcctgaccttcggcagctggacccacggcggccaccagctggacgtgagacccagaggcgccgccgccagcctggccgacttcgtggagaacgtggagtggagagtgctgggcatgcccgccagaagaagagtgctgacctacggctgctgcagcgagccctaccccgacgtgaccttcaccctgctgctgagaagaagagccgccgcctacgtgtgcaacctgctgctgccctgcgtgctgatcagcctgctggcccccctggccttccacctgcccgccgacagcggcgagaaggtgagcctgggcgtgaccgtgctgctggccctgaccgtgttccagctgctgctggccgagagcatgccccccgccgagagcgtgcccctgatcggcaagtactacatggccaccatgaccatggtgaccttcagcaccgccctgaccatcctgatcatgaacctgcactactgcggccccagcgtgagacccgtgcccgcctgggccagagccctgctgctgggccacctggccagaggcctgtgcgtgagagagagaggcgagccctgcggccagagcagaccccccgagctgagccccagcccccagagccccgagggcggcgccggcccccccgccggcccctgccacgagcccagatgcctgtgcagacaggaggccctgctgcaccacgtggccaccatcgccaacaccttcagaagccacagagccgcccagagatgccacgaggactggaagagactggccagagtgatggacagattcttcctggccatcttcttcagcatggccctggtgatgagcctgctggtgctggtgcaggccctgtag

SEQ ID NO: 76624 - DNA, 1590 bp, Artificial Sequence
  Description of Artificial Sequence: Synthetic coding sequence
atgggccccagctgccccgtgttcctgagcttcaccaagctgagcctgtggtggctgctgctgacccccgccggcggcgaggaggccaagagacccccccccagagcccccggcgaccccctgagcagccccagccccaccgccctgccccagggcggcagccacaccgagaccgaggacagactgttcaagcacctgttcagaggctacaacagatgggccagacccgtgcccaacaccagcgacgtggtgatcgtgagattcggcctgagcatcgcccagctgatcgacgtggacgagaagaaccagatgatgaccaccaacgtgtggctgaagcaggagtggagcgactacaagctgagatggaaccccaccgacttcggcaacatcaccagcctgagagtgcccagcgagatgatctggatccccgacatcgtgctgtacaacaacgccgacggcgagttcgccgtgacccacatgaccaaggcccacctgttcagcaccggcaccgtgcactgggtgccccccgccatctacaagagcagctgcagcatcgacgtgaccttcttccccttcgaccagcagaactgcaagatgaagttcggcagctggacctacgacaaggccaagatcgacctggagcagatggagcagaccgtggacctgaaggactactgggagagcggcgagtgggccatcgtgaacgccaccggcacctacaacagcaagaagtacgactgctgcgccgagatctaccccgacgtgacctacgccttcgtgatcagaagactgcccctgttctacaccatcaacctgatcatcccctgcctgctgatcagctgcctgaccgtgctggtgttctacctgcccagcgactgcggcgagaagatcaccctgtgcatcagcgtgctgctgagcctgaccgtgttcctgctgctgatcaccgagatcatccccagcaccagcctggtgatccccctgatcggcgagtacctgctgttcaccatgatcttcgtgaccctgagcatcgtgatcaccgtgttcgtgctgaacgtgcaccacagaagccccagcacccacaccatgccccactgggtgagaggcgccctgctgggctgcgtgcccagatggctgctgatgaacagaccccccccccccgtggagctgtgccaccccctgagactgaagctgagccccagctaccactggctggagagcaacgtggacgccgaggagagagaggtggtggtggaggaggaggacagatgggcctgcgccggccacgtggcccccagcgtgggcaccctgtgcagccacggccacctgcacagcggcgccagcggccccaaggccgaggccctgctgcaggagggcgagctgctgctgagcccccacatgcagaaggccctggagggcgtgcactacatcgccgaccacctgagaagcgaggacgccgacagcagcgtgaaggaggactggaagtacgtggccatggtgatcgacagaatcttcctgtggctgttcatcatcgtgtgcttcctgggcaccatcggcctgttcctgccccccttcctggccggcatgatctag

SEQ ID NO: 76625 - DNA, 1590 bp, Artificial Sequence; identical to SEQ ID NO: 76624
  Description of Artificial Sequence: Synthetic coding sequence

SEQ ID NO: 76626 - DNA, 1518 bp, Artificial Sequence
  Description of Artificial Sequence: Synthetic coding sequence
atgggcagcggccccctgagcctgcccctggccctgagcccccccagactgctgctgctgctgctgctgagcctgctgcccgtggccagagccagcgaggccgagcacagactgttcgagagactgttcgaggactacaacgagatcatcagacccgtggccaacgtgagcgaccccgtgatcatccacttcgaggtgagcatgagccagctggtgaaggtggacgaggtgaaccagatcatggagaccaacctgtggctgaagcagatctggaacgactacaagctgaagtggaaccccagcgactacggcggcgccgagttcatgagagtgcccgcccagaagatctggaagcccgacatcgtgctgtacaacaacgccgtgggcgacttccaggtggacgacaagaccaaggccctgctgaagtacaccggcgaggtgacctggatcccccccgccatcttcaagagcagctgcaagatcgacgtgacctacttccccttcgactaccagaactgcaccatgaagttcggcagctggagctacgacaaggccaagatcgacctggtgctgatcggcagcagcatgaacctgaaggactactgggagagcggcgagtgggccatcatcaaggcccccggctacaagcacgacatcaagtacaactgctgcgaggagatctaccccgacatcacctacagcctgtacatcagaagactgcccctgttctacaccatcaacctgatcatcccctgcctgctgatcagcttcctgaccgtgctggtgttctacctgcccagcgactgcggcgagaaggtgaccctgtgcatcagcgtgctgctgagcctgaccgtgttcctgctggtgatcaccgagaccatccccagcaccagcctggtgatccccctgatcggcgagtacctgctgttcaccatgatcttcgtgaccctgagcatcgtgatcaccgtgttcgtgctgaacgtgcactacagaacccccaccacccacaccatgcccagctgggtgaagaccgtgttcctgaacctgctgcccagagtgatgttcatgaccagacccaccagcaacgagggcaacgcccagaagcccagacccctgtacggcgccgagctgagcaacctgaactgcttcagcagagccgagagcaagggctgcaaggagggctacccctgccaggacggcatgtgcggctactgccaccacagaagaatcaagatcagcaacttcagcgccaacctgaccagaagcagcagcagcgagagcgtggacgccgtgctgagcctgagcgccctgagccccgagatcaaggaggccatccagagcgtgaagtacatcgccgagaacatgaaggcccagaacgaggccaaggagatccaggacgactggaagtacgtggccatggtgatcgacagaatcttcctgtgggtgttcaccctggtgtgcatcctgggcaccgccggcctgttcctgcagcccctgatggccagagaggacgcctag

SEQ ID NO: 76627 - DNA, 939 bp, Artificial Sequence
  Description of Artificial Sequence: Synthetic coding sequence
accaaggccctgctgaagtacaccggcgaggtgacctggatcccccccgccatcttcaagagcagctgcaagatcgacgtgacctacttccccttcgactaccagaactgcaccatgaagttcggcagctggagctacgacaaggccaagatcgacctggtgctgatcggcagcagcatgaacctgaaggactactgggagagcggcgagtgggccatcatcaaggcccccggctacaagcacgacatcaagtacaactgctgcgaggagatctaccccgacatcacctacagcctgtacatcagaagactgcccctgttctacaccatcaacctgatcatcccctgcctgctgatcagcttcctgaccgtgctggtgttctacctgcccagcgactgcggcgagaaggtgaccctgtgcatcagcgtgctgctgagcctgaccgtgttcctgctggtgatcaccgagaccatccccagcaccagcctggtgatccccctgatcggcgagtacctgctgttcaccatgatcttcgtgaccctgagcatcgtgatcaccgtgttcgtgctgaacgtgcactacagaacccccaccacccacaccatgcccagctgggtgaagaccgtgttcctgaacctgctgcccagagtgatgttcatgaccagacccaccagcaacgagggcaacgcccagaagcccagacccctgtacggcgccagccccaaggccgccagaagagagatcaaggaggccatccagagcgtgaagtacatcgccgagaacatgaaggcccagaacgaggccaaggagatccaggacgactggaagtacgtggccatggtgatcgacagaatcttcctgtgggtgttcaccctggtgtgcatcctgggcaccgccggcctgttcctgcagcccctgatggccagagaggacgcctag

SEQ ID NO: 76628 - DNA, 1470 bp, Artificial Sequence
  Description of Artificial Sequence: Synthetic coding sequence
atgggcagcggccccctgagcctgcccctggccctgagcccccccagactgctgctgctgctgctgctgagcctgctgcccgtggccagagccagcgaggccgagcacagactgttcgagagactgttcgaggactacaacgagatcatcagacccgtggccaacgtgagcgaccccgtgatcatccacttcgaggtgagcatgagccagctggtgaaggtggacgaggtgaaccagatcatggagaccaacctgtggctgaagcagatctggaacgactacaagctgaagtggaaccccagcgactacggcggcgccgagttcatgagagtgcccgcccagaagatctggaagcccgacatcgtgctgtacaacaacgccgtgggcgacttccaggtggacgacaagaccaaggccctgctgaagtacaccggcgaggtgacctggatcccccccgccatcttcaagagcagctgcaagatcgacgtgacctacttccccttcgactaccagaactgcaccatgaagttcggcagctggagctacgacaaggccaagatcgacctggtgctgatcggcagcagcatgaacctgaaggactactgggagagcggcgagtgggccatcatcaaggcccccggctacaagcacgacatcaagtacaactgctgcgaggagatctaccccgacatcacctacagcctgtacatcagaagactgcccctgttctacaccatcaacctgatcatcccctgcctgctgatcagcttcctgaccgtgctggtgttctacctgcccagcgactgcggcgagaaggtgaccctgtgcatcagcgtgctgctgagcctgaccgtgttcctgctggtgatcaccgagaccatccccagcaccagcctggtgatccccctgatcggcgagtacctgctgttcaccatgatcttcgtgaccctgagcatcgtgatcaccgtgttcgtgctgaacgtgcactacagaacccccaccacccacaccatgcccagctgggtgaagaccgtgttcctgaacctgctgcccagagtgatgttcatgaccagacccaccagcaacgagggcaacgcccagaagcccagacccctgtacggcgccgagctgagcaacctgaactgcttcagcagagccgagagcaagggctgcaaggagggctacccctgccaggacggcatgtgcggctactgccaccacagaagaatcaagatcagcaacttcagcgccaacctgaccagaagcagcagcagcgagagcgtggacgccgtgctgagcctgagcgccctgagccccgagatcaaggaggccatccagagcgtgaagtacatcgccgagaacatgaaggcccagaacgaggccaaggaggagcagaaggcccaggagatccagcagctgaagagaaaggagaagagcaccgagaccagcgaccaggagcccggcctgtag

SEQ ID NO: 76629 - DNA, 1518 bp, Artificial Sequence; identical to SEQ ID NO: 76626
  Description of Artificial Sequence: Synthetic coding sequence

SEQ ID NO: 76630 - DNA, 1602 bp, Artificial Sequence
  Description of Artificial Sequence: Synthetic coding sequence
gcccccgagcccggcgaggcccccagactggacagagcccaccccggctgcgcctgcgccgagctgagcctgctgtggctgtgctgctgcaccttcaccagcgccgacggcgacttcgccgtgacccacctgaccaaggcccacctgttccacgacggcagagtgcagtggaccccccccgccatctacaagagcagctgcagcatcgacgtgaccttcttccccttcgaccagcagaactgcaccatgaagttcggcagctggacctacgacaaggccaagatcgacctggtgaacatgcacagcagagtggaccagctggacttctgggagagcggcgagtgggtgatcgtggacgccgtgggcacctacaacaccagaaagtacgagtgctgcgccgagatctaccccgacatcacctacgccttcgtgatcagaagactgcccctgttctacaccatcaacctgatcatcccctgcctgctgatcagctgcctgaccgtgctggtgttctacctgcccagcgagtgcggcgagaagatcaccctgtgcatcagcgtgctgctgagcctgaccgtgttcctgctgctgatcaccgagatcatccccagcaccagcctggtgatccccctgatcggcgagtacctgctgttcaccatgatcttcgtgaccctgagcatcgtgatcaccgtgttcgtgctgaacgtgcaccacagaagccccagaacccacaccatgcccacctgggtgagaagagtgttcctggacatcgtgcccagactgctgctgatgaagagacccagcgtggtgaaggacaactgcagaagactgatcgagagcatgcacaagatggccagcgcccccagattctggcccgagcccgagggcgagccccccgccaccagcggcacccagagcctgcacccccccagccccagcttctgcgtgcccctggacgtgcccgccgagcccggccccagctgcaagagccccagcgaccagctgcccccccagcagcccctggaggccgagaaggccagcccccaccccagccccggcccctgcagacccccccacggcacccaggcccccggcctggccaaggccagaagcctgagcgtgcagcacatgagcagccccggcgaggccgtggagggcggcgtgagatgcagaagcagaagcatccagtactgcgtgcccagagacgacgccgcccccgaggccgacggccaggccgccggcgccctggccagcagaaacacccacagcgccgagctgcccccccccgaccagcccagcccctgcaagtgcacctgcaagaaggagcccagcagcgtgagccccagcgccaccgtgaagaccagaagcaccaaggccccccccccccacctgcccctgagccccgccctgaccagagccgtggagggcgtgcagtacatcgccgaccacctgaaggccgaggacaccgacttcagcgtgaaggaggactggaagtacgtggccatggtgatcgacagaatcttcctgtggatgttcatcatcgtgtgcctgctgggcaccgtgggcctgttcctgcccccctggctggccggcatgatctag

SEQ ID NO: 76631 - DNA, 1884 bp, Artificial Sequence
  Description of Artificial Sequence: Synthetic coding sequence
atggagctgggcggccccggcgcccccagactgctgccccccctgctgctgctgctgggcaccggcctgctgagagccagcagccacgtggagaccagagcccacgccgaggagagactgctgaagaagctgttcagcggctacaacaagtggagcagacccgtggccaacatcagcgacgtggtgctggtgagattcggcctgagcatcgcccagctgatcgacgtggacgagaagaaccagatgatgaccaccaacgtgtgggtgaagcaggagtggcacgactacaagctgagatgggaccccgccgactacgagaacgtgaccagcatcagaatccccagcgagctgatctggagacccgacatcgtgctgtacaacaacgccgacggcgacttcgccgtgacccacctgaccaaggcccacctgttccacgacggcagagtgcagtggaccccccccgccatctacaagagcagctgcagcatcgacgtgaccttcttccccttcgaccagcagaactgcaccatgaagttcggcagctggacctacgacaaggccaagatcgacctggtgaacatgcacagcagagtggaccagctggacttctgggagagcggcgagtgggtgatcgtggacgccgtgggcacctacaacaccagaaagtacgagtgctgcgccgagatctaccccgacatcacctacgccttcgtgatcagaagactgcccctgttctacaccatcaacctgatcatcccctgcctgctgatcagctgcctgaccgtgctggtgttctacctgcccagcgagtgcggcgagaagatcaccctgtgcatcagcgtgctgctgagcctgaccgtgttcctgctgctgatcaccgagatcatccccagcaccagcctggtgatccccctgatcggcgagtacctgctgttcaccatgatcttcgtgaccctgagcatcgtgatcaccgtgttcgtgctgaacgtgcaccacagaagccccagaacccacaccatgcccacctgggtgagaagagtgttcctggacatcgtgcccagactgctgctgatgaagagacccagcgtggtgaaggacaactgcagaagactgatcgagagcatgcacaagatggccagcgcccccagattctggcccgagcccgagggcgagccccccgccaccagcggcacccagagcctgcacccccccagccccagcttctgcgtgcccctggacgtgcccgccgagcccggccccagctgcaagagccccagcgaccagctgcccccccagcagcccctggaggccgagaaggccagcccccaccccagccccggcccctgcagacccccccacggcacccaggcccccggcctggccaaggccagaagcctgagcgtgcagcacatgagcagccccggcgaggccgtggagggcggcgtgagatgcagaagcagaagcatccagtactgcgtgcccagagacgacgccgcccccgaggccgacggccaggccgccggcgccctggccagcagaaacacccacagcgccgagctgcccccccccgaccagcccagcccctgcaagtgcacctgcaagaaggagcccagcagcgtgagccccagcgccaccgtgaagaccagaagcaccaaggccccccccccccacctgcccctgagccccgccctgaccagagccgtggagggcgtgcagtacatcgccgaccacctgaaggccgaggacaccgacttcagcgtgaaggaggactggaagtacgtggccatggtgatcgacagaatcttcctgtggatgttcatcatcgtgtgcctgctgggcaccgtgggcctgttcctgcccccctggctggccggcatgatctag

SEQ ID NO: 76632 - DNA, 1671 bp, Artificial Sequence
  Description of Artificial Sequence: Synthetic coding sequence
atgagaatgagcccccccagcgccagcccccccagcagcagcggcggcagaaccagcagcagcaccaccaccgccggcgagcccttctgggccggcgtgctgttcgccatcagaccccaccccggcctgagcggcagaatcgtgtggaccgccggctgccccggcgagggcgccgacggcgacttcgccgtgacccacctgaccaaggcccacctgttccacgacggcagagtgcagtggaccccccccgccatctacaagagcagctgcagcatcgacgtgaccttcttccccttcgaccagcagaactgcaccatgaagttcggcagctggacctacgacaaggccaagatcgacctggtgaacatgcacagcagagtggaccagctggacttctgggagagcggcgagtgggtgatcgtggacgccgtgggcacctacaacaccagaaagtacgagtgctgcgccgagatctaccccgacatcacctacgccttcgtgatcagaagactgcccctgttctacaccatcaacctgatcatcccctgcctgctgatcagctgcctgaccgtgctggtgttctacctgcccagcgagtgcggcgagaagatcaccctgtgcatcagcgtgctgctgagcctgaccgtgttcctgctgctgatcaccgagatcatccccagcaccagcctggtgatccccctgatcggcgagtacctgctgttcaccatgatcttcgtgaccctgagcatcgtgatcaccgtgttcgtgctgaacgtgcaccacagaagccccagaacccacaccatgcccacctgggtgagaagagtgttcctggacatcgtgcccagactgctgctgatgaagagacccagcgtggtgaaggacaactgcagaagactgatcgagagcatgcacaagatggccagcgcccccagattctggcccgagcccgagggcgagccccccgccaccagcggcacccagagcctgcacccccccagccccagcttctgcgtgcccctggacgtgcccgccgagcccggccccagctgcaagagccccagcgaccagctgcccccccagcagcccctggaggccgagaaggccagcccccaccccagccccggcccctgcagacccccccacggcacccaggcccccggcctggccaaggccagaagcctgagcgtgcagcacatgagcagccccggcgaggccgtggagggcggcgtgagatgcagaagcagaagcatccagtactgcgtgcccagagacgacgccgcccccgaggccgacggccaggccgccggcgccctggccagcagaaacacccacagcgccgagctgcccccccccgaccagcccagcccctgcaagtgcacctgcaagaaggagcccagcagcgtgagccccagcgccaccgtgaagaccagaagcaccaaggccccccccccccacctgcccctgagccccgccctgaccagagccgtggagggcgtgcagtacatcgccgaccacctgaaggccgaggacaccgacttcagcgtgaaggaggactggaagtacgtggccatggtgatcgacagaatcttcctgtggatgttcatcatcgtgtgcctgctgggcaccgtgggcctgttcctgcccccctggctggccggcatgatctag

SEQ ID NO: 76633 - DNA, 1407 bp, Artificial Sequence
  Description of Artificial Sequence: Synthetic coding sequence
atggccgccagaggcagcggccccagagccctgagactgctgctgctggtgcagctggtggccggcagatgcggcctggccggcgccgccggcggcgcccagagaggcctgagcgagcccagcagcatcgccaagcacgaggacagcctgctgaaggacctgttccaggactacgagagatgggtgagacccgtggagcacctgaacgacaagatcaagatcaagttcggcctggccatcagccagctggtggacgtggacgagaagaaccagctgatgaccaccaacgtgtggctgaagcaggagtggatcgacgtgaagctgagatggaaccccgacgactacggcggcatcaaggtgatcagagtgcccagcgacagcgtgtggacccccgacatcgtgctgttcgacaacgccgacggcagattcgagggcaccagcaccaagaccgtgatcagatacaacggcaccgtgacctggaccccccccgccaactacaagagcagctgcaccatcgacgtgaccttcttccccttcgacctgcagaactgcagcatgaagttcggcagctggacctacgacggcagccaggtggacatcatcctggaggaccaggacgtggacaagagagacttcttcgacaacggcgagtgggagatcgtgagcgccaccggcagcaagggcaacagaaccgacagctgctgctggtacccctacgtgacctacagcttcgtgatcaagagactgcccctgttctacaccctgttcctgatcatcccctgcatcggcctgagcttcctgaccgtgctggtgttctacctgcccagcaacgagggcgagaagatctgcctgtgcaccagcgtgctggtgagcctgaccgtgttcctgctggtgatcgaggagatcatccccagcagcagcaaggtgatccccctgatcggcgagtacctggtgttcaccatgatcttcgtgaccctgagcatcatggtgaccgtgttcgccatcaacatccaccacagaagcagcagcacccacaacgccatggcccccctggtgagaaagatcttcctgcacaccctgcccaagctgctgtgcatgagaagccacgtggacagatacttcacccagaaggaggagaccgagagcggcagcggccccaagagcagcagaaacaccctggaggccgccctggacagcatcagatacatcaccagacacatcatgaaggagaacgacgtgagagaggtggtggaggactggaagttcatcgcccaggtgctggacagaatgttcctgtggaccttcctgttcgtgagcatcgtgggcagcctgggcctgttcgtgcccgtgatctacaagtgggccaacatcctgatccccgtgcacatcggcaacgccaacaagtag

SEQ ID NO: 76634 - DNA, 1485 bp, Artificial Sequence
  Description of Artificial Sequence: Synthetic coding sequence
atgctgaccagcaagggccagggcttcctgcacggcggcctgtgcctgtggctgtgcgtgttcacccccttcttcaagggctgcgtgggctgcgccaccgaggagagactgttccacaagctgttcagccactacaaccagttcatcagacccgtggagaacgtgagcgaccccgtgaccgtgcacttcgaggtggccatcacccagctggccaacgtggacgaggtgaaccagatcatggagaccaacctgtggctgagacacatctggaacgactacaagctgagatgggaccccatggagtacgacggcatcgagaccctgagagtgcccgccgacaagatctggaagcccgacatcgtgctgtacaacaacgccgtgggcgacttccaggtggagggcaagaccaaggccctgctgaagtacaacggcatgatcacctggaccccccccgccatcttcaagagcagctgccccatggacatcaccttcttccccttcgaccaccagaactgcagcctgaagttcggcagctggacctacgacaaggccgagatcgacctgctgatcatcggcagcaaggtggacatgaacgacttctgggagaacagcgagtgggagatcatcgacgccagcggctacaagcacgacatcaagtacaactgctgcgaggagatctacaccgacatcacctacagcttctacatcagaagactgcccatgttctacaccatcaacctgatcatcccctgcctgttcatcagcttcctgaccgtgctggtgttctacctgcccagcgactgcggcgagaaggtgaccctgtgcatcagcgtgctgctgagcctgaccgtgttcctgctggtgatcaccgagaccatccccagcaccagcctggtggtgcccctggtgggcgagtacctgctgttcaccatgatcttcgtgaccctgagcatcgtggtgaccgtgttcgtgctgaacatccactacagaacccccaccacccacaccatgcccagatgggtgaagaccgtgttcctgaagctgctgccccaggtgctgctgatgagatggcccctggacaagaccagaggcaccggcagcgacgccgtgcccagaggcctggccagaagacccgccaagggcaagctggccagccacggcgagcccagacacctgaaggagtgcttccactgccacaagagcaacgagctggccaccagcaagagaagactgagccaccagcccctgcagtgggtggtggagaacagcgagcacagccccgaggtggaggacgtgatcaacagcgtgcagttcatcgccgagaacatgaagagccacaacgagaccaaggaggtggaggacgactggaagtacgtggccatggtggtggacagagtgttcctgtgggtgttcatcatcgtgtgcgtgttcggcaccgccggcctgttcctgcagcccctgctgggcaacaccggcaagagctag

SEQ ID NO: 76635 - DNA, 1440 bp, Artificial Sequence
  Description of Artificial Sequence: Synthetic coding sequence
atgctgaccagcaagggccagggcttcctgcacggcggcctgtgcctgtggctgtgcgtgttcacccccttcttcaagggctgcgtgggctgcgccaccgaggagagactgttccacaagctgttcagccactacaaccagttcatcagacccgtggagaacgtgagcgaccccgtgaccgtgcacttcgaggtggccatcacccagctggccaacgtgatctggaacgactacaagctgagatgggaccccatggagtacgacggcatcgagaccctgagagtgcccgccgacaagatctggaagcccgacatcgtgctgtacaacaacgccgtgggcgacttccaggtggagggcaagaccaaggccctgctgaagtacaacggcatgatcacctggaccccccccgccatcttcaagagcagctgccccatggacatcaccttcttccccttcgaccaccagaactgcagcctgaagttcggcagctggacctacgacaaggccgagatcgacctgctgatcatcggcagcaaggtggacatgaacgacttctgggagaacagcgagtgggagatcatcgacgccagcggctacaagcacgacatcaagtacaactgctgcgaggagatctacaccgacatcacctacagcttctacatcagaagactgcccatgttctacaccatcaacctgatcatcccctgcctgttcatcagcttcctgaccgtgctggtgttctacctgcccagcgactgcggcgagaaggtgaccctgtgcatcagcgtgctgctgagcctgaccgtgttcctgctggtgatcaccgagaccatccccagcaccagcctggtggtgcccctggtgggcgagtacctgctgttcaccatgatcttcgtgaccctgagcatcgtggtgaccgtgttcgtgctgaacatccactacagaacccccaccacccacaccatgcccagatgggtgaagaccgtgttcctgaagctgctgccccaggtgctgctgatgagatggcccctggacaagaccagaggcaccggcagcgacgccgtgcccagaggcctggccagaagacccgccaagggcaagctggccagccacggcgagcccagacacctgaaggagtgcttccactgccacaagagcaacgagctggccaccagcaagagaagactgagccaccagcccctgcagtgggtggtggagaacagcgagcacagccccgaggtggaggacgtgatcaacagcgtgcagttcatcgccgagaacatgaagagccacaacgagaccaaggaggtggaggacgactggaagtacgtggccatggtggtggacagagtgttcctgtgggtgttcatcatcgtgtgcgtgttcggcaccgccggcctgttcctgcagcccctgctgggcaacaccggcaagagctag

SEQ ID NO: 76636 - DNA, 1509 bp, Artificial Sequence
  Description of Artificial Sequence: Synthetic coding sequence
atgagatgcagccccggcggcgtgtggctggccctggccgccagcctgctgcacgtgagcctgcagggcgagttccagagaaagctgtacaaggagctggtgaagaactacaaccccctggagagacccgtggccaacgacagccagcccctgaccgtgtacttcagcctgagcctgctgcagatcatggacgtggacgagaagaaccaggtgctgaccaccaacatctggctgcagatgagctggaccgaccactacctgcagtggaacgtgagcgagtaccccggcgtgaagaccgtgagattccccgacggccagatctggaagcccgacatcctgctgtacaacagcgccgacgagagattcgacgccaccttccacaccaacgtgctggtgaacagcagcggccactgccagtacctgccccccggcatcttcaagagcagctgctacatcgacgtgagatggttccccttcgacgtgcagcactgcaagctgaagttcggcagctggagctacggcggctggagcctggacctgcagatgcaggaggccgacatcagcggctacatccccaacggcgagtgggacctggtgggcatccccggcaagagaagcgagagattctacgagtgctgcaaggagccctaccccgacgtgaccttcaccgtgaccatgagaagaagaaccctgtactacggcctgaacctgctgatcccctgcgtgctgatcagcgccctggccctgctggtgttcctgctgcccgccgacagcggcgagaagatcagcctgggcatcaccgtgctgctgagcctgaccgtgttcatgctgctggtggccgagatcatgcccgccaccagcgacagcgtgcccctgatcgcccagtacttcgccagcaccatgatcatcgtgggcctgagcgtggtggtgaccgtgatcgtgctgcagtaccaccaccacgaccccgacggcggcaagatgcccaagtggaccagagtgatcctgctgaactggtgcgcctggttcctgagaatgaagagacccggcgaggacaaggtgagacccgcctgccagcacaagcagagaagatgcagcctggccagcgtggagatgagcgccgtggcccccccccccgccagcaacggcaacctgctgtacatcggcttcagaggcctggacggcgtgcactgcgtgcccacccccgacagcggcgtggtgtgcggcagaatggcctgcagccccacccacgacgagcacctgctgcacggcggccagccccccgagggcgaccccgacctggccaagatcctggaggaggtgagatacatcgccaacagattcagatgccaggacgagagcgaggccgtgtgcagcgagtggaagttcgccgcctgcgtggtggacagactgtgcctgatggccttcagcgtgttcaccatcatctgcaccatcggcatcctgatgagcgcccccaacttcgtggaggccgtgagcaaggacttcgcctag

SEQ ID NO: 76637 - DNA, 210 bp, Artificial Sequence
  Description of Artificial Sequence: Synthetic coding sequence
atgcagaagtactgcatctaccagcacttccagttccagctgctgatccagcacctgtggatcgccgccaactgcgacatctgggccaaggtggccagagtgatcggcctgctggccagccacaagaccgacctgcaggagaacacccccgtggtggaggccttccccaacagccccagaacccccaccctgcccggcgtgctgacctag

SEQ ID NO: 76638 - DNA, 1239 bp, Artificial Sequence
  Description of Artificial Sequence: Synthetic coding sequence
atgcagaagtactgcatctaccagcacttccagttccagctgctgatccagcacctgtggatcgccgccaactgcgacatcgccgacgagagattcgacgccaccttccacaccaacgtgctggtgaacagcagcggccactgccagtacctgccccccggcatcttcaagagcagctgctacatcgacgtgagatggttccccttcgacgtgcagcactgcaagctgaagttcggcagctggagctacggcggctggagcctggacctgcagatgcaggaggccgacatcagcggctacatccccaacggcgagtgggacctggtgggcatccccggcaagagaagcgagagattctacgagtgctgcaaggagccctaccccgacgtgaccttcaccgtgaccatgagaagaagaaccctgtactacggcctgaacctgctgatcccctgcgtgctgatcagcgccctggccctgctggtgttcctgctgcccgccgacagcggcgagaagatcagcctgggcatcaccgtgctgctgagcctgaccgtgttcatgctgctggtggccgagatcatgcccgccaccagcgacagcgtgcccctgatcgcccagtacttcgccagcaccatgatcatcgtgggcctgagcgtggtggtgaccgtgatcgtgctgcagtaccaccaccacgaccccgacggcggcaagatgcccaagtggaccagagtgatcctgctgaactggtgcgcctggttcctgagaatgaagagacccggcgaggacaaggtgagacccgcctgccagcacaagcagagaagatgcagcctggccagcgtggagatgagcgccgtggcccccccccccgccagcaacggcaacctgctgtacatcggcttcagaggcctggacggcgtgcactgcgtgcccacccccgacagcggcgtggtgtgcggcagaatggcctgcagccccacccacgacgagcacctgctgcacggcggccagccccccgagggcgaccccgacctggccaagatcctggaggaggtgagatacatcgccaacagattcagatgccaggacgagagcgaggccgtgtgcagcgagtggaagttcgccgcctgcgtggtggacagactgtgcctgatggccttcagcgtgttcaccatcatctgcaccatcggcatcctgatgagcgcccccaacttcgtggaggccgtgagcaaggacttcgcctag

SEQ ID NO: 76639 - DNA, 447 bp, Artificial Sequence
  Description of Artificial Sequence: Synthetic coding sequence
atgagatgcagccccggcggcgtgtggctggccctggccgccagcctgctgcacgtgagcctgcagggcgagttccagagaaagctgtacaaggagctggtgaagaactacaaccccctggagagacccgtggccaacgacagccagcccctgaccgtgtacttcagcctgagcctgctgcagatcatggacgtggacgagaagaaccaggtgctgaccaccaacatctggctgcagatgagctggaccgaccactacctgcagtggaacgtgagcgagtaccccggcgtgaagaccgtgagattccccgacggccagatctggaagcccgacatcctgctgtacaacagcagctacgaccagcagcaggaggtgctggcctacggcatgcactgctggagcccccagttcggccccaccagcagcagcatgttccccgtggtgtag

SEQ ID NO: 76640 - DNA, 600 bp, Artificial Sequence
  Description of Artificial Sequence: Synthetic coding sequence
atgaccaacagcagaaagtgctggcccatgggctgcaccgccggcgcccacagcctggacccccaccccagactgtgcagcctgctgtgcatcggcgagttctgcggcagagacggctgcagcgccgacgagagattcgacgccaccttccacaccaacgtgctggtgaacagcagcggccactgccagtacctgccccccggcatcttcaagagcagctgctacatcgacgtgagatggttccccttcgacgtgcagcactgcaagctgaagttcggcagctggagctacggcggctggagcctggacctgcagatgcaggaggccgacatcagcggctacatccccaacggcgagtgggacctggtgggcatccccggcaagagaagcgagagattctacgagtgctgcaaggagccctaccccgacgtgaccttcaccgtgaccatgagaagaagaaccctgtactacggcctgaacctgctgatcccctgcgtgctgatcagcgccctggccctgctggtgttcctgctgcccgccgacagcggcgagaagatcagcctgggcatcaccgtgctgctgagcctgaccgtgttctag

SEQ ID NO: 76641 - DNA, 1596 bp, Artificial Sequence
  Description of Artificial Sequence: Synthetic coding sequence
atgagatgcagccccggcggcgtgtggctggccctggccgccagcctgctgcacggcaaggccaccgccagcccccccagcacccccccctgggaccccggccacatccccggcgccagcgtgagacccgcccccggccccgtgagcctgcagggcgagttccagagaaagctgtacaaggagctggtgaagaactacaaccccctggagagacccgtggccaacgacagccagcccctgaccgtgtacttcagcctgagcctgctgcagatcatggacgtggacgagaagaaccaggtgctgaccaccaacatctggctgcagatgagctggaccgaccactacctgcagtggaacgtgagcgagtaccccggcgtgaagaccgtgagattccccgacggccagatctggaagcccgacatcctgctgtacaacagcgccgacgagagattcgacgccaccttccacaccaacgtgctggtgaacagcagcggccactgccagtacctgccccccggcatcttcaagagcagctgctacatcgacgtgagatggttccccttcgacgtgcagcactgcaagctgaagttcggcagctggagctacggcggctggagcctggacctgcagatgcaggaggccgacatcagcggctacatccccaacggcgagtgggacctggtgggcatccccggcaagagaagcgagagattctacgagtgctgcaaggagccctaccccgacgtgaccttcaccgtgaccatgagaagaagaaccctgtactacggcctgaacctgctgatcccctgcgtgctgatcagcgccctggccctgctggtgttcctgctgcccgccgacagcggcgagaagatcagcctgggcatcaccgtgctgctgagcctgaccgtgttcatgctgctggtggccgagatcatgcccgccaccagcgacagcgtgcccctgatcgcccagtacttcgccagcaccatgatcatcgtgggcctgagcgtggtggtgaccgtgatcgtgctgcagtaccaccaccacgaccccgacggcggcaagatgcccaagtggaccagagtgatcctgctgaactggtgcgcctggttcctgagaatgaagagacccggcgaggacaaggtgagacccgcctgccagcacaagcagagaagatgcagcctggccagcgtggagatgagcgccgtggcccccccccccgccagcaacggcaacctgctgtacatcggcttcagaggcctggacggcgtgcactgcgtgcccacccccgacagcggcgtggtgtgcggcagaatggcctgcagccccacccacgacgagcacctgctgcacggcggccagccccccgagggcgaccccgacctggccaagatcctggaggaggtgagatacatcgccaacagattcagatgccaggacgagagcgaggccgtgtgcagcgagtggaagttcgccgcctgcgtggtggacagactgtgcctgatggccttcagcgtgttcaccatcatctgcaccatcggcatcctgatgagcgcccccaacttcgtggaggccgtgagcaaggacttcgcctag

SEQ ID NO: 76642 - DNA, 966 bp, Artificial Sequence
  Description of Artificial Sequence: Synthetic coding sequence
atgcaggaggccgacatcagcggctacatccccaacggcgagtgggacctggtgggcatccccggcaagagaagcgagagattctacgagtgctgcaaggagccctaccccgacgtgaccttcaccgtgaccatgagaagaagaaccctgtactacggcctgaacctgctgatcccctgcgtgctgatcagcgccctggccctgctggtgttcctgctgcccgccgacagcggcgagaagatcagcctgggcatcaccgtgctgctgagcctgaccgtgttcatgctgctggtggccgagatcatgcccgccaccagcgacagcgtgcccctgatcgcccagtacttcgccagcaccatgatcatcgtgggcctgagcgtggtggtgaccgtgatcgtgctgcagtaccaccaccacgaccccgacggcggcaagatgcccaagtggaccagagtgatcctgctgaactggtgcgcctggttcctgagaatgaagagacccggcgaggacaaggtgagacccgcctgccagcacaagcagagaagatgcagcctggccagcgtggagatgagcgccgtggcccccccccccgccagcaacggcaacctgctgtacatcggcttcagaggcctggacggcgtgcactgcgtgcccacccccgacagcggcgtggtgtgcggcagaatggcctgcagccccacccacgacgagcacctgctgcacggcggccagccccccgagggcgaccccgacctggccaagatcctggaggaggtgagatacatcgccaacagattcagatgccaggacgagagcgaggccgtgtgcagcgagtggaagttcgccgcctgcgtggtggacagactgtgcctgatggccttcagcgtgttcaccatcatctgcaccatcggcatcctgatgagcgcccccaacttcgtggaggccgtgagcaaggacttcgcctag

SEQ ID NO: 76643 - DNA, 1440 bp, Artificial Sequence
  Description of Artificial Sequence: Synthetic coding sequence
atgaactggagccacagctgcatcagcttctgctggatctacttcgccgccagcagactgagagccgccgagaccgccgacggcaagtacgcccagaagctgttcaacgacctgttcgaggactacagcaacgccctgagacccgtggaggacaccgacaaggtgctgaacgtgaccctgcagatcaccctgagccagatcaaggacatggacgagagaaaccagatcctgaccgcctacctgtggatcagacagatctggcacgacgcctacctgacctgggacagagaccagtacgacggcctggacagcatcagaatccccagcgacctggtgtggagacccgacatcgtgctgtacaacaaggccgacgacgagagcagcgagcccgtgaacaccaacgtggtgctgagatacgacggcctgatcacctgggacgcccccgccatcaccaagagcagctgcgtggtggacgtgacctacttccccttcgacaaccagcagtgcaacctgaccttcggcagctggacctacaacggcaaccaggtggacatcttcaacgccctggacagcggcgacctgagcgacttcatcgaggacgtggagtgggaggtgcacggcatgcccgccgtgaagaacgtgatcagctacggctgctgcagcgagccctaccccgacgtgaccttcaccctgctgctgaagagaagaagcagcttctacatcgtgaacctgctgatcccctgcgtgctgatcagcttcctggcccccctgagcttctacctgcccgccgccagcggcgagaaggtgagcctgggcgtgaccatcctgctggccatgaccgtgttccagctgatggtggccgagatcatgcccgccagcgagaacgtgcccctgatcggcaagtactacatcgccaccatggccctgatcaccgccagcaccgccctgaccatcatggtgatgaacatccacttctgcggcgccgaggccagacccgtgccccactgggccagagtggtgatcctgaagtacatgagcagagtgctgttcgtgtacgacgtgggcgagagctgcctgagcccccaccacagcagagagagagaccacctgaccaaggtgtacagcaagctgcccgagagcaacctgaaggccgccagaaacaaggacctgagcagaaagaaggacatgaacaagagactgaagaacgacctgggctgccagggcaagaacccccaggaggccgagagctactgcgcccagtacaaggtgctgaccagaaacatcgagtacatcgccaagtgcctgaaggaccacaaggccaccaacagcaagggcagcgagtggaagaaggtggccaaggtgatcgacagattcttcatgtggatcttcttcatcatggtgttcgtgatgaccatcctgatcatcgccagagccgactag

SEQ ID NO: 76644 - DNA, 1506 bp, Artificial Sequence
  Description of Artificial Sequence: Synthetic coding sequence
atgacccccggcgccctgctgatgctgctgggcgccctgggcgcccccctggcccccggcgtgagaggcagcgaggccgagggcagactgagagagaagctgttcagcggctacgacagcagcgtgagacccgccagagaggtgggcgacagagtgagagtgagcgtgggcctgatcctggcccagctgatcagcctgaacgagaaggacgaggagatgagcaccaaggtgtacctggacctggagtggaccgactacagactgagctgggaccccgccgagcacgacggcatcgacagcctgagaatcaccgccgagagcgtgtggctgcccgacgtggtgctgctgaacaacaacgacggcaacttcgacgtggccctggacatcagcgtggtggtgagcagcgacggcagcgtgagatggcagccccccggcatctacagaagcagctgcagcatccaggtgacctacttccccttcgactggcagaactgcaccatggtgttcagcagctacagctacgacagcagcgaggtgagcctgcagaccggcctgggccccgacggccagggccaccaggagatccacatccacgagggcaccttcatcgagaacggccagtgggagatcatccacaagcccagcagactgatccagccccccggcgaccccagaggcggcagagagggccagagacaggaggtgatcttctacctgatcatcagaagaaagcccctgttctacctggtgaacgtgatcgccccctgcatcctgatcaccctgctggccatcttcgtgttctacctgccccccgacgccggcgagaagatgggcctgagcatcttcgccctgctgaccctgaccgtgttcctgctgctgctggccgacaaggtgcccgagaccagcctgagcgtgcccatcatcatcaagtacctgatgttcaccatggtgctggtgaccttcagcgtgatcctgagcgtggtggtgctgaacctgcaccacagaagcccccacacccaccagatgcccctgtgggtgagacagatcttcatccacaagctgcccctgtacctgagactgaagagacccaagcccgagagagacctgatgcccgagcccccccactgcagcagccccggcagcggctggggcagaggcaccgacgagtacttcatcagaaagccccccagcgacttcctgttccccaagcccaacagattccagcccgagctgagcgcccccgacctgagaagattcatcgacggccccaacagagccgtggccctgctgcccgagctgagagaggtggtgagcagcatcagctacatcgccagacagctgcaggagcaggaggaccacgacgccctgaaggaggactggcagttcgtggccatggtggtggacagactgttcctgtggaccttcatcatcttcaccagcgtgggcaccctggtgatcttcctggacgccacctaccacctgcccccccccgaccccttcccctag

SEQ ID NO: 76645 - DNA, 1290 bp, Artificial Sequence
  Description of Artificial Sequence: Synthetic coding sequence
atgagcaccaaggtgtacctggacctggagtggaccgactacagactgagctgggaccccgccgagcacgacggcatcgacagcctgagaatcaccgccgagagcgtgtggctgcccgacgtggtgctgctgaacaacaacgacggcaacttcgacgtggccctggacatcagcgtggtggtgagcagcgacggcagcgtgagatggcagccccccggcatctacagaagcagctgcagcatccaggtgacctacttccccttcgactggcagaactgcaccatggtgttcagcagctacagctacgacagcagcgaggtgagcctgcagaccggcctgggccccgacggccagggccaccaggagatccacatccacgagggcaccttcatcgagaacggccagtgggagatcatccacaagcccagcagactgatccagccccccggcgaccccagaggcggcagagagggccagagacaggaggtgatcttctacctgatcatcagaagaaagcccctgttctacctggtgaacgtgatcgccccctgcatcctgatcaccctgctggccatcttcgtgttctacctgccccccgacgccggcgagaagatgggcctgagcatcttcgccctgctgaccctgaccgtgttcctgctgctgctggccgacaaggtgcccgagaccagcctgagcgtgcccatcatcatcaagtacctgatgttcaccatggtgctggtgaccttcagcgtgatcctgagcgtggtggtgctgaacctgcaccacagaagcccccacacccaccagatgcccctgtgggtgagacagatcttcatccacaagctgcccctgtacctgagactgaagagacccaagcccgagagagacctgatgcccgagcccccccactgcagcagccccggcagcggctggggcagaggcaccgacgagtacttcatcagaaagccccccagcgacttcctgttccccaagcccaacagattccagcccgagctgagcgcccccgacctgagaagattcatcgacggccccaacagagccgtggccctgctgcccgagctgagagaggtggtgagcagcatcagctacatcgccagacagctgcaggagcaggaggaccacgacgccctgaaggaggactggcagttcgtggccatggtggtggacagactgttcctgtggaccttcatcatcttcaccagcgtgggcaccctggtgatcttcctggacgccacctaccacctgcccccccccgaccccttcccctag

SEQ ID NO: 76646 - DNA, 1509 bp, Artificial Sequence
  Description of Artificial Sequence: Synthetic coding sequence
atggccagaagatgcggccccgtggccctgctgctgggcttcggcctgctgagactgtgcagcggcgtgtggggcaccgacaccgaggagagactggtggagcacctgctggaccccagcagatacaacaagctgatcagacccgccaccaacggcagcgagctggtgaccgtgcagctgatggtgagcctggcccagctgatcagcgtgcacgagagagagcagatcatgaccaccaacgtgtggctgacccaggagtgggaggactacagactgacctggaagcccgaggagttcgacaacatgaagaaggtgagactgcccagcaagcacatctggctgcccgacgtggtgctgtacaacaacgccgacggcatgtacgaggtgagcttctacagcaacgccgtggtgagctacgacggcagcatcttctggctgccccccgccatctacaagagcgcctgcaagatcgaggtgaagcacttccccttcgaccagcagaactgcaccatgaagttcagaagctggacctacgacagaaccgagatcgacctggtgctgaagagcgaggtggccagcctggacgacttcacccccagcggcgagtgggacatcgtggccctgcccggcagaagaaacgagaaccccgacgacagcacctacgtggacatcacctacgacttcatcatcagaagaaagcccctgttctacaccatcaacctgatcatcccctgcgtgctgatcaccagcctggccatcctggtgttctacctgcccagcgactgcggcgagaagatgaccctgtgcatcagcgtgctgctggccctgaccgtgttcctgctgctgatcagcaagatcgtgccccccaccagcctggacgtgcccctggtgggcaagtacctgatgttcaccatggtgctggtgaccttcagcatcgtgaccagcgtgtgcgtgctgaacgtgcaccacagaagccccaccacccacaccatggccccctgggtgaaggtggtgttcctggagaagctgcccgccctgctgttcatgcagcagcccagacaccactgcgccagacagagactgagactgagaagaagacagagagagagagagggcgccggcgccctgttcttcagagaggcccccggcgccgacagctgcacctgcttcgtgaacagagccagcgtgcagggcctggccggcgccttcggcgccgagcccgcccccgtggccggccccggcagaagcggcgagccctgcggctgcggcctgagagaggccgtggacggcgtgagattcatcgccgaccacatgagaagcgaggacgacgaccagagcgtgagcgaggactggaagtacgtggccatggtgatcgacagactgttcctgtggatcttcgtgttcgtgtgcgtgttcggcaccatcggcatgttcctgcagcccctgttccagaactacaccaccaccaccttcctgcacagcgaccacagcgcccccagcagcaagtag

SEQ ID NO: 76647 - DNA, 1377 bp, Artificial Sequence
  Description of Artificial Sequence: Synthetic coding sequence
atgctgcccgacttcatgctggtgctgatcgtgctgggcatccccagcagcgccaccaccggcttcaacagcatcgccgagaacgaggacgccctgctgagacacctgttccagggctaccagaagtgggtgagacccgtgctgcacagcaacgacaccatcaaggtgtacttcggcctgaagatcagccagctggtggacgtggacgagaagaaccagctgatgaccaccaacgtgtggctgaagcaggagtggaccgaccacaagctgagatggaaccccgacgactacggcggcatccacagcatcaaggtgcccagcgagagcctgtggctgcccgacatcgtgctgttcgagaacgccgacggcagattcgagggcagcctgatgaccaaggtgatcgtgaagagcaacggcaccgtggtgtggaccccccccgccagctacaagagcagctgcaccatggacgtgaccttcttccccttcgacagacagaactgcagcatgaagttcggcagctggacctacgacggcaccatggtggacctgatcctgatcaacgagaacgtggacagaaaggacttcttcgacaacggcgagtgggagatcctgaacgccaagggcatgaagggcaacagaagagacggcgtgtacagctaccccttcatcacctacagcttcgtgctgagaagactgcccctgttctacaccctgttcctgatcatcccctgcctgggcctgagcttcctgaccgtgctggtgttctacctgcccagcgacgagggcgagaagctgagcctgagcaccagcgtgctggtgagcctgaccgtgttcctgctggtgatcgaggagatcatccccagcagcagcaaggtgatccccctgatcggcgagtacctgctgttcatcatgatcttcgtgaccctgagcatcatcgtgaccgtgttcgtgatcaacgtgcaccacagaagcagcagcacctaccaccccatggccccctgggtgaagagactgttcctgcagaagctgcccaagctgctgtgcatgaaggaccacgtggacagatacagcagccccgagaaggaggagagccagcccgtggtgaagggcaaggtgctggagaagaagaagcagaagcagctgagcgacggcgagaaggtgctggtggccttcctggagaaggccgccgacagcatcagatacatcagcagacacgtgaagaaggagcacttcatcagccaggtggtgcaggactggaagttcgtggcccaggtgctggacagaatcttcctgtggctgttcctgatcgtgagcgtgaccggcagcgtgctgatcttcacccccgccctgaagatgtggctgcacagctaccactag

SEQ ID NO: 76648 - DNA, 1497 bp, Artificial Sequence
  Description of Artificial Sequence: Synthetic coding sequence
atgagaagagcccccagcctggtgctgttcttcctggtggccctgtgcggcagaggcaactgcagagtggccaacgccgaggagaagctgatggacgacctgctgaacaagaccagatacaacaacctgatcagacccgccaccagcagcagccagctgatcagcatcaagctgcagctgagcctggcccagctgatcagcgtgaacgagagagagcagatcatgaccaccaacgtgtggctgaagcaggagtggaccgactacagactgacctggaacagcagcagatacgagggcgtgaacatcctgagaatccccgccaagagaatctggctgcccgacatcgtgctgtacaacaacgccgacggcacctacgaggtgagcgtgtacaccaacctgatcgtgagaagcaacggcagcgtgctgtggctgccccccgccatctacaagagcgcctgcaagatcgaggtgaagtacttccccttcgaccagcagaactgcaccctgaagttcagaagctggacctacgaccacaccgagatcgacatggtgctgatgacccccaccgccagcatggacgacttcacccccagcggcgagtgggacatcgtggccctgcccggcagaagaaccgtgaacccccaggaccccagctacgtggacgtgacctacgacttcatcatcaagagaaagcccctgttctacaccatcaacctgatcatcccctgcgtgctgaccaccctgctggccatcctggtgttctacctgcccagcgactgcggcgagaagatgaccctgtgcatcagcgtgctgctggccctgaccttcttcctgctgctgatcagcaagatcgtgccccccaccagcctggacgtgcccctgatcggcaagtacctgatgttcaccatggtgctggtgaccttcagcatcgtgaccagcgtgtgcgtgctgaacgtgcaccacagaagccccagcacccacaccatggccccctgggtgaagagatgcttcctgcacaagctgcccaccttcctgttcatgaagagacccggccccgacagcagccccgccagagccttcccccccagcaagagctgcgtgaccaagcccgaggccaccgccaccagcaccagccccagcaacttctacggcaacagcatgtacttcgtgaaccccgccagcgccgccagcaagagccccgccggcagcacccccgtggccatccccagagacttctggctgagaagcagcggcagattcagacaggacgtgcaggaggccctggagggcgtgagcttcatcgcccagcacatgaagaacgacgacgaggaccagagcgtggtggaggactggaagtacgtggccatggtggtggacagactgttcctgtgggtgttcatgttcgtgtgcgtgctgggcaccgtgggcctgttcctgccccccctgttccagacccacgccgccagcgagggcccctacgccgcccagagagactag

SEQ ID NO: 76649 - DNA, 696 bp, Artificial Sequence
  Description of Artificial Sequence: Synthetic coding sequence
atgagaagagcccccagcctggtgctgttcttcctggtggccctgtgcggcagaggcaactgcagagtggccaacgccgaggagaagctgatggacgacctgctgaacaagaccagatacaacaacctgatcagacccgccaccagcagcagccagctgatcagcatcaagctgcagctgagcctggcccagctgatcagcgtgaacgagagagagcagatcatgaccaccaacgtgtggctgaagcaggagtggaccgactacagactgacctggaacagcagcagatacgagggcgtgaacatcctgagaatccccgccaagagaatctggctgcccgacatcgtgctgtacaacaagagcctgagaaccggcagcacctggctgtggtggtggaccggctgcagctgcggctgcagctgcctgtgcgccagctgggccctgtggggcagcagctacagacccagcagcagacccatgcagctgctgagaggccccaccctgcccagcgtgaccgagggccccctgggctgcggcgtgagaggctgcgagtggcccggcggccacttcgccgccagcttctgggtggtggccgacgaggccctgagcaagtacgtgagcatcggccaccagccccaccagaccagccacagcagaggcaccggcaaggacggcggcctgggctgccccctgtag

SEQ ID NO: 76650 - DNA, 1554 bp, Artificial Sequence
  Description of Artificial Sequence: Synthetic coding sequence
atggagggccccgtgctgaccctgggcctgctggccgccctggccgtgtgcggcagctggggcctgaacgaggaggagagactgatcagacacctgttccaggagaagggctacaacaaggagctgagacccgtggcccacaaggaggagagcgtggacgtggccctggccctgaccctgagcaacctgatcagcctgaaggaggtggaggagaccctgaccaccaacgtgtggatcgagcacggctggaccgacaacagactgaagtggaacgccgaggagttcggcaacatcagcgtgctgagactgccccccgacatggtgtggctgcccgagatcgtgctggagaacaacaacgacggcagcttccagatcagctacagctgcaacgtgctggtgtaccactacggcttcgtgtactggctgccccccgccatcttcagaagcagctgccccatcagcgtgacctacttccccttcgactggcagaactgcagcctgaagttcagcagcctgaagtacaccgccaaggagatcaccctgagcctgaagcaggacgccaaggagaacagaacctaccccgtggagtggatcatcatcgaccccgagggcttcaccgagaacggcgagtgggagatcgtgcacagacccgccagagtgaacgtggaccccagagcccccctggacagccccagcagacaggacatcaccttctacctgatcatcagaagaaagcccctgttctacatcatcaacatcctggtgccctgcgtgctgatcagcttcatggtgaacctggtgttctacctgcccgccgacagcggcgagaagaccagcgtggccatcagcgtgctgctggcccagagcgtgttcctgctgctgatcagcaagagactgcccgccaccagcatggccatccccctgatcggcaagttcctgctgttcggcatggtgctggtgaccatggtggtggtgatctgcgtgatcgtgctgaacatccacttcagaacccccagcacccacgtgctgagcgagggcgtgaagaagctgttcctggagaccctgcccgagctgctgcacatgagcagacccgccgaggacggccccagccccggcgccctggtgagaagaagcagcagcctgggctacatcagcaaggccgaggagtacttcctgctgaagagcagaagcgacctgatgttcgagaagcagagcgagagacacggcctggccagaagactgaccaccgccagaagaccccccgccagcagcgagcaggcccagcaggagctgttcaacgagctgaagcccgccgtggacggcgccaacttcatcgtgaaccacatgagagaccagaacaactacaacgaggagaaggacagctggaacagagtggccagaaccgtggacagactgtgcctgttcgtggtgacccccgtgatggtggtgggcaccgcctggatcttcctgcagggcgtgtacaaccagccccccccccagcccttccccggcgacccctacagctacaacgtgcaggacaagagattcatctag

SEQ ID NO: 76651 - DNA, 708 bp, Artificial Sequence
  Description of Artificial Sequence: Synthetic coding sequence
atggagggccccgtgctgaccctgggcctgctggccgccctggccgtgtgcggcagctggggcctgaacgaggaggagagactgatcagacacctgttccaggagaagggctacaacaaggagctgagacccgtggcccacaaggaggagagcgtggacgtggccctggccctgaccctgagcaacctgatcagcctgaaggaggtggaggagaccctgaccaccaacgtgtggatcgagcacggctggaccgacaacagactgaagtggaacgccgaggagttcggcaacatcagcgtgctgagactgccccccgacatggtgtggctgcccgagatcgtgctggagaacaacaacgacggcagcttccagatcagctacagctgcaacgtgctggtgtaccactacggcttcgtgtactggctgccccccgccatcttcagaagcagctgccccatcagcgtgacctacttccccttcgactggcagaactgcagcctgaagttcagagagagaggcgtgggcgacagcccccccgccggccagggccagagaggcccccagagccccagcggccagccccagccccccggccaccacctgctgccccaccaccccccccaggcccccctgctgcaccaccagcaccccggcgccctgagagcccacctgctgcacggccagcccggcctgctgcccaccggctag

SEQ ID NO: 76652 - DNA, 972 bp, Artificial Sequence
  Description of Artificial Sequence: Synthetic coding sequence
atgctgaagaacctggagaccagcgtgagctgcgccagccccagaacctggtgcggcagccagagactgtgctggagaaccaccatgaccgcccccagcagaagccccacccccgccacctgcctgagcaccaccaccgccagctgcaccggctgccacctgcccagcagcgccccccccgcccccagcctgagccccatcagccccagcaccggcagaaccgcccccagcagcagcggcggcgagaagaccagcgtggccatcagcgtgctgctggcccagagcgtgttcctgctgctgatcagcaagagactgcccgccaccagcatggccatccccctgatcggcaagttcctgctgttcggcatggtgctggtgaccatggtggtggtgatctgcgtgatcgtgctgaacatccacttcagaacccccagcacccacgtgctgagcgagggcgtgaagaagctgttcctggagaccctgcccgagctgctgcacatgagcagacccgccgaggacggccccagccccggcgccctggtgagaagaagcagcagcctgggctacatcagcaaggccgaggagtacttcctgctgaagagcagaagcgacctgatgttcgagaagcagagcgagagacacggcctggccagaagactgaccaccgccagaagaccccccgccagcagcgagcaggcccagcaggagctgttcaacgagctgaagcccgccgtggacggcgccaacttcatcgtgaaccacatgagagaccagaacaactacaacgaggagaaggacagctggaacagagtggccagaaccgtggacagactgtgcctgttcgtggtgacccccgtgatggtggtgggcaccgcctggatcttcctgcagggcgtgtacaaccagccccccccccagcccttccccggcgacccctacagctacaacgtgcaggacaagagattcatctag

SEQ ID NO: 76653 - DNA, 708 bp, Artificial Sequence; identical to SEQ ID NO: 76651
  Description of Artificial Sequence: Synthetic coding sequence

SEQ ID NO: 76654 - DNA, 1509 bp, Artificial Sequence
  Description of Artificial Sequence: Synthetic coding sequence
atggagggccccgtgctgaccctgggcctgctggccgccctggccgtgtgcggcagctggggcctgaacgaggaggagagactgatcagacacctgttccaggagaagggctacaacaaggagctgagacccgtggcccacaaggaggagagcgtggacgtggccctggccctgaccctgagcaacctgatcagcctgggctggaccgacaacagactgaagtggaacgccgaggagttcggcaacatcagcgtgctgagactgccccccgacatggtgtggctgcccgagatcgtgctggagaacaacaacgacggcagcttccagatcagctacagctgcaacgtgctggtgtaccactacggcttcgtgtactggctgccccccgccatcttcagaagcagctgccccatcagcgtgacctacttccccttcgactggcagaactgcagcctgaagttcagcagcctgaagtacaccgccaaggagatcaccctgagcctgaagcaggacgccaaggagaacagaacctaccccgtggagtggatcatcatcgaccccgagggcttcaccgagaacggcgagtgggagatcgtgcacagacccgccagagtgaacgtggaccccagagcccccctggacagccccagcagacaggacatcaccttctacctgatcatcagaagaaagcccctgttctacatcatcaacatcctggtgccctgcgtgctgatcagcttcatggtgaacctggtgttctacctgcccgccgacagcggcgagaagaccagcgtggccatcagcgtgctgctggcccagagcgtgttcctgctgctgatcagcaagagactgcccgccaccagcatggccatccccctgatcggcaagttcctgctgttcggcatggtgctggtgaccatggtggtggtgatctgcgtgatcgtgctgaacatccacttcagaacccccagcacccacgtgctgagcgagggcgtgaagaagctgttcctggagaccctgcccgagctgctgcacatgagcagacccgccgaggacggccccagccccggcgccctggtgagaagaagcagcagcctgggctacatcagcaaggccgaggagtacttcctgctgaagagcagaagcgacctgatgttcgagaagcagagcgagagacacggcctggccagaagactgaccaccgccagaagaccccccgccagcagcgagcaggcccagcaggagctgttcaacgagctgaagcccgccgtggacggcgccaacttcatcgtgaaccacatgagagaccagaacaactacaacgaggagaaggacagctggaacagagtggccagaaccgtggacagactgtgcctgttcgtggtgacccccgtgatggtggtgggcaccgcctggatcttcctgcagggcgtgtacaaccagccccccccccagcccttccccggcgacccctacagctacaacgtgcaggacaagagattcatctag

SEQ ID NO: 76655 - DNA, 1482 bp, Artificial Sequence
  Description of Artificial Sequence: Synthetic coding sequence
atggccagagcccccctgggcgtgctgctgctgctgggcctgctgggcagaggcgtgggcaagaacgaggagctgagactgtaccaccacctgttcaacaactacgaccccggcagcagacccgtgagagagcccgaggacaccgtgaccatcagcctgaaggtgaccctgaccaacctgatcagcctgaacgagaaggaggagaccctgaccaccagcgtgtggatcggcatcgactggcaggactacagactgaactacagcaaggacgacttcggcggcatcgagaccctgagagtgcccagcgagctggtgtggctgcccgagatcgtgctggagaacaacatcgacggccagttcggcgtggcctacgacgccaacgtgctggtgtacgagggcggcagcgtgacctggctgccccccgccatctacagaagcgtgtgcgccgtggaggtgacctacttccccttcgactggcagaactgcagcctgatcttcagaagccagacctacaacgccgaggaggtggagttcaccttcgccgtggacaacgacggcaagaccatcaacaagatcgacatcgacaccgaggcctacaccgagaacggcgagtgggccatcgacttctgccccggcgtgatcagaagacaccacggcggcgccaccgacggccccggcgagaccgacgtgatctacagcctgatcatcagaagaaagcccctgttctacgtgatcaacatcatcgtgccctgcgtgctgatcagcggcctggtgctgctggcctacttcctgcccgcccaggccggcggccagaagtgcaccgtgagcatcaacgtgctgctggcccagaccgtgttcctgttcctgatcgcccagaagatccccgagaccagcctgagcgtgcccctgctgggcagattcctgatcttcgtgatggtggtggccaccctgatcgtgatgaactgcgtgatcgtgctgaacgtgagccagagaacccccaccacccacgccatgagccccagactgagacacgtgctgctggagctgctgcccagactgctgggcagcccccccccccccgaggcccccagagccgccagcccccccagaagagccagcagcgtgggcctgctgctgagagccgaggagctgatcctgaagaagcccagaagcgagctggtgttcgagggccagagacacagacagggcacctggaccgccgccttctgccagagcctgggcgccgccgcccccgaggtgagatgctgcgtggacgccgtgaacttcgtggccgagagcaccagagaccaggaggccaccggcgaggaggtgagcgactgggtgagaatgggcaacgccctggacaacatctgcttctgggccgccctggtgctgttcagcgtgggcagcagcctgatcttcctgggcgcctacttcaacagagtgcccgacctgccctacgccccctgcatccagccctag

SEQ ID NO: 76656 - DNA, 1554 bp, Artificial Sequence
  Description of Artificial Sequence: Synthetic coding sequence
atgcacggcggccagggccccctgctgctgctgctgctgctggccgtgtgcctgggcgcccagggcagaaaccaggaggagagactgctggccgacctgatgcagaactacgaccccaacctgagacccgccgagagagacagcgacgtggtgaacgtgagcctgaagctgaccctgaccaacctgatcagcctgaacgagagagaggaggccctgaccaccaacgtgtggatcgagatgcagtggtgcgactacagactgagatgggaccccagagactacgagggcctgtgggtgctgagagtgcccagcaccatggtgtggagacccgacatcgtgctggagaacaacgtggacggcgtgttcgaggtggccctgtactgcaacgtgctggtgagccccgacggctgcatctactggctgccccccgccatcttcagaagcgcctgcagcatcagcgtgacctacttccccttcgactggcagaactgcagcctgatcttccagagccagacctacagcaccaacgagatcgacctgcagctgagccaggaggacggccagaccatcgagtggatcttcatcgaccccgaggccttcaccgagaacggcgagtgggccatccagcacagacccgccaagatgctgctggaccccgccgcccccgcccaggaggccggccaccagaaggtggtgttctacctgctgatccagagaaagcccctgttctacgtgatcaacatcatcgccccctgcgtgctgatcagcagcgtggccatcctgatccacttcctgcccgccaaggccggcggccagaagtgcaccgtggccatcaacgtgctgctggcccagaccgtgttcctgttcctggtggccaagaaggtgcccgagaccagccaggccgtgcccctgatcagcaagtacctgaccttcctgctggtggtgaccatcctgatcgtggtgaacgccgtggtggtgctgaacgtgagcctgagaagcccccacacccacagcatggccagaggcgtgagaaaggtgttcctgagactgctgccccagctgctgagaatgcacgtgagacccctggcccccgccgccgtgcaggacacccagagcagactgcagaacggcagcagcggctggagcatcaccaccggcgaggaggtggccctgtgcctgcccagaagcgagctgctgttccagcagtggcagagacagggcctggtggccgccgccctggagaagctggagaagggccccgagctgggcctgagccagttctgcggcagcctgaagcaggccgcccccgccatccaggcctgcgtggaggcctgcaacctgatcgcctgcgccagacaccagcagagccacttcgacaacggcaacgaggagtggttcctggtgggcagagtgctggacagagtgtgcttcctggccatgctgagcctgttcatctgcggcaccgccggcatcttcctgatggcccactacaacagagtgcccgccctgcccttccccggcgaccccagaccctacctgcccagccccgactag

SEQ ID NO: 76657 - DNA, 1554 bp, Artificial Sequence; identical to SEQ ID NO: 76656
  Description of Artificial Sequence: Synthetic coding sequence

SEQ ID NO: 76658 - DNA, 1080 bp, Artificial Sequence
  Description of Artificial Sequence: Synthetic coding sequence
atggtgagacccatgctgctgctgagcctgggcctgctggccggcctgctgcccgccctggccgcctgcccccagaactgccactgccacagcgacctgcagcacgtgatctgcgacaaggtgggcctgcagaagatccccaaggtgagcgagaagaccaagctgctgaacctgcagagaaacaacttccccgtgctggccgccaacagcttcagagccatgcccaacctggtgagcctgcacctgcagcactgccagatcagagaggtggccgccggcgccttcagaggcctgaagcagctgatctacctgtacctgagccacaacgacatcagagtgctgagagccggcgccttcgacgacctgaccgagctgacctacctgtacctggaccacaacaaggtgaccgagctgcccagaggcctgctgagccccctggtgaacctgttcatcctgcagctgaacaacaacaagatcagagagctgagagccggcgccttccagggcgccaaggacctgagatggctgtacctgagcgagaacgccctgagcagcctgcagcccggcgccctggacgacgtggagaacctggccaagttccacgtggacagaaaccagctgagcagctaccccagcgccgccctgagcaagctgagagtggtggaggagctgaagctgagccacaaccccctgaagagcatccccgacaacgccttccagagcttcggcagatacctggagaccctgtggctggacaacaccaacctggagaagttcagcgacggcgccttcctgggcgtgaccaccctgaagcacgtgcacctggagaacaacagactgaaccagctgcccagcaacttccccttcgacagcctggagaccctggccctgaccaacaacccctggaagtgcacctgccagctgagaggcctgagaagatggctggaggccaaggccagcagacccgacgccacctgcgccagccccgccaagttcaagggccagcacatcagagacaccgacgccttcagaagctgcaagttccccaccaagagaagcaagaaggccggcagacactag

SEQ ID NO: 76659 - DNA, 129 bp, Artificial Sequence
  Description of Artificial Sequence: Synthetic coding sequence
tgagccagcagacccgacgccacctgcgccagccccgccaagttcaagggccagcacatcagagacaccgacgccttcagaagctgcaagttccccaccaagagaagcaagaaggccggcagacactag

SEQ ID NO: 76660 - DNA, 1080 bp, Artificial Sequence; identical to SEQ ID NO: 76658
  Description of Artificial Sequence: Synthetic coding sequence

SEQ ID NO: 76661 - DNA, 2328 bp, Artificial Sequence
  Description of Artificial Sequence: Synthetic coding sequence
atgagagccagcctgctgctgagcgtgctgagacccgccggccccgtggccgtgggcatcagcctgggcttcaccctgagcctgctgagcgtgacctgggtggaggagccctgcggccccggccccccccagcccggcgacagcgagctgccccccagaggcaacaccaacgccgccagaagacccaacagcgtgcagcccggcgccgagagagagaagcccggcgccggcgagggcgccggcgagaactgggagcccagagtgctgccctaccaccccgcccagcccggccaggccgccaagaaggccgtgagaaccagatacatcagcaccgagctgggcatcagacagagactgctggtggccgtgctgaccagccagaccaccctgcccaccctgggcgtggccgtgaacagaaccctgggccacagactggagagagtggtgttcctgaccggcgccagaggcagaagagccccccccggcatggccgtggtgaccctgggcgaggagagacccatcggccacctgcacctggccctgagacacctgctggagcagcacggcgacgacttcgactggttcttcctggtgcccgacaccacctacaccgaggcccacggcctggccagactgaccggccacctgagcctggccagcgccgcccacctgtacctgggcagaccccaggacttcatcggcggcgagcccacccccggcagatactgccacggcggcttcggcgtgctgctgagcagaatgctgctgcagcagctgagaccccacctggagggctgcagaaacgacatcgtgagcgccagacccgacgagtggctgggcagatgcatcctggacgccaccggcgtgggctgcaccggcgaccacgagggcgtgcactacagccacctggagctgagccccggcgagcccgtgcaggagggcgacccccacttcagaagcgccctgaccgcccaccccgtgagagaccccgtgcacatgtaccagctgcacaaggccttcgccagagccgagctggagagaacctaccaggagatccaggagctgcagtgggagatccagaacaccagccacctggccgtggacggcgaccaggccgccgcctggcccgtgggcatccccgcccccagcagacccgccagcagattcgaggtgctgagatgggactacttcaccgagcagcacgccttcagctgcgccgacggcagccccagatgccccctgagaggcgccgacagagccgacgtggccgacgtgctgggcaccgccctggaggagctgaacagaagataccaccccgccctgagactgcagaagcagcagctggtgaacggctacagaagattcgaccccgccagaggcatggagtacaccctggacctgcagctggaggccctgaccccccagggcggcagaagacccctgaccagaagagtgcagctgctgagacccctgagcagagtggagatcctgcccgtgccctacgtgaccgaggccagcagactgaccgtgctgctgcccctggccgccgccgagagagacctggcccccggcttcctggaggccttcgccaccgccgccctggagcccggcgacgccgccgccgccctgaccctgctgctgctgtacgagcccagacaggcccagagagtggcccacgccgacgtgttcgcccccgtgaaggcccacgtggccgagctggagagaagattccccggcgccagagtgccctggctgagcgtgcagaccgccgcccccagccccctgagactgatggacctgctgagcaagaagcaccccctggacaccctgttcctgctggccggccccgacaccgtgctgacccccgacttcctgaacagatgcagaatgcacgccatcagcggctggcaggccttcttccccatgcacttccaggccttccaccccgccgtggcccccccccagggccccggcccccccgagctgggcagagacaccggcagattcgacagacaggccgccagcgaggcctgcttctacaacagcgactacgtggccgccagaggcagactggccgccgccagcgagcaggaggaggagctgctggagagcctggacgtgtacgagctgttcctgcacttcagcagcctgcacgtgctgagagccgtggagcccgccctgctgcagagatacagagcccagacctgcagcgccagactgagcgaggacctgtaccacagatgcctgcagagcgtgctggagggcctgggcagcagaacccagctggccatgctgctgttcgagcaggagcagggcaacagcacctag

SEQ ID NO: 76662 - DNA, 1842 bp, Artificial Sequence
  Description of Artificial Sequence: Synthetic coding sequence
atggccgtggtgaccctgggcgaggagagacccatcggccacctgcacctggccctgagacacctgctggagcagcacggcgacgacttcgactggttcttcctggtgcccgacaccacctacaccgaggcccacggcctggccagactgaccggccacctgagcctggccagcgccgcccacctgtacctgggcagaccccaggacttcatcggcggcgagcccacccccggcagatactgccacggcggcttcggcgtgctgctgagcagaatgctgctgcagcagctgagaccccacctggagggctgcagaaacgacatcgtgagcgccagacccgacgagtggctgggcagatgcatcctggacgccaccggcgtgggctgcaccggcgaccacgagggcgtgcactacagccacctggagctgagccccggcgagcccgtgcaggagggcgacccccacttcagaagcgccctgaccgcccaccccgtgagagaccccgtgcacatgtaccagctgcacaaggccttcgccagagccgagctggagagaacctaccaggagatccaggagctgcagtgggagatccagaacaccagccacctggccgtggacggcgaccaggccgccgcctggcccgtgggcatccccgcccccagcagacccgccagcagattcgaggtgctgagatgggactacttcaccgagcagcacgccttcagctgcgccgacggcagccccagatgccccctgagaggcgccgacagagccgacgtggccgacgtgctgggcaccgccctggaggagctgaacagaagataccaccccgccctgagactgcagaagcagcagctggtgaacggctacagaagattcgaccccgccagaggcatggagtacaccctggacctgcagctggaggccctgaccccccagggcggcagaagacccctgaccagaagagtgcagctgctgagacccctgagcagagtggagatcctgcccgtgccctacgtgaccgaggccagcagactgaccgtgctgctgcccctggccgccgccgagagagacctggcccccggcttcctggaggccttcgccaccgccgccctggagcccggcgacgccgccgccgccctgaccctgctgctgctgtacgagcccagacaggcccagagagtggcccacgccgacgtgttcgcccccgtgaaggcccacgtggccgagctggagagaagattccccggcgccagagtgccctggctgagcgtgcagaccgccgcccccagccccctgagactgatggacctgctgagcaagaagcaccccctggacaccctgttcctgctggccggccccgacaccgtgctgacccccgacttcctgaacagatgcagaatgcacgccatcagcggctggcaggccttcttccccatgcacttccaggccttccaccccgccgtggcccccccccagggccccggcccccccgagctgggcagagacaccggcagattcgacagacaggccgccagcgaggcctgcttctacaacagcgactacgtggccgccagaggcagactggccgccgccagcgagcaggaggaggagctgctggagagcctggacgtgtacgagctgttcctgcacttcagcagcctgcacgtgctgagagccgtggagcccgccctgctgcagagatacagagcccagacctgcagcgccagactgagcgaggacctgtaccacagatgcctgcagagcgtgctggagggcctgggcagcagaacccagctggccatgctgctgttcgagcaggagcagggcaacagcacctag

SEQ ID NO: 76663 - DNA, 2319 bp, Artificial Sequence
  Description of Artificial Sequence: Synthetic coding sequence
atgagactgagcagcctgctggccctgctgagacccgccctgcccctgatcctgggcctgagcctgggctgcagcctgagcctgctgagagtgagctggatccagggcgagggcgaggacccctgcgtggaggccgtgggcgagagaggcggcccccagaaccccgacagcagagccagactggaccagagcgacgaggacttcaagcccagaatcgtgccctactacagagaccccaacaagccctacaagaaggtgctgagaaccagatacatccagaccgagctgggcagcagagagagactgctggtggccgtgctgaccagcagagccaccctgagcaccctggccgtggccgtgaacagaaccgtggcccaccacttccccagactgctgtacttcaccggccagagaggcgccagagcccccgccggcatgcaggtggtgagccacggcgacgagagacccgcctggctgatgagcgagaccctgagacacctgcacacccacttcggcgccgactacgactggttcttcatcatgcaggacgacacctacgtgcaggcccccagactggccgccctggccggccacctgagcatcaaccaggacctgtacctgggcagagccgaggagttcatcggcgccggcgagcaggccagatactgccacggcggcttcggctacctgctgagcagaagcctgctgctgagactgagaccccacctggacggctgcagaggcgacatcctgagcgccagacccgacgagtggctgggcagatgcctgatcgacagcctgggcgtgggctgcgtgagccagcaccagggccagcagtacagaagcttcgagctggccaagaacagagaccccgagaaggagggcagcagcgccttcctgagcgccttcgccgtgcaccccgtgagcgagggcaccctgatgtacagactgcacaagagattcagcgccctggagctggagagagcctacagcgagatcgagcagctgcaggcccagatcagaaacctgaccgtgctgacccccgagggcgaggccggcctgagctggcccgtgggcctgcccgcccccttcaccccccacagcagattcgaggtgctgggctgggactacttcaccgagcagcacaccttcagctgcgccgacggcgcccccaagtgccccctgcagggcgccagcagagccgacgtgggcgacgccctggagaccgccctggagcagctgaacagaagataccagcccagactgagattccagaagcagagactgctgaacggctacagaagattcgaccccgccagaggcatggagtacaccctggacctgctgctggagtgcgtgacccagagaggccacagaagagccctggccagaagagtgagcctgctgagacccctgagcagagtggagatcctgcccatgccctacgtgaccgaggccaccagagtgcagctggtgctgcccctgctggtggccgaggccgccgccgcccccgccttcctggaggccttcgccgccaacgtgctggagcccagagagcacgccctgctgaccctgctgctggtgtacggccccagagagggcggcagaggcgcccccgaccccttcctgggcgtgaaggccgccgccgccgagctggagagaagataccccggcaccagactggcctggctggccgtgagagccgaggcccccagccaggtgagactgatggacgtggtgagcaagaagcaccccgtggacaccctgttcttcctgaccaccgtgtggaccagacccggccccgaggtgctgaacagatgcagaatgaacgccatcagcggctggcaggccttcttccccgtgcacttccaggagttcaaccccgccctgagcccccagagaagcccccccggcccccccggcgccggccccgacccccccagcccccccggcgccgaccccagcagaggcgcccccatcggcggcagattcgacagacaggccagcgccgagggctgcttctacaacgccgactacctggccgccagagccagactggccggcgagctggccggccaggaggaggaggaggccctggagggcctggaggtgatggacgtgttcctgagattcagcggcctgcacctgttcagagccgtggagcccggcctggtgcagaagttcagcctgagagactgcagccccagactgagcgaggagctgtaccacagatgcagactgagcaacctggagggcctgggcggcagagcccagctggccatggccctgttcgagcaggagcaggccaacagcacctag

SEQ ID NO: 76664 - DNA, 2004 bp, Artificial Sequence
  Description of Artificial Sequence: Synthetic coding sequence
atgagactgagcagcctgctggccctgctgagacccgccctgcccctgatcctgggcctgagcctgggctgcagcctgagcctgctgagagtgagctggatccagggcgagggcgaggacccctgcgtggaggccgtgggcgagagaggcggcccccagaaccccgacagcagagccagactggaccagagcgacgaggacttcaagcccagaatcgtgccctactacagagaccccaacaagccctacaagaaggtgctgagaaccagatacatccagaccgagctgggcagcagagagagactgctggtggccgtgctgaccagcagagccaccctgagcaccctggccgtggccgtgaacagaaccgtggcccaccacttccccagactgctgtacttcaccggccagagaggcgccagagcccccgccggcatgcaggtggtgagccacggcgacgagagacccgcctggctgatgagcgagaccctgagacacctgcacacccacttcggcgccgactacgactggttcttcatcatgcaggacgacacctacgtgcaggcccccagactggccgccctggccggccacctgagcatcaaccaggacctgtacctgggcagagccgaggagttcatcggcgccggcgagcaggccagatactgccacggcggcttcggctacctgctgagcagaagcctgctgctgagactgagaccccacctggacggctgcagaggcgacatcctgagcgccagacccgacgagtggctgggcagatgcctgatcgacagcctgggcgtgggctgcgtgagccagcaccagggccagcagtacagaagcttcgagctggccaagaacagagaccccgagaaggagggcagcagcgccttcctgagcgccttcgccgtgcaccccgtgagcgagggcaccctgatgtacagactgcacaagagattcagcgccctggagctggagagagcctacagcgagatcgagcagctgcaggcccagatcagaaacctgaccgtgctgacccccgagggcgaggccggcctgagctggcccgtgggcctgcccgcccccttcaccccccacagcagattcgaggtgctgggctgggactacttcaccgagcagcacaccttcagctgcgccgacggcgcccccaagtgccccctgcagggcgccagcagagccgacgtgggcgacgccctggagaccgccctggagcagctgaacagaagataccagcccagactgagattccagaagcagagactgctgaacggctacagaagattcgaccccgccagaggcatggagtacaccctggacctgctgctggagtgcgtgacccagagaggccacagaagagccctggccagaagagtgagcctgctgagacccctgagcagagtggagatcctgcccatgccctacgtgaccgaggccaccagagtgcagctggtgctgcccctgctggtggccgaggccgccgccgcccccgccttcctggaggccttcgccgccaacgtgctggagcccagagagcacgccctgctgaccctgctgctggtgtacggccccagagagggcggcagaggcgcccccgaccccttcctgggcgtgaaggccgccgccgccgagctggagagaagataccccggcaccagactggcctggctggccgtgagagccgaggcccccagccaggtgagactgatggacgtggtgagcaagaagcaccccgtggacaccctgttcttcctgaccaccgtgtggaccagacccggccccgaggtgctgaacagatgcagaatgaacgccatcagcggctggcaggccttcttccccgtgcacttccaggagttcaaccccgccctgagcccccagagaagccccccccccaacctgatcaccttccccctgagcgccagcgcccccggcagagccagacaggacggcggccagatcgagaactgctgctgcatcttctag

SEQ ID NO: 76665 - DNA, 6969 bp, Artificial Sequence
  Description of Artificial Sequence: Synthetic coding sequence
atgcagagcggccccagaccccccctgcccgcccccggcctggccctggccctgaccctgaccatgctggccagactggccagcgccgccagcttcttcggcgagaaccacctggaggtgcccgtggccaccgccctgaccgacatcgacctgcagctgcagttcagcaccagccagcccgaggccctgctgctgctggccgccggccccgccgaccacctgctgctgcagctgtacagcggcagactgcaggtgagactggtgctgggccaggaggagctgagactgcagacccccgccgagaccctgctgagcgacagcatcccccacaccgtggtgctgaccgtggtggagggctgggccaccctgagcgtggacggcttcctgaacgccagcagcgccgtgcccggcgcccccctggaggtgccctacggcctgttcgtgggcggcaccggcaccctgggcctgccctacctgagaggcaccagcagacccctgagaggctgcctgcacgccgccaccctgaacggcagaagcctgctgagacccctgacccccgacgtgcacgagggctgcgccgaggagttcagcgccagcgacgacgtggccctgggcttcagcggcccccacagcctggccgccttccccgcctggggcacccaggacgagggcaccctggagttcaccctgaccacccagagcagacaggcccccctggccttccaggccggcggcagaagaggcgacttcatctacgtggacatcttcgagggccacctgagagccgtggtggagaagggccagggcaccgtgctgctgcacaacagcgtgcccgtggccgacggccagccccacgaggtgagcgtgcacatcaacgcccacagactggagatcagcgtggaccagtaccccacccacaccagcaacagaggcgtgctgagctacctggagcccagaggcagcctgctgctgggcggcctggacgccgaggccagcagacacctgcaggagcacagactgggcctgacccccgaggccaccaacgccagcctgctgggctgcatggaggacctgagcgtgaacggccagagaagaggcctgagagaggccctgctgaccagaaacatggccgccggctgcagactggaggaggaggagtacgaggacgacgcctacggccactacgaggccttcagcaccctggcccccgaggcctggcccgccatggagctgcccgagccctgcgtgcccgagcccggcctgccccccgtgttcgccaacttcacccagctgctgaccatcagccccctggtggtggccgagggcggcaccgcctggctggagtggagacacgtgcagcccaccctggacctgatggaggccgagctgagaaagagccaggtgctgttcagcgtgaccagaggcgccagacacggcgagctggagctggacatccccggcgcccaggccagaaagatgttcaccctgctggacgtggtgaacagaaaggccagattcatccacgacggcagcgaggacaccagcgaccagctggtgctggaggtgagcgtgaccgccagagtgcccatgcccagctgcctgagaagaggccagacctacctgctgcccatccaggtgaaccccgtgaacgaccccccccacatcatcttcccccacggcagcctgatggtgatcctggagcacacccagaagcccctgggccccgaggtgttccaggcctacgaccccgacagcgcctgcgagggcctgaccttccaggtgctgggcaccagcagcggcctgcccgtggagagaagagaccagcccggcgagcccgccaccgagttcagctgcagagagctggaggccggcagcctggtgtacgtgcacagaggcggccccgcccaggacctgaccttcagagtgagcgacggcctgcaggccagcccccccgccaccctgaaggtggtggccatcagacccgccatccagatccacagaagcaccggcctgagactggcccagggcagcgccatgcccatcctgcccgccaacctgagcgtggagaccaacgccgtgggccaggacgtgagcgtgctgttcagagtgaccggcgccctgcagttcggcgagctgcagaagcagggcgccggcggcgtggagggcgccgagtggtgggccacccaggccttccaccagagagacgtggagcagggcagagtgagatacctgagcaccgacccccagcaccacgcctacgacaccgtggagaacctggccctggaggtgcaggtgggccaggagatcctgagcaacctgagcttccccgtgaccatccagagagccaccgtgtggatgctgagactggagcccctgcacacccagaacacccagcaggagaccctgaccaccgcccacctggaggccaccctggaggaggccggccccagcccccccaccttccactacgaggtggtgcaggcccccagaaagggcaacctgcagctgcagggcaccagactgagcgacggccagggcttcacccaggacgacatccaggccggcagagtgacctacggcgccaccgccagagccagcgaggccgtggaggacaccttcagattcagagtgaccgcccccccctacttcagccccctgtacaccttccccatccacatcggcggcgaccccgacgcccccgtgctgaccaacgtgctgctggtggtgcccgagggcggcgagggcgtgctgagcgccgaccacctgttcgtgaagagcctgaacagcgccagctacctgtacgaggtgatggagagacccagacacggcagactggcctggagaggcacccaggacaagaccaccatggtgaccagcttcaccaacgaggacctgctgagaggcagactggtgtaccagcacgacgacagcgagaccaccgaggacgacatccccttcgtggccaccagacagggcgagagcagcggcgacatggcctgggaggaggtgagaggcgtgttcagagtggccatccagcccgtgaacgaccacgcccccgtgcagaccatcagcagaatcttccacgtggccagaggcggcagaagactgctgaccaccgacgacgtggccttcagcgacgccgacagcggcttcgccgacgcccagctggtgctgaccagaaaggacctgctgttcggcagcatcgtggccgtggacgagcccaccagacccatctacagattcacccaggaggacctgagaaagagaagagtgctgttcgtgcacagcggcgccgacagaggctggatccagctgcaggtgagcgacggccagcaccaggccaccgccctgctggaggtgcaggccagcgagccctacctgagagtggccaacggcagcagcctggtggtgccccagggcggccagggcaccatcgacaccgccgtgctgcacctggacaccaacctggacatcagaagcggcgacgaggtgcactaccacgtgaccgccggccccagatggggccagctggtgagagccggccagcccgccaccgccttcagccagcaggacctgctggacggcgccgtgctgtacagccacaacggcagcctgagccccagagacaccatggccttcagcgtggaggccggccccgtgcacaccgacgccaccctgcaggtgaccatcgccctggagggccccctggcccccctgaagctggtgagacacaagaagatctacgtgttccagggcgaggccgccgagatcagaagagaccagctggaggccgcccaggaggccgtgccccccgccgacatcgtgttcagcgtgaagagcccccccagcgccggctacctggtgatggtgagcagaggcgccctggccgacgagccccccagcctggaccccgtgcagagcttcagccaggaggccgtggacaccggcagagtgctgtacctgcacagcagacccgaggcctggagcgacgccttcagcctggacgtggccagcggcctgggcgcccccctggagggcgtgctggtggagctggaggtgctgcccgccgccatccccctggaggcccagaacttcagcgtgcccgagggcggcagcctgaccctggccccccccctgctgagagtgagcggcccctacttccccaccctgctgggcctgagcctgcaggtgctggagcccccccagcacggcgccctgcagaaggaggacggcccccaggccagaaccctgagcgccttcagctggagaatggtggaggagcagctgatcagatacgtgcacgacggcagcgagaccctgaccgacagcttcgtgctgatggccaacgccagcgagatggacagacagagccaccccgtggccttcaccgtgaccgtgctgcccgtgaacgaccagccccccatcctgaccaccaacaccggcctgcagatgtgggagggcgccaccgcccccatccccgccgaggccctgagaagcaccgacggcgacagcggcagcgaggacctggtgtacaccatcgagcagcccagcaacggcagagtggtgctgagaggcgcccccggcaccgaggtgagaagcttcacccaggcccagctggacggcggcctggtgctgttcagccacagaggcaccctggacggcggcttcagattcagactgagcgacggcgagcacaccagccccggccacttcttcagagtgaccgcccagaagcaggtgctgctgagcctgaagggcagccagaccctgaccgtgtgccccggcagcgtgcagcccctgagcagccagaccctgagagccagcagcagcgccggcaccgacccccagctgctgctgtacagagtggtgagaggcccccagctgggcagactgttccacgcccagcaggacagcaccggcgaggccctggtgaacttcacccaggccgaggtgtacgccggcaacatcctgtacgagcacgagatgccccccgagcccttctgggaggcccacgacaccctggagctgcagctgagcagcccccccgccagagacgtggccgccaccctggccgtggccgtgagcttcgaggccgcctgcccccagagacccagccacctgtggaagaacaagggcctgtgggtgcccgagggccagagagccagaatcaccgtggccgccctggacgccagcaacctgctggccagcgtgcccagcccccagagaagcgagcacgacgtgctgttccaggtgacccagttccccagcagaggccagctgctggtgagcgaggagcccctgcacgccggccagccccacttcctgcagagccagctggccgccggccagctggtgtacgcccacggcggcggcggcacccagcaggacggcttccacttcagagcccacctgcagggccccgccggcgccagcgtggccggcccccagaccagcgaggccttcgccatcaccgtgagagacgtgaacgagagacccccccagccccaggccagcgtgcccctgagactgaccagaggcagcagagcccccatcagcagagcccagctgagcgtggtggaccccgacagcgcccccggcgagatcgagtacgaggtgcagagagccccccacaacggcttcctgagcctggtgggcggcggcctgggccccgtgaccagattcacccaggccgacgtggacagcggcagactggccttcgtggccaacggcagcagcgtggccggcatcttccagctgagcatgagcgacggcgccagcccccccctgcccatgagcctggccgtggacatcctgcccagcgccatcgaggtgcagctgagagcccccctggaggtgccccaggccctgggcagaagcagcctgagccagcagcagctgagagtggtgagcgacagagaggagcccgaggccgcctacagactgatccagggcccccagtacggccacctgctggtgggcggcagacccaccagcgccttcagccagttccagatcgaccagggcgaggtggtgttcgccttcaccaacttcagcagcagccacgaccacttcagagtgctggccctggccagaggcgtgaacgccagcgccgtggtgaacgtgaccgtgagagccctgctgcacgtgtgggccggcggcccctggccccagggcgccaccctgagactggaccccaccgtgctggacgccggcgagctggccaacagaaccggcagcgtgcccagattcagactgctggagggccccagacacggcagagtggtgagagtgcccagagccagaaccgagcccggcggcagccagctggtggagcagttcacccagcaggacctggaggacggcagactgggcctggaggtgggcagacccgagggcagagcccccggccccgccggcgacagcctgaccctggagctgtgggcccagggcgtgccccccgccgtggccagcctggacttcgccaccgagccctacaacgccgccagaccctacagcgtggccctgctgagcgtgcccgaggccgccagaaccgaggccggcaagcccgagagcagcacccccaccggcgagcccggccccatggccagcagccccgagcccgccgtggccaagggcggcttcctgagcttcctggaggccaacatgttcagcgtgatcatccccatgtgcctggtgctgctgctgctggccctgatcctgcccctgctgttctacctgagaaagagaaacaagaccggcaagcacgacgtgcaggtgctgaccgccaagcccagaaacggcctggccggcgacaccgagaccttcagaaaggtggagcccggccaggccatccccctgaccgccgtgcccggccagggccccccccccggcggccagcccgaccccgagctgctgcagttctgcagaacccccaaccccgccctgaagaacggccagtactgggtgtag

SEQ ID NO: 76666 - DNA, 984 bp, Artificial Sequence
  Description of Artificial Sequence: Synthetic coding sequence
gagcagcacagagaggagcccgaggccgcctacagactgatccagggcccccagtacggccacctgctggtgggcggcagacccaccagcgccttcagccagttccagatcgaccagggcgaggtggtgttcgccttcaccaacttcagcagcagccacgaccacttcagagtgctggccctggccagaggcgtgaacgccagcgccgtggtgaacgtgaccgtgagagccctgctgcacgtgtgggccggcggcccctggccccagggcgccaccctgagactggaccccaccgtgctggacgccggcgagctggccaacagaaccggcagcgtgcccagattcagactgctggagggccccagacacggcagagtggtgagagtgcccagagccagaaccgagcccggcggcagccagctggtggagcagttcacccagcaggacctggaggacggcagactgggcctggaggtgggcagacccgagggcagagcccccggccccgccggcgacagcctgaccctggagctgtgggcccagggcgtgccccccgccgtggccagcctggacttcgccaccgagccctacaacgccgccagaccctacagcgtggccctgctgagcgtgcccgaggccgccagaaccgaggccggcaagcccgagagcagcacccccaccggcgagcccggccccatggccagcagccccgagcccgccgtggccaagggcggcttcctgagcttcctggaggccaacatgttcagcgtgatcatccccatgtgcctggtgctgctgctgctggccctgatcctgcccctgctgttctacctgagaaagagaaacaagaccggcaagcacgacgtgcaggtgctgaccgccaagcccagaaacggcctggccggcgacaccgagaccttcagaaaggtggagcccggccaggccatccccctgaccgccgtgcccggccagggccccccctag

SEQ ID NO: 76667 - DNA, 2409 bp, Artificial Sequence
  Description of Artificial Sequence: Synthetic coding sequence
atggccgccagaggcagaagagcctggctgagcgtgctgctgggcctggtgctgggcttcgtgctggccagcagactggtgctgcccagagccagcgagctgaagagagccggccccagaagaagagccagccccgagggctgcagaagcggccaggccgccgccagccaggccggcggcgccagaggcgacgccagaggcgcccagctgtggccccccggcagcgaccccgacggcggccccagagacagaaacttcctgttcgtgggcgtgatgaccgcccagaagtacctgcagaccagagccgtggccgcctacagaacctggagcaagaccatccccggcaaggtgcagttcttcagcagcgagggcagcgacaccagcgtgcccatccccgtggtgcccctgagaggcgtggacgacagctaccccccccagaagaagagcttcatgatgctgaagtacatgcacgaccactacctggacaagtacgagtggttcatgagagccgacgacgacgtgtacatcaagggcgacagactggagaacttcctgagaagcctgaacagcagcgagcccctgttcctgggccagaccggcctgggcaccaccgaggagatgggcaagctggccctggagcccggcgagaacttctgcatgggcggccccggcgtgatcatgagcagagaggtgctgagaagaatggtgccccacatcggcaagtgcctgagagagatgtacaccacccacgaggacgtggaggtgggcagatgcgtgagaagattcgccggcgtgcagtgcgtgtggagctacgagatgcagcagctgttctacgagaactacgagcagaacaagaagggctacatcagagacctgcacaacagcaagatccaccaggccatcaccctgcaccccaacaagaaccccccctaccagtacagactgcacagctacatgctgagcagaaagatcagcgagctgagacacagaaccatccagctgcacagagagatcgtgctgatgagcaagtacagcaacaccgagatccacaaggaggacctgcagctgggcatcccccccagcttcatgagattccagcccagacagagagaggagatcctggagtgggagttcctgaccggcaagtacctgtacagcgccgtggacggccagccccccagaagaggcatggacagcgcccagagagaggccctggacgacatcgtgatgcaggtgatggagatgatcaacgccaacgccaagaccagaggcagaatcatcgacttcaaggagatccagtacggctacagaagagtgaaccccatgtacggcgccgagtacatcctggacctgctgctgctgtacaagaagcacaagggcaagaagatgaccgtgcccgtgagaagacacgcctacctgcagcagaccttcagcaagatccagttcgtggagcacgaggagctggacgcccaggagctggccaagagaatcaaccaggagagcggcagcctgagcttcctgagcaacagcctgaagaagctggtgcccttccagctgcccggcagcaagagcgagcacaaggagcccaaggacaagaagatcaacatcctgatccccctgagcggcagattcgacatgttcgtgagattcatgggcaacttcgagaagacctgcctgatccccaaccagaacgtgaagctggtggtgctgctgttcaacagcgacagcaaccccgacaaggccaagcaggtggagctgatgagagactacagaatcaagtaccccaaggccgacatgcagatcctgcccgtgagcggcgagttcagcagagccctggccctggaggtgggcagcagccagttcaacaacgagagcctgctgttcttctgcgacgtggacctggtgttcaccaccgagttcctgcagagatgcagagccaacaccgtgctgggccagcagatctacttccccatcatcttcagccagtacgaccccaagatcgtgtacagcggcaaggtgcccagcgacaaccacttcgccttcacccagaagaccggcttctggagaaactacggcttcggcatcacctgcatctacaagggcgacctggtgagagtgggcggcttcgacgtgagcatccagggctggggcctggaggacgtggacctgttcaacaaggtggtgcaggccggcctgaagaccttcagaagccaggaggtgggcgtggtgcacgtgcaccaccccgtgttctgcgaccccaacctggaccccaagcagtacaagatgtgcctgggcagcaaggccagcacctacggcagcacccagcagctggccgagatgtggctggagaagaacgaccccagctacagcaagagcagcaacaacaacggcagcgtgagaaccgcctag

SEQ ID NO: 76668 - DNA, 2649 bp, Artificial Sequence
  Description of Artificial Sequence: Synthetic coding sequence
atggccgtgagaagcagaagaccctggatgagcgtggccctgggcctggtgctgggcttcaccgccgccagctggctgatcgcccccagagtggccgagctgagcgagagaaagagaagaggcagcagcctgtgcagctactacggcagaagcgccgccggccccagagccggcgcccagcagcccctgccccagccccagagcagacccagacaggagcagagccccccccccgccagacaggacctgcagggcccccccctgcccgaggccgcccccggcatcaccagcttcagaagcagcccctggcagcagcccccccccctgcagcagagaagaagaggcagagagcccgagggcgccaccggcctgcccggcgcccccgccgccgagggcgagcccgaggaggaggacggcggcgccgccggccagagaagagacggcagacccggcagcagccacaacggcagcggcgacggcggcgccgccgcccccagcgccagacccagagacttcctgtacgtgggcgtgatgaccgcccagaagtacctgggcagcagagccctggccgcccagagaacctgggccagattcatccccggcagagtggagttcttcagcagccagcagccccccaacgccggccagccccccccccccctgcccgtgatcgccctgcccggcgtggacgacagctaccccccccagaagaagagcttcatgatgatcaagtacatgcacgaccactacctggacaagtacgagtggttcatgagagccgacgacgacgtgtacatcaagggcgacaagctggaggagttcctgagaagcctgaacagcagcaagcccctgtacctgggccagaccggcctgggcaacatcgaggagctgggcaagctgggcctggagcccggcgagaacttctgcatgggcggccccggcatgatcttcagcagagaggtgctgagaagaatggtgccccacatcggcgagtgcctgagagagatgtacaccacccacgaggacgtggaggtgggcagatgcgtgagaagattcggcggcacccagtgcgtgtggagctacgagatgcagcagctgttccacgagaactacgagcacaacagaaagggctacatccaggacctgcacaacagcaagatccacgccgccatcaccctgcaccccaacaagagacccgcctaccagtacagactgcacaactacatgctgagcagaaagatcagcgagctgagatacagaaccatccagctgcacagagagagcgccctgatgagcaagctgagcaacaccgaggtgagcaaggaggaccagcagctgggcgtgatccccagcttcaaccacttccagcccagagagagaaacgaggtgatcgagtgggagttcctgaccggcaagctgctgtacagcgccgccgagaaccagccccccagacagagcctgagcagcatcctgagaaccgccctggacgacaccgtgctgcaggtgatggagatgatcaacgagaacgccaagagcagaggcagactgatcgacttcaaggagatccagtacggctacagaagagtgaaccccatgcacggcgtggagtacatcctggacctgctgctgctgtacaagagacacaagggcagaaagctgaccgtgcccgtgagaagacacgcctacctgcagcagctgttcagcaagcccttcttcagagagaccgaggagctggacgtgaacagcctggtggagagcatcaacagcgagacccagagcttcagcttcatcagcaacagcctgaagatcctgagcagcttccagggcgccaaggagatgggcggccacaacgagaagaaggtgcacatcctggtgcccctgatcggcagatacgacatcttcctgagattcatggagaacttcgagaacatgtgcctgatccccaagcagaacgtgaagctggtgatcatcctgttcagcagagacagcggccaggacagcagcaagcacatcgagctgatcaagggctaccagaacaagtaccccaaggccgagatgaccctgatccccatgaagggcgagttcagcagaggcctgggcctggagatggccagcgcccagttcgacaacgacaccctgctgctgttctgcgacgtggacctgatcttcagagaggacttcctgcagagatgcagagacaacaccatccagggccagcaggtgtactaccccatcatcttcagccagtacgaccccaaggtgaccaacggcggcaacccccccaccgacgactacttcatcttcagcaagaagaccggcttctggagagactacggctacggcatcacctgcatctacaagagcgacctgctgggcgccggcggcttcgacaccagcatccagggctggggcctggaggacgtggacctgtacaacaaggtgatcctgagcggcctgagacccttcagaagccaggaggtgggcgtggtgcacatcttccaccccgtgcactgcgaccccaacctggaccccaagcagtacaagatgtgcctgggcagcaaggccagcaccttcgccagcaccatgcagctggccgagctgtggctggagaagcacctgggcgtgagatacaacagaaccctgagctag

SEQ ID NO: 76669 - DNA, 2868 bp, Artificial Sequence
  Description of Artificial Sequence: Synthetic coding sequence
atgcccagcctgcccgccccccccgcccccctgctgctgctgggcctgctgctgctgggcagcagacccgccagaggcgccggccccgagccccccgtgctgcccatcagaagcgagaaggagcccctgcccgtgagaggcgccgccggctgcaccttcggcggcaaggtgtacgccctggacgagacctggcaccccgacctgggcgagcccttcggcgtgatgagatgcgtgctgtgcgcctgcgaggccccccagtggggcagaagaaccagaggccccggcagagtgagctgcaagaacatcaagcccgagtgccccacccccgcctgcggccagcccagacagctgcccggccactgctgccagacctgcccccaggagagaagcagcagcgagagacagcccagcggcctgagcttcgagtaccccagagaccccgagcacagaagctacagcgacagaggcgagcccggcgccgaggagagagccagaggcgacggccacaccgacttcgtggccctgctgaccggccccagaagccaggccgtggccagagccagagtgagcctgctgagaagcagcctgagattcagcatcagctacagaagactggacagacccaccagaatcagattcagcgacagcaacggcagcgtgctgttcgagcaccccgccgcccccacccaggacggcctggtgtgcggcgtgtggagagccgtgcccagactgagcctgagactgctgagagccgagcagctgcacgtggccctggtgaccctgacccaccccagcggcgaggtgtggggccccctgatcagacacagagccctggccgccgagaccttcagcgccatcctgaccctggagggccccccccagcagggcgtgggcggcatcaccctgctgaccctgagcgacaccgaggacagcctgcacttcctgctgctgttcagaggcctgctggagcccagaagcggcggcctgacccaggtgcccctgagactgcagatcctgcaccagggccagctgctgagagagctgcaggccaacgtgagcgcccaggagcccggcttcgccgaggtgctgcccaacctgaccgtgcaggagatggactggctggtgctgggcgagctgcagatggccctggagtgggccggcagacccggcctgagaatcagcggccacatcgccgccagaaagagctgcgacgtgctgcagagcgtgctgtgcggcgccgacgccctgatccccgtgcagaccggcgccgccggcagcgccagcctgaccctgctgggcaacggcagcctgatctaccaggtgcaggtggtgggcaccagcagcgaggtggtggccatgaccctggagaccaagccccagagaagagaccagagaaccgtgctgtgccacatggccggcctgcagcccggcggccacaccgccgtgggcatctgccccggcctgggcgccagaggcgcccacatgctgctgcagaacgagctgttcctgaacgtgggcaccaaggacttccccgacggcgagctgagaggccacgtggccgccctgccctactgcggccacagcgccagacacgacaccctgcccgtgcccctggccggcgccctggtgctgccccccgtgaagagccaggccgccggccacgcctggctgagcctggacacccactgccacctgcactacgaggtgctgctggccggcctgggcggcagcgagcagggcaccgtgaccgcccacctgctgggcccccccggcacccccggccccagaagactgctgaagggcttctacggcagcgaggcccagggcgtggtgaaggacctggagcccgagctgctgagacacctggccaagggcatggccagcctgatgatcaccaccaagggcagccccagaggcgagctgagaggccaggtgcacatcgccaaccagtgcgaggtgggcggcctgagactggaggccgccggcgccgagggcgtgagagccctgggcgcccccgacaccgccagcgccgccccccccgtggtgcccggcctgcccgccctggcccccgccaagcccggcggccccggcagacccagagaccccaacacctgcttcttcgagggccagcagagaccccacggcgccagatgggcccccaactacgaccccctgtgcagcctgtgcacctgccagagaagaaccgtgatctgcgaccccgtggtgtgccccccccccagctgcccccaccccgtgcaggcccccgaccagtgctgccccgtgtgccccgagaagcaggacgtgagagacctgcccggcctgcccagaagcagagaccccggcgagggctgctacttcgacggcgacagaagctggagagccgccggcaccagatggcaccccgtggtgccccccttcggcctgatcaagtgcgccgtgtgcacctgcaagggcggcaccggcgaggtgcactgcgagaaggtgcagtgccccagactggcctgcgcccagcccgtgagagtgaaccccaccgactgctgcaagcagtgccccgtgggcagcggcgcccacccccagctgggcgaccccatgcaggccgacggccccagaggctgcagattcgccggccagtggttccccgagagccagagctggcaccccagcgtgccccccttcggcgagatgagctgcatcacctgcagatgcggcgccggcgtgccccactgcgagagagacgactgcagcctgcccctgagctgcggcagcggcaaggagagcagatgctgcagcagatgcaccgcccacagaagacccgcccccgagaccagaaccgaccccgagctggagaaggaggccgagggcagctag

SEQ ID NO: 76670 - DNA, 285 bp, Artificial Sequence
  Description of Artificial Sequence: Synthetic coding sequence
atgcccagcctgcccgccccccccgcccccctgctgctgctgggcctgctgctgctgggcagcagacccgccagaggcgccggccccgagccccccgtgctgcccatcagaagcgagaaggagcccctgcccgtgagaggcgccgccggctgcaccttcggcggcaaggtgtacgccctggacgagacctggcaccccgacctgggcgagcccttcggcgtgatgagatgcgtgctgtgcgcctgcgaggccaccggcaccctgagacccagagagatgaagtag

SEQ ID NO: 76671 - DNA, 1512 bp, Artificial Sequence
  Description of Artificial Sequence: Synthetic coding sequence
ggcgagcacctgagccagaagggcccccacgtgagaccctgcagaaccaaccccggcagcctggaggcccccgacagcacccccggcgccgccaccgccagaaccagcggccagtgcctgagccccggcgagtggggcagcggcagcagatgccacctgagctggcccctggccatcgcccaccacaccctgctgtgcccccaggagcccggcttcgccgaggtgctgcccaacctgaccgtgcaggagatggactggctggtgctgggcgagctgcagatggccctggagtgggccggcagacccggcctgagaatcagcggccacatcgccgccagaaagagctgcgacgtgctgcagagcgtgctgtgcggcgccgacgccctgatccccgtgcagaccggcgccgccggcagcgccagcctgaccctgctgggcaacggcagcctgatctaccaggtgcaggtggtgggcaccagcagcgaggtggtggccatgaccctggagaccaagccccagagaagagaccagagaaccgtgctgtgccacatggccggcctgcagcccggcggccacaccgccgtgggcatctgccccggcctgggcgccagaggcgcccacatgctgctgcagaacgagctgttcctgaacgtgggcaccaaggacttccccgacggcgagctgagaggccacgtggccgccctgccctactgcggccacagcgccagacacgacaccctgcccgtgcccctggccggcgccctggtgctgccccccgtgaagagccaggccgccggccacgcctggctgagcctggacacccactgccacctgcactacgaggtgctgctggccggcctgggcggcagcgagcagggcaccgtgaccgcccacctgctgggcccccccggcacccccggccccagaagactgctgaagggcttctacggcagcgaggcccagggcgtggtgaaggacctggagcccgagctgctgagacacctggccaagggcatggccagcctgatgatcaccaccaagggcagccccagaggcgagctgagaggccaggtgcacatcgccaaccagtgcgaggtgggcggcctgagactggaggccgccggcgccgagggcgtgagagccctgggcgcccccgacaccgccagcgccgccccccccgtggtgcccggcctgcccgccctggcccccgccaagcccggcggccccggcagacccagagaccccaacacctgcttcttcgagggccagcagagaccccacggcgccagatgggcccccaactacgaccccctgtgcagcctgtgcacctgccagagaagaaccgtgatctgcgaccccgtggtgtgccccccccccagctgcccccaccccgtgcaggcccccgaccagtgctgccccgtgtgccccgagaagcaggacgtgagagacctgcccggcctgcccagaagcagagaccccggcgagggcggccactggagaggcgccctgtag

SEQ ID NO: 76672 - DNA, 2748 bp, Artificial Sequence
  Description of Artificial Sequence: Synthetic coding sequence
atgcccagcctgcccgccccccccgcccccctgctgctgctgggcctgctgctgctgggcagcagacccgccagaggcgccggccccgagccccccgtgctgcccatcagaagcgagaaggagcccctgcccgtgagaggcgccgccggctgcaccttcggcggcaaggtgtacgccctggacgagacctggcaccccgacctgggcgagcccttcggcgtgatgagatgcgtgctgtgcgcctgcgaggccccccagtggggcagaagaaccagaggccccggcagagtgagctgcaagaacatcaagcccgagtgccccacccccgcctgcggccagcccagacagctgcccggccactgctgccagacctgcccccaggagagaagcagcagcgagagacagcccagcggcctgagcttcgagtaccccagagaccccgagcacagaagctacagcgacagaggcgagcccggcgccgaggagagagccagaggcgacggccacaccgacttcgtggccctgctgaccggccccagaagccaggccgtggccagagccagagtgagcctgctgagaagcagcctgagattcagcatcagctacagaagactggacagacccaccagaatcagattcagcgacagcaacggcagcgtgctgttcgagcaccccgccgcccccacccaggacggcctggtgtgcggcgtgtggagagccgtgcccagactgagcctgagactgctgagagccgagcagctgcacgtggccctggtgaccctgacccaccccagcggcgaggtgtggggccccctgatcagacacagagccctggccgccgagaccttcagcgccatcctgaccctggagggccccccccagcagggcgtgggcggcatcaccctgctgaccctgagcgacaccgaggacagcctgcacttcctgctgctgttcagaggcctgctggagcccagaagcggcggcctgacccaggtgcccctgagactgcagatcctgcaccagggccagctgctgagagagctgcaggccaacgtgagcgcccaggagcccggcttcgccgaggtgctgcccaacctgaccgtgcaggagatggactggctggtgctgggcgagctgcagatggccctggagtgggccggcagacccggcctgagaatcagcggccacatcgccgccagaaagagctgcgacgtgctgcagagcgtgctgtgcggcgccgacgccctgatccccgtgcagaccggcgccgccggcagcgccagcctgaccctgctgggcaacggcagcctgatctaccaggccgtgggcatctgccccggcctgggcgccagaggcgcccacatgctgctgcagaacgagctgttcctgaacgtgggcaccaaggacttccccgacggcgagctgagaggccacgtggccgccctgccctactgcggccacagcgccagacacgacaccctgcccgtgcccctggccggcgccctggtgctgccccccgtgaagagccaggccgccggccacgcctggctgagcctggacacccactgccacctgcactacgaggtgctgctggccggcctgggcggcagcgagcagggcaccgtgaccgcccacctgctgggcccccccggcacccccggccccagaagactgctgaagggcttctacggcagcgaggcccagggcgtggtgaaggacctggagcccgagctgctgagacacctggccaagggcatggccagcctgatgatcaccaccaagggcagccccagaggcgagctgagaggccaggtgcacatcgccaaccagtgcgaggtgggcggcctgagactggaggccgccggcgccgagggcgtgagagccctgggcgcccccgacaccgccagcgccgccccccccgtggtgcccggcctgcccgccctggcccccgccaagcccggcggccccggcagacccagagaccccaacacctgcttcttcgagggccagcagagaccccacggcgccagatgggcccccaactacgaccccctgtgcagcctgtgcacctgccagagaagaaccgtgatctgcgaccccgtggtgtgccccccccccagctgcccccaccccgtgcaggcccccgaccagtgctgccccgtgtgccccgagaagcaggacgtgagagacctgcccggcctgcccagaagcagagaccccggcgagggctgctacttcgacggcgacagaagctggagagccgccggcaccagatggcaccccgtggtgccccccttcggcctgatcaagtgcgccgtgtgcacctgcaagggcggcaccggcgaggtgcactgcgagaaggtgcagtgccccagactggcctgcgcccagcccgtgagagtgaaccccaccgactgctgcaagcagtgccccgtgggcagcggcgcccacccccagctgggcgaccccatgcaggccgacggccccagaggctgcagattcgccggccagtggttccccgagagccagagctggcaccccagcgtgccccccttcggcgagatgagctgcatcacctgcagatgcggcgccggcgtgccccactgcgagagagacgactgcagcctgcccctgagctgcggcagcggcaaggagagcagatgctgcagcagatgcaccgcccacagaagacccgcccccgagaccagaaccgaccccgagctggagaaggaggccgagggcagctag

SEQ ID NO: 76673 - DNA, 1494 bp, Artificial Sequence
  Description of Artificial Sequence: Synthetic coding sequence
atggactggctggtgctgggcgagctgcagatggccctggagtgggccggcagacccggcctgagaatcagcggccacatcgccgccagaaagagctgcgacgtgctgcagagcgtgctgtgcggcgccgacgccctgatccccgtgcagaccggcgccgccggcagcgccagcctgaccctgctgggcaacggcagcctgatctaccaggtgcaggtggtgggcaccagcagcgaggtggtggccatgaccctggagaccaagccccagagaagagaccagagaaccgtgctgtgccacatggccggcctgcagcccggcggccacaccgccgtgggcatctgccccggcctgggcgccagaggcgcccacatgctgctgcagaacgagctgttcctgaacgtgggcaccaaggacttccccgacggcgagctgagaggccacgtggccgccctgccctactgcggccacagcgccagacacgacaccctgcccgtgcccctggccggcgccctggtgctgccccccgtgaagagccaggccgccggccacgcctggctgagcctggacacccactgccacctgcactacgaggtgctgctggccggcctgggcggcagcgagcagggcaccgtgaccgcccacctgctgggcccccccggcacccccggccccagaagactgctgaagggcttctacggcagcgaggcccagggcgtggtgaaggacctggagcccgagctgctgagacacctggccaagggcatggccagcctgatgatcaccaccaagggcagccccagaggcgagctgagaggccagagaagaaccgtgatctgcgaccccgtggtgtgccccccccccagctgcccccaccccgtgcaggcccccgaccagtgctgccccgtgtgccccgagaagcaggacgtgagagacctgcccggcctgcccagaagcagagaccccggcgagggctgctacttcgacggcgacagaagctggagagccgccggcaccagatggcaccccgtggtgccccccttcggcctgatcaagtgcgccgtgtgcacctgcaagggcggcaccggcgaggtgcactgcgagaaggtgcagtgccccagactggcctgcgcccagcccgtgagagtgaaccccaccgactgctgcaagcagtgccccgtgggcagcggcgcccacccccagctgggcgaccccatgcaggccgacggccccagaggctgcagattcgccggccagtggttccccgagagccagagctggcaccccagcgtgccccccttcggcgagatgagctgcatcacctgcagatgcggcgccggcgtgccccactgcgagagagacgactgcagcctgcccctgagctgcggcagcggcaaggagagcagatgctgcagcagatgcaccgcccacagaagacccgcccccgagaccagaaccgaccccgagctggagaaggaggccgagggcagctag

SEQ ID NO: 76674 - DNA, 3126 bp, Artificial Sequence
  Description of Artificial Sequence: Synthetic coding sequence
atggagaacatgttcctgcagagcagcatgctgacctgcatcttcctgctgatcagcggcagctgcgagctgtgcgccgaggagaacttcagcagaagctacccctgcgacgagaagaagcagaacgacagcgtgatcgccgagtgcagcaacagaagactgcaggaggtgccccagaccgtgggcaagtacgtgaccgagctggacctgagcgacaacttcatcacccacatcaccaacgagagcttccagggcctgcagaacctgaccaagatcaacctgaaccacaaccccaacgtgcagcaccagaacggcaaccccggcatccagagcaacggcctgaacatcaccgacggcgccttcctgaacctgaagaacctgagagagctgctgctggaggacaaccagctgccccagatccccagcggcctgcccgagagcctgaccgagctgagcctgatccagaacaacatctacaacatcaccaaggagggcatcagcagactgatcaacctgaagaacctgtacctggcctggaactgctacttcaacaaggtgtgcgagaagaccaacatcgaggacggcgtgttcgagaccctgaccaacctggagctgctgagcctgagcttcaacagcctgagccacgtgccccccaagctgcccagcagcctgagaaagctgttcctgagcaacacccagatcaagtacatcagcgaggaggacttcaagggcctgatcaacctgaccctgctggacctgagcggcaactgccccagatgcttcaacgcccccttcccctgcgtgccctgcgacggcggcgccagcatcaacatcgacagattcgccttccagaacctgacccagctgagatacctgaacctgagcagcaccagcctgagaaagatcaacgccgcctggttcaagaacatgccccacctgaaggtgctggacctggagttcaactacctggtgggcgagatcgccagcggcgccttcctgaccatgctgcccagactggagatcctggacctgagcttcaactacatcaagggcagctacccccagcacatcaacatcagcagaaacttcagcaagctgctgagcctgagagccctgcacctgagaggctacgtgttccaggagctgagagaggacgacttccagcccctgatgcagctgcccaacctgagcaccatcaacctgggcatcaacttcatcaagcagatcgacttcaagctgttccagaacttcagcaacctggagatcatctacctgagcgagaacagaatcagccccctggtgaaggacaccagacagagctacgccaacagcagcagcttccagagacacatcagaaagagaagaagcaccgacttcgagttcgacccccacagcaacttctaccacttcaccagacccctgatcaagccccagtgcgccgcctacggcaaggccctggacctgagcctgaacagcatcttcttcatcggccccaaccagttcgagaacctgcccgacatcgcctgcctgaacctgagcgccaacagcaacgcccaggtgctgagcggcaccgagttcagcgccatcccccacgtgaagtacctggacctgaccaacaacagactggacttcgacaacgccagcgccctgaccgagctgagcgacctggaggtgctggacctgagctacaacagccactacttcagaatcgccggcgtgacccaccacctggagttcatccagaacttcaccaacctgaaggtgctgaacctgagccacaacaacatctacaccctgaccgacaagtacaacctggagagcaagagcctggtggagctggtgttcagcggcaacagactggacatcctgtggaacgacgacgacaacagatacatcagcatcttcaagggcctgaagaacctgaccagactggacctgagcctgaacagactgaagcacatccccaacgaggccttcctgaacctgcccgccagcctgaccgagctgcacatcaacgacaacatgctgaagttcttcaactggaccctgctgcagcagttccccagactggagctgctggacctgagaggcaacaagctgctgttcctgaccgacagcctgagcgacttcaccagcagcctgagaaccctgctgctgagccacaacagaatcagccacctgcccagcggcttcctgagcgaggtgagcagcctgaagcacctggacctgagcagcaacctgctgaagaccatcaacaagagcgccctggagaccaagaccaccaccaagctgagcatgctggagctgcacggcaaccccttcgagtgcacctgcgacatcggcgacttcagaagatggatggacgagcacctgaacgtgaagatccccagactggtggacgtgatctgcgccagccccggcgaccagagaggcaagagcatcgtgagcctggagctgaccacctgcgtgagcgacgtgaccgccgtgatcctgttcttcttcaccttcttcatcaccaccatggtgatgctggccgccctggcccaccacctgttctactgggacgtgtggttcatctacaacgtgtgcctggccaaggtgaagggctacagaagcctgagcaccagccagaccttctacgacgcctacatcagctacgacaccaaggacgccagcgtgaccgactgggtgatcaacgagctgagataccacctggaggagagcagagacaagaacgtgctgctgtgcctggaggagagagactgggaccccggcctggccatcatcgacaacctgatgcagagcatcaaccagagcaagaagaccgtgttcgtgctgaccaagaagtacgccaagagctggaacttcaagaccgccttctacctggccctgcagagactgatggacgagaacatggacgtgatcatcttcatcctgctggagcccgtgctgcagcacagccagtacctgagactgagacagagaatctgcaagagcagcatcctgcagtggcccgacaaccccaaggccgagggcctgttctggcagaccctgagaaacgtggtgctgaccgagaacgacagcagatacaacaacatgtacgtggacagcatcaagcagtactag

SEQ ID NO: 76675 - DNA, 1377 bp, Artificial Sequence
  Description of Artificial Sequence: Synthetic coding sequence
atgagaaagaagtggaagatgggcggcatgaagtacatcttcagcctgctgttcttcctgctgctggagggcggcaagaccgagcaggtgaagcacagcgagacctactgcatgttccaggacaagaagtacagagtgggcgagagatggcacccctacctggagccctacggcctggtgtactgcgtgaactgcatctgcagcgagaacggcaacgtgctgtgcagcagagtgagatgccccaacgtgcactgcctgagccccgtgcacatcccccacctgtgctgccccagatgccccgaggacagcctgccccccgtgaacaacaaggtgaccagcaagagctgcgagtacaacggcaccacctaccagcacggcgagctgttcgtggccgagggcctgttccagaacagacagcccaaccagtgcacccagtgcagctgcagcgagggcaacgtgtactgcggcctgaagacctgccccaagctgacctgcgccttccccgtgagcgtgcccgacagctgctgcagagtgtgcagaggcgacggcgagctgagctgggagcacagcgacggcgacatcttcagacagcccgccaacagagaggccagacacagctaccacagaagccactacgaccccccccccagcagacaggccggcggcctgagcagattccccggcgccagaagccacagaggcgccctgatggacagccagcaggccagcggcaccatcgtgcagatcgtgatcaacaacaagcacaagcacggccaggtgtgcgtgagcaacggcaagacctacagccacggcgagagctggcaccccaacctgagagccttcggcatcgtggagtgcgtgctgtgcacctgcaacgtgaccaagcaggagtgcaagaagatccactgccccaacagatacccctgcaagtacccccagaagatcgacggcaagtgctgcaaggtgtgccccggcaagaaggccaaggaggagctgcccggccagagcttcgacaacaagggctacttctgcggcgaggagaccatgcccgtgtacgagagcgtgttcatggaggacggcgagaccaccagaaagatcgccctggagaccgagagacccccccaggtggaggtgcacgtgtggaccatcagaaagggcatcctgcagcacttccacatcgagaagatcagcaagagaatgttcgaggagctgccccacttcaagctggtgaccagaaccaccctgagccagtggaagatcttcaccgagggcgaggcccagatcagccagatgtgcagcagcagagtgtgcagaaccgagctggaggacctggtgaaggtgctgtacctggagagaagcgagaagggccactgctag

SEQ ID NO: 76676 - DNA, 1353 bp, Artificial Sequence
  Description of Artificial Sequence: Synthetic coding sequence
atgggcggcatgaagtacatcttcagcctgctgttcttcctgctgctggagggcggcaagaccgagcaggtgaagcacagcgagacctactgcatgttccaggacaagaagtacagagtgggcgagagatggcacccctacctggagccctacggcctggtgtactgcgtgaactgcatctgcagcgagaacggcaacgtgctgtgcagcagagtgagatgccccaacgtgcactgcctgagccccgtgcacatcccccacctgtgctgccccagatgccccgacagcctgccccccgtgaacaacaaggtgaccagcaagagctgcgagtacaacggcaccacctaccagcacggcgagctgttcgtggccgagggcctgttccagaacagacagcccaaccagtgcacccagtgcagctgcagcgagggcaacgtgtactgcggcctgaagacctgccccaagctgacctgcgccttccccgtgagcgtgcccgacagctgctgcagagtgtgcagaggcgacggcgagctgagctgggagcacagcgacggcgacatcttcagacagcccgccaacagagaggccagacacagctaccacagaagccactacgaccccccccccagcagacaggccggcggcctgagcagattccccggcgccagaagccacagaggcgccctgatggacagccagcaggccagcggcaccatcgtgcagatcgtgatcaacaacaagcacaagcacggccaggtgtgcgtgagcaacggcaagacctacagccacggcgagagctggcaccccaacctgagagccttcggcatcgtggagtgcgtgctgtgcacctgcaacgtgaccaagcaggagtgcaagaagatccactgccccaacagatacccctgcaagtacccccagaagatcgacggcaagtgctgcaaggtgtgccccggcaagaaggccaaggagctgcccggccagagcttcgacaacaagggctacttctgcggcgaggagaccatgcccgtgtacgagagcgtgttcatggaggacggcgagaccaccagaaagatcgccctggagaccgagagacccccccaggtggaggtgcacgtgtggaccatcagaaagggcatcctgcagcacttccacatcgagaagatcagcaagagaatgttcgaggagctgccccacttcaagctggtgaccagaaccaccctgagccagtggaagatcttcaccgagggcgaggcccagatcagccagatgtgcagcagcagagtgtgcagaaccgagctggaggacctggtgaaggtgctgtacctggagagaagcgagaagggccactgctag

SEQ ID NO: 76677 - DNA, 1371 bp, Artificial Sequence
  Description of Artificial Sequence: Synthetic coding sequence
atgagaaagaagtggaagatgggcggcatgaagtacatcttcagcctgctgttcttcctgctgctggagggcggcaagaccgagcaggtgaagcacagcgagacctactgcatgttccaggacaagaagtacagagtgggcgagagatggcacccctacctggagccctacggcctggtgtactgcgtgaactgcatctgcagcgagaacggcaacgtgctgtgcagcagagtgagatgccccaacgtgcactgcctgagccccgtgcacatcccccacctgtgctgccccagatgccccgacagcctgccccccgtgaacaacaaggtgaccagcaagagctgcgagtacaacggcaccacctaccagcacggcgagctgttcgtggccgagggcctgttccagaacagacagcccaaccagtgcacccagtgcagctgcagcgagggcaacgtgtactgcggcctgaagacctgccccaagctgacctgcgccttccccgtgagcgtgcccgacagctgctgcagagtgtgcagaggcgacggcgagctgagctgggagcacagcgacggcgacatcttcagacagcccgccaacagagaggccagacacagctaccacagaagccactacgaccccccccccagcagacaggccggcggcctgagcagattccccggcgccagaagccacagaggcgccctgatggacagccagcaggccagcggcaccatcgtgcagatcgtgatcaacaacaagcacaagcacggccaggtgtgcgtgagcaacggcaagacctacagccacggcgagagctggcaccccaacctgagagccttcggcatcgtggagtgcgtgctgtgcacctgcaacgtgaccaagcaggagtgcaagaagatccactgccccaacagatacccctgcaagtacccccagaagatcgacggcaagtgctgcaaggtgtgccccggcaagaaggccaaggagctgcccggccagagcttcgacaacaagggctacttctgcggcgaggagaccatgcccgtgtacgagagcgtgttcatggaggacggcgagaccaccagaaagatcgccctggagaccgagagacccccccaggtggaggtgcacgtgtggaccatcagaaagggcatcctgcagcacttccacatcgagaagatcagcaagagaatgttcgaggagctgccccacttcaagctggtgaccagaaccaccctgagccagtggaagatcttcaccgagggcgaggcccagatcagccagatgtgcagcagcagagtgtgcagaaccgagctggaggacctggtgaaggtgctgtacctggagagaagcgagaagggccactgctag

SEQ ID NO: 76678 - DNA, 1134 bp, Artificial Sequence
  Description of Artificial Sequence: Synthetic coding sequence
atgagaaagaagtggaagatgggcggcatgaagtacatcttcagcctgctgttcttcctgctgctggagggcggcaagaccgagcaggtgaagcacagcgagacctactgcatgttccaggacaagaagtacagagtgggcgagagatggcacccctacctggagccctacggcctggtgtactgcgtgaactgcatctgcagcgagaacggcaacgtgctgtgcagcagagtgagatgccccaacgtgcactgcctgagccccgtgcacatcccccacctgtgctgccccagatgccccggcgacggcgagctgagctgggagcacagcgacggcgacatcttcagacagcccgccaacagagaggccagacacagctaccacagaagccactacgaccccccccccagcagacaggccggcggcctgagcagattccccggcgccagaagccacagaggcgccctgatggacagccagcaggccagcggcaccatcgtgcagatcgtgatcaacaacaagcacaagcacggccaggtgtgcgtgagcaacggcaagacctacagccacggcgagagctggcaccccaacctgagagccttcggcatcgtggagtgcgtgctgtgcacctgcaacgtgaccaagcaggagtgcaagaagatccactgccccaacagatacccctgcaagtacccccagaagatcgacggcaagtgctgcaaggtgtgccccggcaagaaggccaaggagctgcccggccagagcttcgacaacaagggctacttctgcggcgaggagaccatgcccgtgtacgagagcgtgttcatggaggacggcgagaccaccagaaagatcgccctggagaccgagagacccccccaggtggaggtgcacgtgtggaccatcagaaagggcatcctgcagcacttccacatcgagaagatcagcaagagaatgttcgaggagctgccccacttcaagctggtgaccagaaccaccctgagccagtggaagatcttcaccgagggcgaggcccagatcagccagatgtgcagcagcagagtgtgcagaaccgagctggaggacctggtgaaggtgctgtacctggagagaagcgagaagggccactgctag

SEQ ID NO: 76679 - DNA, 1374 bp, Artificial Sequence
  Description of Artificial Sequence: Synthetic coding sequence
atgagaaagaagtggaagatgggcggcatgaagtacatcttcagcctgctgttcttcctgctgctggagggcggcaagaccgagcaggtgaagcacagcgagacctactgcatgttccaggacaagaagtacagagtgggcgagagatggcacccctacctggagccctacggcctggtgtactgcgtgaactgcatctgcagcgagaacggcaacgtgctgtgcagcagagtgagatgccccaacgtgcactgcctgagccccgtgcacatcccccacctgtgctgccccagatgccccgacagcctgccccccgtgaacaacaaggtgaccagcaagagctgcgagtacaacggcaccacctaccagcacggcgagctgttcgtggccgagggcctgttccagaacagacagcccaaccagtgcacccagtgcagctgcagcgagggcaacgtgtactgcggcctgaagacctgccccaagctgacctgcgccttccccgtgagcgtgcccgacagctgctgcagagtgtgcagaggcgacggcgagctgagctgggagcacagcgacggcgacatcttcagacagcccgccaacagagaggccagacacagctaccacagaagccactacgaccccccccccagcagacaggccggcggcctgagcagattccccggcgccagaagccacagaggcgccctgatggacagccagcaggccagcggcaccatcgtgcagatcgtgatcaacaacaagcacaagcacggccaggtgtgcgtgagcaacggcaagacctacagccacggcgagagctggcaccccaacctgagagccttcggcatcgtggagtgcgtgctgtgcacctgcaacgtgaccaagcaggagtgcaagaagatccactgccccaacagatacccctgcaagtacccccagaagatcgacggcaagtgctgcaaggtgtgccccggcaagaaggccaaggaggagctgcccggccagagcttcgacaacaagggctacttctgcggcgaggagaccatgcccgtgtacgagagcgtgttcatggaggacggcgagaccaccagaaagatcgccctggagaccgagagacccccccaggtggaggtgcacgtgtggaccatcagaaagggcatcctgcagcacttccacatcgagaagatcagcaagagaatgttcgaggagctgccccacttcaagctggtgaccagaaccaccctgagccagtggaagatcttcaccgagggcgaggcccagatcagccagatgtgcagcagcagagtgtgcagaaccgagctggaggacctggtgaaggtgctgtacctggagagaagcgagaagggccactgctag

SEQ ID NO: 76680 - DNA, 1137 bp, Artificial Sequence
  Description of Artificial Sequence: Synthetic coding sequence
atgagaaagaagtggaagatgggcggcatgaagtacatcttcagcctgctgttcttcctgctgctggagggcggcaagaccgagcaggtgaagcacagcgagacctactgcatgttccaggacaagaagtacagagtgggcgagagatggcacccctacctggagccctacggcctggtgtactgcgtgaactgcatctgcagcgagaacggcaacgtgctgtgcagcagagtgagatgccccaacgtgcactgcctgagccccgtgcacatcccccacctgtgctgccccagatgccccggcgacggcgagctgagctgggagcacagcgacggcgacatcttcagacagcccgccaacagagaggccagacacagctaccacagaagccactacgaccccccccccagcagacaggccggcggcctgagcagattccccggcgccagaagccacagaggcgccctgatggacagccagcaggccagcggcaccatcgtgcagatcgtgatcaacaacaagcacaagcacggccaggtgtgcgtgagcaacggcaagacctacagccacggcgagagctggcaccccaacctgagagccttcggcatcgtggagtgcgtgctgtgcacctgcaacgtgaccaagcaggagtgcaagaagatccactgccccaacagatacccctgcaagtacccccagaagatcgacggcaagtgctgcaaggtgtgccccggcaagaaggccaaggaggagctgcccggccagagcttcgacaacaagggctacttctgcggcgaggagaccatgcccgtgtacgagagcgtgttcatggaggacggcgagaccaccagaaagatcgccctggagaccgagagacccccccaggtggaggtgcacgtgtggaccatcagaaagggcatcctgcagcacttccacatcgagaagatcagcaagagaatgttcgaggagctgccccacttcaagctggtgaccagaaccaccctgagccagtggaagatcttcaccgagggcgaggcccagatcagccagatgtgcagcagcagagtgtgcagaaccgagctggaggacctggtgaaggtgctgtacctggagagaagcgagaagggccactgctag

SEQ ID NO: 76681 - DNA, 1356 bp, Artificial Sequence
  Description of Artificial Sequence: Synthetic coding sequence
atggtgcccgaggtgagagtgctgagcagcctgctgggcctggccctgctgtggttccccctggacagccacgccagagccagacccgacatgttctgcctgttccacggcaagagatacagccccggcgagagctggcacccctacctggagccccagggcctgatgtactgcctgagatgcacctgcagcgagggcgcccacgtgagctgctacagactgcactgcccccccgtgcactgcccccagcccgtgaccgagccccagcagtgctgccccaagtgcgtggagccccacacccccagcggcctgagagccccccccaagagctgccagcacaacggcaccatgtaccagcacggcgagatcttcagcgcccacgagctgttccccagcagactgcccaaccagtgcgtgctgtgcagctgcaccgagggccagatctactgcggcctgaccacctgccccgagcccggctgccccgcccccctgcccctgcccgacagctgctgccaggcctgcaaggacgaggccagcgagcagagcgacgaggaggacagcgtgcagagcctgcacggcgtgagacacccccaggacccctgcagcagcgacgccggcagaaagagaggccccggcacccccgcccccaccggcctgagcgcccccctgagcttcatccccagacacttcagacccaagggcgccggcagcaccaccgtgaagatcgtgctgaaggagaagcacaagaaggcctgcgtgcacggcggcaagacctacagccacggcgaggtgtggcaccccgccttcagagccttcggccccctgccctgcatcctgtgcacctgcgaggacggcagacaggactgccagagagtgacctgccccaccgagtacccctgcagacaccccgagaaggtggccggcaagtgctgcaagatctgccccgaggacaaggccgaccccggccacagcgagatcagcagcaccagatgccccaaggcccccggcagagtgctggtgcacaccagcgtgagccccagccccgacaacctgagaagattcgccctggagcacgaggccagcgacctggtggagatctacctgtggaagctggtgaaggacgaggagaccgaggcccagagaggcgaggtgcccggccccagaccccacagccagaacctgcccctggacagcgaccaggagagccaggaggccagactgcccgagagaggcaccgccctgcccaccgccagatggccccccagaagaagcctggagagactgcccagccccgaccccggcgccgagggccacggccagagcagacagagcgaccaggacatcaccaagacctag

SEQ ID NO: 76682 - DNA, 846 bp, Artificial Sequence
  Description of Artificial Sequence: Synthetic coding sequence
atgtaccagcacggcgagatcttcagcgcccacgagctgttccccagcagactgcccaaccagtgcgtgctgtgcagctgcaccgagggccagatctactgcggcctgaccacctgccccgagcccggctgccccgcccccctgcccctgcccgacagctgctgccaggcctgcaaggccggcagcagctggggcctgctgtgcagcgtgagcgacttccaccccagctgccacctgcagagacacccccaggacccctgcagcagcgacgccggcagaaagagaggccccggcacccccgcccccaccggcctgagcgcccccctgagcttcatccccagacacttcagacccaagggcgccggcagcaccaccgtgaagatcgtgctgaaggagaagcacaagaaggcctgcgtgcacggcggcaagacctacagccacggcgaggtgtggcaccccgccttcagagccttcggccccctgccctgcatcctgtgcacctgcgaggacggcagacaggactgccagagagtgacctgccccaccgagtacccctgcagacaccccgagaaggtggccggcaagtgctgcaagatctgccccgaggacaaggccgaccccggccacagcgagatcagcagcaccagatgccccaaggcccccggcagagtgctggtgcacaccagcgtgagccccagccccgacaacctgagaagattcgccctggagcacgaggccagcgacctggtggagatctacctgtggaagctggtgaagggcgtgttcctggcccagaccctggagctgaaggtgaccgccagccccgacaaggtgaccaagacctag

SEQ ID NO: 76683 - DNA, 1290 bp, Artificial Sequence
  Description of Artificial Sequence: Synthetic coding sequence
atggtgcccgaggtgagagtgctgagcagcctgctgggcctggccctgctgtggttccccctggacagccacgccagagccagacccgacatgttctgcctgttccacggcaagagatacagccccggcgagagctggcacccctacctggagccccagggcctgatgtactgcctgagatgcacctgcagcgagggcgcccacgtgagctgctacagactgcactgcccccccgtgcactgcccccagcccgtgaccgagccccagcagtgctgccccaagtgcgtggagccccacacccccagcggcctgagagccccccccaagagctgccagcacaacggcaccatgtaccagcacggcgagatcttcagcgcccacgagctgttccccagcagactgcccaaccagtgcgtgctgtgcagctgcaccgagggccagatctactgcggcctgaccacctgccccgagcccggctgccccgcccccctgcccctgcccgacagctgctgccaggcctgcaaggacgaggccagcgagcagagcgacgaggaggacagcgtgcagagcctgcacggcgtgagacacccccaggacccctgcagcagcgacgccggcagaaagagaggccccggcacccccgcccccaccggcctgagcgcccccctgagcttcatccccagacacttcagacccaagggcgccggcagcaccaccgtgaagatcgtgctgaaggagaagcacaagaaggcctgcgtgcacggcggcaagacctacagccacggcgaggtgtggcaccccgccttcagagccttcggccccctgccctgcatcctgtgcacctgcgaggacggcagacaggactgccagagagtgacctgccccaccgagtacccctgcagacaccccgagaaggtggccggcaagtgctgcaagatctgccccgaggacaaggccgaccccggccacagcgagatcagcagcaccagatgccccaaggcccccggcagagtgctggtgcacaccagcgtgagccccagccccgacaacctgagaagattcgccctggagcacgaggccagcgacctggtggagatctacctgtggaagctggtgaagggcatcttccacctgacccagatcaagaaggtgagaaagcaggacttccagaaggaggcccagcacttcagactgctggccggcccccacgagggccactggaacgtgttcctggcccagaccctggagctgaaggtgaccgccagccccgacaaggtgaccaagacctag

SEQ ID NO: 76684 - DNA, 840 bp, Artificial Sequence
  Description of Artificial Sequence: Synthetic coding sequence
atgtaccagcacggcgagatcttcagcgcccacgagctgttccccagcagactgcccaaccagtgcgtgctgtgcagctgcaccgagggccagatctactgcggcctgaccacctgccccgagcccggctgccccgcccccctgcccctgcccgacagctgctgccaggcctgcaaggacgaggccagcgagcagagcgacgaggaggacagcgtgcagagcctgcacggcgtgagacacccccaggacccctgcagcagcgacgccggcagaaagagaggccccggcacccccgcccccaccggcctgagcgcccccctgagcttcatccccagacacttcagacccaagggcgccggcagcaccaccgtgaagatcgtgctgaaggagaagcacaagaaggcctgcgtgcacggcggcaagacctacagccacggcgaggtgtggcaccccgccttcagagccttcggccccctgccctgcatcctgtgcacctgcgaggacggcagacaggactgccagagagtgacctgccccaccgagtacccctgcagacaccccgagaaggtggccggcaagtgctgcaagatctgccccgaggacaaggccgaccccggccacagcgagatcagcagcaccagatgccccaaggcccccggcagagtgctggtgcacaccagcgtgagccccagccccgacaacctgagaagattcgccctggagcacgaggccagcgacctggtggagatctacctgtggaagctggtgaaggacgtgttcctggcccagaccctggagctgaaggtgaccgccagccccgacaaggtgaccaagacctag

SEQ ID NO: 76685 - DNA, 498 bp, Artificial Sequence
  Description of Artificial Sequence: Synthetic coding sequence
atggagatgttccagggcctgctgctgctgctgctgctgagcatgggcggcacctgggccagcaaggagcccctgagacccagatgcagacccatcaacgccaccctggccgtggagaaggagggctgccccgtgtgcatcaccgtgaacaccaccatctgcgccggctactgccccaccatgaccagagtgctgcagggcgtgctgcccgccctgccccaggtggtgtgcaactacagagacgtgagattcgagagcatcagactgcccggctgccccagaggcgtgaaccccgtggtgagctacgccgtggccctgagctgccagtgcgccctgtgcagaagaagcaccaccgactgcggcggccccaaggaccaccccctgacctgcgacgaccccagattccaggacagcagcagcagcaaggcccccccccccagcctgcccagccccagcagactgcccggccccagcgacacccccatcctgccccagtag

SEQ ID NO: 76686 - DNA, 507 bp, Artificial Sequence
  Description of Artificial Sequence: Synthetic coding sequence
gcccccagaatggagatgttccagggcctgctgctgctgctgctgctgagcatgggcggcacctgggccagcaaggagcccctgagacccagatgcagacccatcaacgccaccctggccgtggagaaggagggctgccccgtgtgcatcaccgtgaacaccaccatctgcgccggctactgccccaccatgaccagagtgctgcagggcgtgctgcccgccctgccccaggtggtgtgcaactacagagacgtgagattcgagagcatcagactgcccggctgccccagaggcgtgaaccccgtggtgagctacgccgtggccctgagctgccagtgcgccctgtgcagaagaagcaccaccgactgcggcggccccaaggaccaccccctgacctgcgacgaccccagattccaggacagcagcagcagcaaggcccccccccccagcctgcccagccccagcagactgcccggccccagcgacacccccatcctgccccagtag

SEQ ID NO: 76687 - DNA, 654 bp, Artificial Sequence
  Description of Artificial Sequence: Synthetic coding sequence
atggcccccggcagcagaaccagcctgctgctggccttcgccctgctgtgcctgccctggctgcaggaggccggcgccgtgcagaccgtgcccctgagcagactgttcgaccacgccatgctgcaggcccacagagcccaccagctggccatcgacacctaccaggagttcgaggagacctacatccccaaggaccagaagtacagcttcctgcacgacagccagaccagcttctgcttcagcgacagcatccccacccccagcaacatggaggagacccagcagaagagcaacctggagctgctgagaatcagcctgctgctgatcgagagctggctggagcccgtgagattcctgagaagcatgttcgccaacaacctggtgtacgacaccagcgacagcgacgactaccacctgctgaaggacctggaggagggcatccagaccctgatgggcagactggaggacggcagcagaagaaccggccagatcctgaagcagacctacagcaagttcgacaccaacagccacaaccacgacgccctgctgaagaactacggcctgctgtactgcttcagaaaggacatggacaaggtggagaccttcctgagaatggtgcagtgcagaagcgtggagggcagctgcggcttctag

SEQ ID NO: 76688 - DNA, 771 bp, Artificial Sequence
  Description of Artificial Sequence: Synthetic coding sequence
atggcccccggcagcagaaccagcctgctgctggccttcgccctgctgtgcctgccctggctgcaggaggccggcgccgtgcagaccgtgcccctgagcagactgttcgaccacgccatgctgcaggcccacagagcccaccagctggccatcgacacctaccaggagttcgaggagacctacatccccaaggaccagaagtacagcttcctgcacgacagccagaccagcttctgcttcagcgacagcatccccacccccagcaacatggaggagacccagcagaagagcaacctggagctgctgagaatcagcctgctgctgatcgagagctggctggagcccgtgagattcctgagaagcatgttcgccaacaacctggtgtacgacaccagcgacagcgacgactaccacctgctgaaggacctggaggagggcatccagaccctgatgggcgtgagagtggcccccggcgtgaccaaccccggcacccccctggccagcagagccggcggcgagaagtactgctgccccctgttcagcagcaaggccctgacccaggagaacagcccctacagcagcttcagactggtgaacccccccggcctgagcctgcaccccgagggcgagggcggcaagtggatcaacgagagaggcagagagcagtgccccagcgcctggcccctgctgctgttcctgcacttcgccgaggccggcagaagacagccccccgactgggccgacccccaggccgacctgcagcaggtgtag

SEQ ID NO: 76689 - DNA, 369 bp, Artificial Sequence
  Description of Artificial Sequence: Synthetic coding sequence
atggcccccggcagcagaaccagcctgctgctggccttcgccctgctgtgcctgccctggctgcaggaggccggcgccgtgcagaccgtgcccctgagcagactgttcgaccacgccatgctgcaggcccacagagcccaccagctggccatcgacacctaccaggagttcagactggaggacggcagcagaagaaccggccagatcctgaagcagacctacagcaagttcgacaccaacagccacaaccacgacgccctgctgaagaactacggcctgctgtactgcttcagaaaggacatggacaaggtggagaccttcctgagaatggtgcagtgcagaagcgtggagggcagctgcggcttctag

SEQ ID NO: 76690 - DNA, 552 bp, Artificial Sequence
  Description of Artificial Sequence: Synthetic coding sequence
atggcccccggcagcagaaccagcctgctgctggccttcgccctgctgtgcctgccctggctgcaggaggccgagacctacatccccaaggaccagaagtacagcttcctgcacgacagccagaccagcttctgcttcagcgacagcatccccacccccagcaacatggaggagacccagcagaagagcaacctggagctgctgagaatcagcctgctgctgatcgagagctggctggagcccgtgagattcctgagaagcatgttcgccaacaacctggtgtacgacaccagcgacagcgacgactaccacctgctgaaggacctggaggagggcatccagaccctgatgggcagactggaggacggcagcagaagaaccggccagatcctgaagcagacctacagcaagttcgacaccaacagccacaaccacgacgccctgctgaagaactacggcctgctgtactgcttcagaaaggacatggacaaggtggagaccttcctgagaatggtgcagtgcagaagcgtggagggcagctgcggcttctag

SEQ ID NO: 76691 - DNA, 504 bp, Artificial Sequence
  Description of Artificial Sequence: Synthetic coding sequence
atggccgccggcagcagaaccagcctgctgctggccttcgccctgctgtgcctgccctggctgcaggaggccggcgccgtgcagaccgtgcccctgagcagactgttcgaccacgccatgctgcaggcccacagagcccaccagctggccatcgacacctaccaggagttcgaggagacctacatccccaaggaccagaagtacagcttcctgcacgacagccagaccagcttctgcttcagcgacagcatccccacccccagcaacatggaggagacccagcagaagagcaacctggagctgctgagaatcagcctgctgctgatcgagagctggctggagcccgtgagattcctgagaagcatgttcgccaacaacctggtgtacgacaccagcgacagcgacgactaccacctgctgaaggacctggaggagggcatccagaccctgatgggcgtgagagtggcccccggcgtggccaaccccggcacccccctggcctag

SEQ ID NO: 76692 - DNA, 369 bp, Artificial Sequence
  Description of Artificial Sequence: Synthetic coding sequence
atggccgccggcagcagaaccagcctgctgctggccttcgccctgctgtgcctgccctggctgcaggaggccggcgccgtgcagaccgtgcccctgagcagactgttcgaccacgccatgctgcaggcccacagagcccaccagctggccatcgacacctaccaggagttcagactggaggacggcagcagaagaaccggccagatcctgaagcagacctacagcaagttcgacaccaacagccacaaccacgacgccctgctgaagaactacggcctgctgtactgcttcagaaaggacatggacaaggtggagaccttcctgagaatggtgcagtgcagaagcgtggagggcagctgcggcttctag

SEQ ID NO: 76693 - DNA, 654 bp, Artificial Sequence
  Description of Artificial Sequence: Synthetic coding sequence
atggccgccggcagcagaaccagcctgctgctggccttcgccctgctgtgcctgccctggctgcaggaggccggcgccgtgcagaccgtgcccctgagcagactgttcgaccacgccatgctgcaggcccacagagcccaccagctggccatcgacacctaccaggagttcgaggagacctacatccccaaggaccagaagtacagcttcctgcacgacagccagaccagcttctgcttcagcgacagcatccccacccccagcaacatggaggagacccagcagaagagcaacctggagctgctgagaatcagcctgctgctgatcgagagctggctggagcccgtgagattcctgagaagcatgttcgccaacaacctggtgtacgacaccagcgacagcgacgactaccacctgctgaaggacctggaggagggcatccagaccctgatgggcagactggaggacggcagcagaagaaccggccagatcctgaagcagacctacagcaagttcgacaccaacagccacaaccacgacgccctgctgaagaactacggcctgctgtactgcttcagaaaggacatggacaaggtggagaccttcctgagaatggtgcagtgcagaagcgtggagggcagctgcggcttctag

SEQ ID NO: 76694 - DNA, 483 bp, Artificial Sequence
  Description of Artificial Sequence: Synthetic coding sequence
atggccgccggcagcagaaccagcctgctgctggccttcgccctgctgtgcctgccctggctgcaggaggccgacagcatccccacccccagcaacatggaggagacccagcagaagagcaacctggagctgctgagaatcagcctgctgctgatcgagagctggctggagcccgtgagattcctgagaagcatgttcgccaacaacctggtgtacgacaccagcgacagcgacgactaccacctgctgaaggacctggaggagggcatccagaccctgatgggcagactggaggacggcagcagaagaaccggccagatcctgaagcagacctacagcaagttcgacaccaacagccacaaccacgacgccctgctgaagaactacggcctgctgtactgcttcagaaaggacatggacaaggtggagaccttcctgagaatggtgcagtgcagaagcgtggagggcagctgcggcttctag

SEQ ID NO: 76695 - DNA, 498 bp, Artificial Sequence
  Description of Artificial Sequence: Synthetic coding sequence
tgaggcagcagaaccagcctgctgctggccttcgccctgctgtgcctgccctggctgcaggaggccggcgccgtgcagaccgtgcccctgagcagactgttcgaccacgccatgctgcaggcccacagagcccaccagctggccatcgacacctaccaggagttcgaggagacctacatccccaaggaccagaagtacagcttcctgcacgacagccagaccagcttctgcttcagcgacagcatccccacccccagcaacatggaggagacccagcagaagagcaacctggagctgctgagaatcagcctgctgctgatcgagagctggctggagcccgtgagattcctgagaagcatgttcgccaacaacctggtgtacgacaccagcgacagcgacgactaccacctgctgaaggacctggaggagggcatccagaccctgatgggcgtgagagtggcccccggcgtggccaaccccggcacccccctggcctag

SEQ ID NO: 76696 - DNA, 669 bp, Artificial Sequence
  Description of Artificial Sequence: Synthetic coding sequence
atggccgccggcagcagaaccagcctgctgctggccttcgccctgctgtgcctgccctggctgcaggaggccggcgccgtgcagaccgtgcccctgagcagactgttcaaggaggccatgctgcaggcccacagagcccaccagctggccatcgacacctaccaggagttcatcagcagctggggcatggaggcctacatcaccaaggagcagaagtacagcttcctgcacgacagccagaccagcttctgcttcagcgacagcatccccaccagcagcaacatggaggagacccagcagaagagcaacctggagctgctgcacatcagcctgctgctgatcgagagcagactggagcccgtgagattcctgagaagcaccttcaccaacaacctggtgtacgacaccagcgacagcgacgactaccacctgctgaaggacctggaggagggcatccagatgctgatgggcagactggaggacggcagccacctgaccggccagaccctgaagcagacctacagcaagttcgacaccaacagccacaaccacgacgccctgctgaagaactacggcctgctgcactgcttcagaaaggacatggacaaggtggagaccttcctgagaatggtgcagtgcagaagcgtggagggcagctgcggcttctag

SEQ ID NO: 76697 - DNA, 387 bp, Artificial Sequence
  Description of Artificial Sequence: Synthetic coding sequence
atggaggagacccagcagaagagcaacctggagctgctgcacatcagcctgctgctgatcgagagcagactggagcccgtgagattcctgagaagcaccttcaccaacaacctggtgtacgacaccagcgacagcgacgactaccacctgctgaaggacctggaggagggcatccagatgctgatgggcagactggaggacggcagccacctgaccggccagaccctgaagcagacctacagcaagttcgacaccaacagccacaaccacgacgccctgctgaagaactacggcctgctgcactgcttcagaaaggacatggacaaggtggagaccttcctgagaatggtgcagtgcagaagcgtggagggcagctgcggcttctag

SEQ ID NO: 76698 - DNA, 522 bp, Artificial Sequence
  Description of Artificial Sequence: Synthetic coding sequence
atggccaccggcagcagaaccagcctgctgctggccttcgccctgctgtgcctgccctggctgcaggaggccggcgccgtgcagaccgtgcccctgagcagactgttcaaggaggccatgctgcaggcccacagagcccaccagctggccatcgacacctaccaggagttcatcagcagctggggcatgggcgccggccagggctggcaggagggcgtgaccttcccccactggggcagcaacggcagaagactgagaagcagcggcctgttcagcgaggccaagatgcaggccgacgagcacagactgagccaggtgcccagaagagtgaccgtgggcgccggcctgcagcacagaaagcagtggagcttcctggtgggcggccccagccccagaaagaagcccatcagccagagaaacagaagcatccacagctgcatgacccccagaccccccagcgccagccagaccctgttcagacacccccccacctggagaaagagaagcagaaaccccacctag

SEQ ID NO: 76699 - DNA, 420 bp, Artificial Sequence
  Description of Artificial Sequence: Synthetic coding sequence
atggccgccgacagcatccccaccagcagcaacatggaggagacccagcagaagagcaacctggagctgctgcacatcagcctgctgctgatcgagagcagactggagcccgtgagattcctgagaagcaccttcaccaacaacctggtgtacgacaccagcgacagcgacgactaccacctgctgaaggacctggaggagggcatccagatgctgatgggcagactggaggacggcagccacctgaccggccagaccctgaagcagacctacagcaagttcgacaccaacagccacaaccacgacgccctgctgaagaactacggcctgctgcactgcttcagaaaggacatggacaaggtggagaccttcctgagaatggtgcagtgcagaagcgtggagggcagctgcggcttctag

SEQ ID NO: 76700 - DNA, 1962 bp, Artificial Sequence
  Description of Artificial Sequence: Synthetic coding sequence
atggccgacaccctgcccagcgagttcgacgtgatcgtgatcggcaccggcctgcccgagagcatcatcgccgccgcctgcagcagaagcggcagaagagtgctgcacgtggacagcagaagctactacggcggcaactgggccagcttcagcttcagcggcctgctgagctggctgaaggagtaccaggagaacagcgacatcgtgagcgacagccccgtgtggcaggaccagatcctggagaacgaggaggccatcgccctgagcagaaaggacaagaccatccagcacgtggaggtgttctgctacgccagccaggacctgcacgaggacgtggaggaggccggcgccctgcagaagaaccacgccctggtgaccagcgccaacagcaccgaggccgccgacagcgccttcctgcccaccgaggacgagagcctgagcaccatgagctgcgagatgctgaccgagcagacccccagcagcgaccccgagaacgccctggaggtgaacggcgccgaggtgaccggcgagaaggagaaccactgcgacgacaagacctgcgtgcccagcaccagcgccgaggacatgagcgagaacgtgcccatcgccgaggacaccaccgagcagcccaagaagaacagaatcacctacagccagatcatcaaggagggcagaagattcaacatcgacctggtgagcaagctgctgtacagcagaggcctgctgatcgacctgctgatcaagagcaacgtgagcagatacgccgagttcaagaacatcaccagaatcctggccttcagagagggcagagtggagcaggtgccctgcagcagagccgacgtgttcaacagcaagcagctgaccatggtggagaagagaatgctgatgaagttcctgaccttctgcatggagtacgagaagtaccccgacgagtacaagggctacgaggagatcaccttctacgagtacctgaagacccagaagctgacccccaacctgcagtacatcgtgatgcacagcatcgccatgaccagcgagaccgccagcagcaccatcgacggcctgaaggccaccaagaacttcctgcactgcctgggcagatacggcaacacccccttcctgttccccctgtacggccagggcgagctgccccagtgcttctgcagaatgtgcgccgtgttcggcggcatctactgcctgagacacagcgtgcagtgcctggtggtggacaaggagagcagaaagtgcaaggccatcatcgaccagttcggccagagaatcatcagcgagcacttcctggtggaggacagctacttccccgagaacatgtgcagcagagtgcagtacagacagatcagcagagccgtgctgatcaccgacagaagcgtgctgaagaccgacagcgaccagcagatcagcatcctgaccgtgcccgccgaggagcccggcaccttcgccgtgagagtgatcgagctgtgcagcagcaccatgacctgcatgaagggcacctacctggtgcacctgacctgcaccagcagcaagaccgccagagaggacctggagagcgtggtgcagaagctgttcgtgccctacaccgagatggagatcgagaacgagcaggtggagaagcccagaatcctgtgggccctgtacttcaacatgagagacagcagcgacatcagcagaagctgctacaacgacctgcccagcaacgtgtacgtgtgcagcggccccgactgcggcctgggcaacgacaacgccgtgaagcaggccgagaccctgttccaggagatctgccccaacgaggacttctgcccccccccccccaaccccgaggacatcatcctggacggcgacagcctgcagcccgaggccagcgagagcagcgccatccccgaggccaacagcgagaccttcaaggagagcaccaacctgggcaacctggaggagagcagcgagtag

SEQ ID NO: 76701 - DNA, 333 bp, Artificial Sequence
  Description of Artificial Sequence: Synthetic coding sequence
atggccgacaccctgcccagcgagttcgacgtgatcgtgatcggcaccggcctgcccgagagcatcatcgccgccgcctgcagcagaagcggcagaagagtgctgcacgtggacagcagaagctactacggcggcaactgggccagcttcagcttcagcggcctgctgagctggctgaaggagtaccaggagaacagcgacatcgtgagcgacagccccgtgtggcaggaccagatcctggagaacgaggaggccatcgccctgagcagaaaggacaagaccatccagcacgtggaggtgttctgctacgccagaagcaccctgctgctgtag

SEQ ID NO: 76702 - DNA, 1518 bp, Artificial Sequence
  Description of Artificial Sequence: Synthetic coding sequence
atgagctgcgagatgctgaccgagcagacccccagcagcgaccccgagaacgccctggaggtgaacggcgccgaggtgaccggcgagaaggagaaccactgcgacgacaagacctgcgtgcccagcaccagcgccgaggacatgagcgagaacgtgcccatcgccgaggacaccaccgagcagcccaagaagaacagaatcacctacagccagatcatcaaggagggcagaagattcaacatcgacctggtgagcaagctgctgtacagcagaggcctgctgatcgacctgctgatcaagagcaacgtgagcagatacgccgagttcaagaacatcaccagaatcctggccttcagagagggcagagtggagcaggtgccctgcagcagagccgacgtgttcaacagcaagcagctgaccatggtggagaagagaatgctgatgaagttcctgaccttctgcatggagtacgagaagtaccccgacgagtacaagggctacgaggagatcaccttctacgagtacctgaagacccagaagctgacccccaacctgcagtacatcgtgatgcacagcatcgccatgaccagcgagaccgccagcagcaccatcgacggcctgaaggccaccaagaacttcctgcactgcctgggcagatacggcaacacccccttcctgttccccctgtacggccagggcgagctgccccagtgcttctgcagaatgtgcgccgtgttcggcggcatctactgcctgagacacagcgtgcagtgcctggtggtggacaaggagagcagaaagtgcaaggccatcatcgaccagttcggccagagaatcatcagcgagcacttcctggtggaggacagctacttccccgagaacatgtgcagcagagtgcagtacagacagatcagcagagccgtgctgatcaccgacagaagcgtgctgaagaccgacagcgaccagcagatcagcatcctgaccgtgcccgccgaggagcccggcaccttcgccgtgagagtgatcgagctgtgcagcagcaccatgacctgcatgaagggcacctacctggtgcacctgacctgcaccagcagcaagaccgccagagaggacctggagagcgtggtgcagaagctgttcgtgccctacaccgagatggagatcgagaacgagcaggtggagaagcccagaatcctgtgggccctgtacttcaacatgagagacagcagcgacatcagcagaagctgctacaacgacctgcccagcaacgtgtacgtgtgcagcggccccgactgcggcctgggcaacgacaacgccgtgaagcaggccgagaccctgttccaggagatctgccccaacgaggacttctgcccccccccccccaaccccgaggacatcatcctggacggcgacagcctgcagcccgaggccagcgagagcagcgccatccccgaggccaacagcgagaccttcaaggagagcaccaacctgggcaacctggaggagagcagcgagtag

SEQ ID NO: 76703 - DNA, 1971 bp, Artificial Sequence
  Description of Artificial Sequence: Synthetic coding sequence
atggccgacaacctgcccaccgagttcgacgtggtgatcatcggcaccggcctgcccgagagcatcctggccgccgcctgcagcagaagcggccagagagtgctgcacatcgacagcagaagctactacggcggcaactgggccagcttcagcttcagcggcctgctgagctggctgaaggagtaccagcagaacaacgacatcggcgaggagagcaccgtggtgtggcaggacctgatccacgagaccgaggaggccatcaccctgagaaagaaggacgagaccatccagcacaccgaggccttctgctacgccagccaggacatggaggacaacgtggaggagatcggcgccctgcagaagaaccccagcctgggcgtgagcaacaccttcaccgaggtgctggacagcgccctgcccgaggagagccagctgagctacttcaacagcgacgagatgcccgccaagcacacccagaagagcgacaccgagatcagcctggaggtgaccgacgtggaggagagcgtggagaaggagaagtactgcggcgacaagacctgcatgcacaccgtgagcgacaaggacggcgacaaggacgagagcaagagcaccgtggaggacaaggccgacgagcccatcagaaacagaatcacctacagccagatcgtgaaggagggcagaagattcaacatcgacctggtgagcaagctgctgtacagccagggcctgctgatcgacctgctgatcaagagcgacgtgagcagatacgtggagttcaagaacgtgaccagaatcctggccttcagagagggcaaggtggagcaggtgccctgcagcagagccgacgtgttcaacagcaaggagctgaccatggtggagaagagaatgctgatgaagttcctgaccttctgcctggagtacgagcagcaccccgacgagtaccaggccttcagacagtgcagcttcagcgagtacctgaagaccaagaagctgacccccaacctgcagcacttcgtgctgcacagcatcgccatgaccagcgagagcagctgcaccaccatcgacggcctgaacgccaccaagaacttcctgcagtgcctgggcagattcggcaacacccccttcctgttccccctgtacggccagggcgagatcccccagggcttctgcagaatgtgcgccgtgttcggcggcatctactgcctgagacacaaggtgcagtgcttcgtggtggacaaggagagcggcagatgcaaggccatcatcgaccacttcggccagagaatcaacgccaagtacttcatcgtggaggacagctacctgagcgaggagacctgcagcaacgtgcagtacaagcagatcagcagagccgtgctgatcaccgaccagagcatcctgaagaccgacctggaccagcagaccagcatcctgatcgtgccccccgccgagcccggcgcctgcgccgtgagagtgaccgagctgtgcagcagcaccatgacctgcatgaaggacacctacctggtgcacctgacctgcagcagcagcaagaccgccagagaggacctggagagcgtggtgaagaagctgttcaccccctacaccgagaccgagatcaacgaggaggagctgaccaagcccagactgctgtgggccctgtacttcaacatgagagacagcagcggcatcagcagaagcagctacaacggcctgcccagcaacgtgtacgtgtgcagcggccccgactgcggcctgggcaacgagcacgccgtgaagcaggccgagaccctgttccaggagatcttccccaccgaggagttctgcccccccccccccaaccccgaggacatcatcttcgacggcgacgacaagcagcccgaggcccccggcaccaacaacgtggtgatggccaagctggagagcagcgaggagagcaagaacctggagagccccgagaagcacctgcagaactag

SEQ ID NO: 76704 - DNA, 1641 bp, Artificial Sequence
  Description of Artificial Sequence: Synthetic coding sequence
atggagcagagaagagtgaccgacttcttcgccagaagaagacccggcccccccagaatcgccccccccaagctggcctgcagaacccccagccccgccagacccgccctgagagcccccgccagcgccaccagcggcagcagaaagagagccagaccccccgccgcccccggcagagaccaggccagaccccccgccagaagaagactgagactgagcgtggacgaggtgagcagccccagcacccccgaggcccccgacatccccgcctgccccagccccggccagaagatcaagaagagcacccccgccgccggccagcccccccacctgaccagcgcccaggaccaggacaccatcagcgagctggccagctgcctgcagagagccagagagctgggcgccagagtgagagccctgaaggccagcgcccaggacgccggcgagagctgcacccccgaggccgagggcagacccgaggagccctgcggcgagaaggcccccgcctaccagagattccacgccctggcccagcccggcctgcccggcctggtgctgccctacaagtaccaggtgctggccgagatgttcagaagcatggacaccatcgtgggcatgctgcacaacagaagcgagacccccaccttcgccaaggtgcagagaggcgtgcaggacatgatgagaagaagattcgaggagtgcaacgtgggccagatcaagaccgtgtaccccgccagctacagattcagacaggagagaagcgtgcccaccttcaaggacggcaccagaagaagcgactaccagctgaccatcgagcccctgctggagcaggaggccgacggcgccgccccccagctgaccgccagcagactgctgcagagaagacagatcttcagccagaagctggtggagcacgtgaaggagcaccacaaggccttcctggccagcctgagccccgccatggtggtgcccgaggaccagctgaccagatggcaccccagattcaacgtggacgaggtgcccgacatcgagcccgccgccctgccccagccccccgccaccgagaagctgaccaccgcccaggaggtgctggccagagccagaaacctgatcagccccagaatggagaaggccctgagccagctggccctgagaagcgccgcccccagcagccccggcagccccagacccgccctgcccgccaccccccccgccaccccccccgccgccagccccagcgccctgaagggcgtgagccaggacctgctggagagaatcagagccaaggaggcccagaagcagctggcccagatgaccagatgccccgagcaggagcagagactgcagagactggagagactgcccgagctggccagagtgctgagaagcgtgttcgtgagcgagagaaagcccgccctgagcatggaggtggcctgcgccagaatggtgggcagctgctgcaccatcatgagccccggcgagatggagaagcacctgctgctgctgagcgagctgctgcccgactggctgagcctgcacagaatcagaaccgacacctacgtgaagctggacaaggccgccgacctggcccacatcaccgccagactggcccaccagaccagagccgaggagggcctgtag

SEQ ID NO: 76705 - DNA, 306 bp, Artificial Sequence
  Description of Artificial Sequence: Synthetic coding sequence
atgcagcagcagcagcagctggccagcgccagaaacagaagactggcccagcagatggagaacagacccagcgtgcaggccgccctgaagctgaagcagaagagcctgaagcagagactgggcaagagcaacatccaggccagactgggcagacccatcggcgccctggccagaggcgccatcggcggcagaggcctgcccatcatccagagaggcctgcccagaggcggcctgagaggcggcagagccaccagaaccctgctgagaggcggcatgagcctgagaggccagtgctgcgtgccctag

SEQ ID NO: 76706 - DNA, 672 bp, Artificial Sequence
  Description of Artificial Sequence: Synthetic coding sequence
atgctgaagaacaagcagcccacccccgtgaacatcagagccagcatgcagcagcagcagcagctggccagcgccagaaacagaagactggcccagcagatggagaacagacccagcgtgcaggccgccctgaagctgaagcagagcctgaagcagagactgggcaagagcaacatccaggccagactgggcagacccatcggcgccctggccagaggcgccatcggcggcagaggcctgcccatcatccagagaggcctgcccagaggcggcctgagaggcggcagagccaccagaaccctgctgagaggcggcatgagcctgagaggccagaacctgctgagaggcggcagagccgtggcccccagaatgggcctgagaagaggcggcgtgagaggcagaggcggccccggcagaggcggcctgggcagaggcgccatgggcagaggcggcatcggcggcagaggcagaggcatgatcggcagaggcagaggcggcttcggcggcagaggcagaggcagaggcagaggcagaggcgccctggccagacccgtgctgaccaaggagcagctggacaaccagctggacgcctacatgagcaagaccaagggccacctggacgccgagctggacgcctacatggcccagaccgaccccgagaccaacgactag

SEQ ID NO: 76707 - DNA, 609 bp, Artificial Sequence
  Description of Artificial Sequence: Synthetic coding sequence
atggccgcccagagcgcccccaaggtggtgctgaagagcaccaccaagatgagcctgaacgagagattcaccaacatgctgaagaacaagcagcccacccccgtgaacatcagagccagcatgcagcagcagcagcagctggccagcgccagaaacagaagactggcccagcagatggagaacagacccagcgtgcaggccgccctgaagctgaagcagagcctgaagcagagactgggcaagagcaacatccaggccagactgggcagacccatcggcgccctggccagaggcgccatcggcggcagaggcctgcccatcatccagagaggcctgcccagaggcggcctgagaggcggcagagccaccagaaccctgctgagaggcggcatgagcctgagaggcagaggcatgatcggcagaggcagaggcggcttcggcggcagaggcagaggcagaggcagaggcagaggcgccctggccagacccgtgctgaccaaggagcagctggacaaccagctggacgcctacatgagcaagaccaagggccacctggacgccgagctggacgcctacatggcccagaccgaccccgagaccaacgactag

SEQ ID NO: 76708 - DNA, 747 bp, Artificial Sequence
  Description of Artificial Sequence: Synthetic coding sequence
atggccgcccagagcgcccccaaggtggtgctgaagagcaccaccaagatgagcctgaacgagagattcaccaacatgctgaagaacaagcagcccacccccgtgaacatcagagccagcatgcagcagcagcagcagctggccagcgccagaaacagaagactggcccagcagatggagaacagacccagcgtgcaggccgccctgaagctgaagcagagcctgaagcagagactgggcaagagcaacatccaggccagactgggcagacccatcggcgccctggccagaggcgccatcggcggcagaggcctgcccatcatccagagaggcctgcccagaggcggcctgagaggcggcagagccaccagaaccctgctgagaggcggcatgagcctgagaggccagaacctgctgagaggcggcagagccgtggcccccagaatgggcctgagaagaggcggcgtgagaggcagaggcggccccggcagaggcggcctgggcagaggcgccatgggcagaggcggcatcggcggcagaggcagaggcatgatcggcagaggcagaggcggcttcggcggcagaggcagaggcagaggcagaggcagaggcgccctggccagacccgtgctgaccaaggagcagctggacaaccagctggacgcctacatgagcaagaccaagggccacctggacgccgagctggacgcctacatggcccagaccgaccccgagaccaacgactag

SEQ ID NO: 76709 - DNA, 609 bp, Artificial Sequence; identical to SEQ ID NO: 76707
  Description of Artificial Sequence: Synthetic coding sequence

SEQ ID NO: 76710 - DNA, 636 bp, Artificial Sequence
  Description of Artificial Sequence: Synthetic coding sequence
atggaggagctgagcagcgtgggcgagcaggtgttcgccgccgagtgcatcctgagcaagagactgagaaagggcaagctggagtacctggtgaagtggagaggctggagcagcaagcacaacagctgggagcccgaggagaacatcctggaccccagactgctgctggccttccagaagaaggagcacgagaaggaggtgcagaacagaaagagaggcaagagacccagaggcagacccagaaagctgaccgccatgagcagctgcagcagaagaagcaagctgaaggtgggcggctgcgccggctacgccgaccccaccagccagcaccccctgggcgtgggcggcagacagagagagggcctgggccccagcggcagaggctggcacttctgccagcagagcgtgcccctgctgggcaagcaggagccccccttcttcctgagcctgagcttctgctgccagggcccccagcccgccgagagcagcagcccccccctgcccggcgccagctgcttcagcctgagctgcacccccctgtgctgggtggccggcagcaactgctgcagacaggccctgttcccccccagaggcagcctgggcgacggcaaggagcaggaggcctgcgtgcagtag

SEQ ID NO: 76711 - DNA, 1599 bp, Artificial Sequence
  Description of Artificial Sequence: Synthetic coding sequence
atggaggagctgagcagcgtgggcgagcaggtgttcgccgccgagtgcatcctgagcaagagactgagaaagggcaagctggagtacctggtgaagtggagaggctggagcagcaagcacaacagctgggagcccgaggagaacatcctggaccccagactgctgctggccttccagaagaaggagcacgagaaggaggtgcagaacagaaagagaggcaagagacccagaggcagacccagaaagctgaccgccatgagcagctgcagcagaagaagcaagctgaaggagcccgacgcccccagcaagagcaagagcagcagcagcagcagcagcagcaccagcagcagcagcagcagcgacgaggaggacgacagcgacctggacgccaagagaggccccagaggcagagagacccaccccgtgccccagaagaaggcccagatcctggtggccaagcccgagctgaaggaccccatcagaaagaagagaggcagaaagcccctgccccccgagcagaaggccaccagaagacccgtgagcctggccaaggtgctgaagaccgccagaaaggacctgggcgcccccgccagcaagctgcccccccccctgagcgcccccgtggccggcctggccgccctgaaggcccacgccaaggaggcctgcggcggccccagcgccatggccacccccgagaacctggccagcctgatgaagggcatggccagcagccccggcagaggcggcatcagctggcagagcagcatcgtgcactacatgaacagaatgacccagagccaggcccaggccgccagcagactggccctgaaggcccaggccaccaacaagtgcggcctgggcctggacctgaaggtgagaacccagaagggcgagctgggcatgagcccccccggcagcaagatccccaaggcccccagcggcggcgccgtggagcagaaggtgggcaacaccggcggccccccccacacccacggcgccagcagagtgcccgccggctgccccggcccccagcccgcccccacccaggagctgagcctgcaggtgctggacctgcagagcgtgaagaacggcatgcccggcgtgggcctgctggccagacacgccaccgccaccaagggcgtgcccgccaccaaccccgcccccggcaagggcaccggcagcggcctgatcggcgccagcggcgccaccatgcccaccgacaccagcaagagcgagaagctggccagcagagccgtggccccccccacccccgccagcaagagagactgcgtgaagggcagcgccacccccagcggccaggagagcagaaccgcccccggcgaggccagaaaggccgccaccctgcccgagatgagcgccggcgaggagagcagcagcagcgacagcgaccccgacagcgccagcccccccagcaccggccagaaccccagcgtgagcgtgcagaccagccaggactggaagcccaccagaagcctgatcgagcacgtgttcgtgaccgacgtgaccgccaacctgatcaccgtgaccgtgaaggagagccccaccagcgtgggcttcttcaacctgagacactactag

SEQ ID NO: 76712 - DNA, 1935 bp, Artificial Sequence
  Description of Artificial Sequence: Synthetic coding sequence
atggaggccgagagaggccccgagagaagacccgccgagagaagcagccccggccagacccccgaggagggcgcccaggccctggccgagttcgccgccctgcacggccccgccctgagagccagcggcgtgcccgagagatactggggcagactgctgcacaagctggagcacgaggtgttcgacgccggcgaggtgttcggcatcatgcaggtggaggaggtggaggaggaggaggacgaggccgccagagaggtgagaaagcagcagcccaaccccggcaacgagctgtgctacaaggtgatcgtgaccagagagagcggcctgcaggccgcccaccccaacagcatcttcctgatcgaccacgcctggacctgcagagtggagcacgccagacagcagctgcagcaggtgcccggcctgctgcacagaatggccaacctgatgggcatcgagttccacggcgagctgcccagcaccgaggccgtggccctggtgctggaggagatgtggaagttcaaccagacctaccagctggcccacggcaccgccgaggagaagatgcccgtgtggtacatcatggacgagttcggcagcagaatccagcacgccgacgtgcccagcttcgccaccgcccccttcttctacatgccccagcaggtggcctacaccctgctgtggcccctgagagacctggacaccggcgaggaggtgaccagagacttcgcctacggcgagaccgaccccctgatcagaaagtgcatgctgctgccctgggcccccaccgacatgctggacctgagcagctgcacccccgagccccccgccgagcactaccaggccatcctggaggagaacaaggagaagctgcccctggacatcaaccccgtggtgcacccccacggccacatcttcaaggtgtacaccgacgtgcagcaggtggccagcagcctgacccaccccagattcaccctgacccagagcgaggccgacgccgacatcctgttcaacttcagccacttcaaggactacagaaagctgagccaggagagacccggcgtgctgctgaaccagttcccctgcgagaacctgctgaccgtgaaggactgcctggccagcatcgccagaagagccggcggccccgagggccccccctggctgcccagaaccttcaacctgagaaccgagctgccccagttcgtgagctacttccagcagagagagagatggggcgaggacaaccactggatctgcaagccctggaacctggccagaagcctggacacccacgtgaccaagagcctgcacagcatcatcagacacagagagagcacccccaaggtggtgagcaagtacatcgagagccccgtgctgttcctgagagaggacgtgggcaaggtgaagttcgacatcagatacatcgtgctgctgagaagcgtgagacccctgagactgttcgtgtacgacgtgttctggctgagattcagcaacagagccttcgccctgaacgacctggacgactacgagaagcacttcaccgtgatgaactacgaccccgacgtggtgctgaagcaggtgcactgcgaggagttcatccccgagttcgagaagcagtaccccgagttcccctggaccgacgtgcaggccgagatcttcagagccttcaccgagctgttccaggtggcctgcgccaagcccccccccctgggcctgtgcgactaccccagcagcagagccatgtacgccgtggacctgatgctgaagtgggacaacggccccgacggcagaagagtgatgcagccccagatcctggaggtgaacttcaaccccgactgcgagagagcctgcagataccaccccaccttcttcaacgacgtgttcagcaccctgttcctggaccagcccggcggctgccacgtgacctgcctggtgtag

SEQ ID NO: 76713 - DNA, 477 bp, Artificial Sequence
  Description of Artificial Sequence: Synthetic coding sequence
atggagctgagcgccatcggcgagcaggtgttcgccgtggagagcatcagaaagaagagagtgagaaagggcaaggtggagtacctggtgaagtggaagggctggccccccaagtacagcacctgggagcccgaggagcacatcctggaccccagactggtgatggcctacgaggagaaggaggagagagacagagccagcggctacagaaagagaggccccaagcccaagagactgctgctgcaggagccccccgcccccgacgtgctgcaggccgccggcgagtgggagcccgccgcccagccccccgaggaggaggccgacgccgacctggccgagggcccccccccctggacccccgccctgcccagcagcgaggtgaccgtgaccgacatcaccgccaacagcatcaccgtgaccttcagagaggcccaggccgccgagggcttcttcagagacagaagcggcaagttctag

SEQ ID NO: 76714 - DNA, 366 bp, Artificial Sequence
  Description of Artificial Sequence: Synthetic coding sequence
atggagctgagcgccatcggcgagcaggtgttcgccgtggagagcatcagaaagaagagagtgagaaagggcaaggtggagtacctggtgaagtggaagggctggccccccaaggaggagagagacagagccagcggctacagaaagagaggccccaagcccaagagactgctgctgcagagactgtacagcatggacctgagaagcagccacaaggccaagggcaaggagaagctgtgcttcagcctgacctgccccctgggcagcggcagccccgagggcgtggtgaaggccggcgcccccgagctggtggacaagggccccctggtgcccaccctgcccttccccctgagaaagcccagatag

SEQ ID NO: 76715 - DNA, 5133 bp, Artificial Sequence
  Description of Artificial Sequence: Synthetic coding sequence
atgaacggccacagcgacgaggagagcgtgagaaacagcagcggcgagagcagccagagcgacgacgacagcggcagcgccagcggcagcggcagcggcagcagcagcggcagcagcagcgacggcagcagcagccagagcggcagcagcgacagcgacagcggcagcgagagcggcagccagagcgagagcgagagcgacaccagcagagagaacaaggtgcaggccaagccccccaaggtggacggcgccgagttctggaagagcagccccagcatcctggccgtgcagagaagcgccatcctgaagaagcagcagcagcagcagcagcagcagcagcaccaggccagcagcaacagcggcagcgaggaggacagcagcagcagcgaggacagcgacgacagcagcagcgaggtgaagagaaagaagcacaaggacgaggactggcagatgagcggcagcggcagccccagccagagcggcagcgacagcgagagcgaggaggagagagagaagagcagctgcgacgagaccgagagcgactacgagcccaagaacaaggtgaagagcagaaagccccagaacagaagcaagagcaagaacggcaagaagatcctgggccagaagaagagacagatcgacagcagcgaggaggacgacgacgaggaggactacgacaacgacaagagaagcagcagaagacaggccaccgtgaacgtgagctacaaggaggacgaggagatgaagaccgacagcgacgacctgctggaggtgtgcggcgaggacgtgccccagcccgaggaggaggagttcgagaccatcgagagattcatggactgcagaatcggcagaaagggcgccaccggcgccaccaccaccatctacgccgtggaggccgacggcgaccccaacgccggcttcgagaagaacaaggagcccggcgagatccagtacctgatcaagtggaagggctggagccacatccacaacacctgggagaccgaggagaccctgaagcagcagaacgtgagaggcatgaagaagctggacaactacaagaagaaggaccaggagaccaagagatggctgaagaacgccagccccgaggacgtggagtactacaactgccagcaggagctgaccgacgacctgcacaagcagtaccagatcgtggagagaatcatcgcccacagcaaccagaagagcgccgccggctaccccgactactactgcaagtggcagggcctgccctacagcgagtgcagctgggaggacggcgccctgatcagcaagaagttccaggcctgcatcgacgagtacttcagcagaaaccagagcaagaccacccccttcaaggactgcaaggtgctgaagcagagacccagattcgtggccctgaagaagcagcccagctacatcggcggccacgagggcctggagctgagagactaccagctgaacggcctgaactggctggcccacagctggtgcaagggcaacagctgcatcctggccgacgagatgggcctgggcaagaccatccagaccatcagcttcctgaactacctgttccacgagcaccagctgtacggccccttcctgctggtggtgcccctgagcaccctgaccagctggcagagagagatccagacctgggccagccagatgaacgccgtggtgtacctgggcgacatcaacagcagaaacatgatcagaacccacgagtggacccaccaccagaccaagagactgaagttcaacatcctgctgaccacctacgagatcctgctgaaggacaaggccttcctgggcggcctgaactgggccttcatcggcgtggacgaggcccacagactgaagaacgacgacagcctgctgtacaagaccctgatcgacttcaagagcaaccacagactgctgatcaccggcacccccctgcagaacagcctgaaggagctgtggagcctgctgcacttcatcatgcccgagaagttcagcagctgggaggacttcgaggaggagcacggcaagggcagagagtacggctacgccagcctgcacaaggagctggagcccttcctgctgagaagagtgaagaaggacgtggagaagagcctgcccgccaaggtggagcagatcctgagaatggagatgagcgccctgcagaagcagtactacaagtggatcctgaccagaaactacaaggccctgagcaagggcagcaagggcagcaccagcggcttcctgaacatcatgatggagctgaagaagtgctgcaaccactgctacctgatcaagccccccgacaacaacgagttctacaacaagcaggaggccctgcagcacctgatcagaagcagcggcaagctgatcctgctggacaagctgctgatcagactgagagagagaggcaacagagtgctgatcttcagccagatggtgagaatgctggacatcctggccgagtacctgaagtacagacagttccccttccagagactggacggcagcatcaagggcgagctgagaaagcaggccctggaccacttcaacgccgagggcagcgaggacttctgcttcctgctgagcaccagagccggcggcctgggcatcaacctggccagcgccgacaccgtggtgatcttcgacagcgactggaacccccagaacgacctgcaggcccaggccagagcccacagaatcggccagaagaagcaggtgaacatctacagactggtgaccaagggcagcgtggaggaggacatcctggagagagccaagaagaagatggtgctggaccacctggtgatccagagaatggacaccaccggcaagaccgtgctgcacaccggcagcgcccccagcagcagcacccccttcaacaaggaggagctgagcgccatcctgaagttcggcgccgaggagctgttcaaggagcccgagggcgaggagcaggagccccaggagatggacatcgacgagatcctgaagagagccgagacccacgagaacgagcccggccccctgaccgtgggcgacgagctgctgagccagttcaaggtggccaacttcagcaacatggacgaggacgacatcgagctggagcccgagagaaacagcaagaactgggaggagatcatccccgaggaccagagaagaagactggaggaggaggagagacagaaggagctggaggagatctacatgctgcccagaatgagaaactgcgccaagcagatcagcttcaacggcagcgagggcagaagaagcagaagcagaagatacagcggcagcgacagcgacagcatcagcgagggcaagagacccaagaagagaggcagacccagaaccatccccagagagaacatcaagggcttcagcgacgccgagatcagaagattcatcaagagctacaagaagttcggcggccccctggagagactggacgccatcgccagagacgccgagctggtggacaagagcgagaccgacctgagaagactgggcgagctggtgcacaacggctgcatcaaggccctgaaggacagcagcagcggcaccgagagaaccggcggcagactgggcaaggtgaagggccccaccttcagaatcagcggcgtgcaggtgaacgccaagctggtgatcagccacgaggaggagctgatccccctgcacaagagcatccccagcgaccccgaggagagaaagcagtacaccatcccctgccacaccaaggccgcccacttcgacatcgactggggcaaggaggacgacagcaacctgctgatcggcatctacgagtacggctacggcagctgggagatgatcaagatggaccccgacctgagcctgacccacaagatcctgcccgacgaccccgacaagaagccccaggccaagcagctgcagaccagagccgactacctgatcaagctgctgagcagagacctggccaagaaggaggccctgagcggcgccggcagcagcaagagaagaaaggccagagccaagaagaacaaggccatgaagagcatcaaggtgaaggaggagatcaagagcgacagcagccccctgcccagcgagaagagcgacgaggacgacgacaagctgagcgagagcaagagcgacggcagagagagaagcaagaagagcagcgtgagcgacgcccccgtgcacatcaccgccagcggcgagcccgtgcccatcagcgaggagagcgaggagctggaccagaagaccttcagcatctgcaaggagagaatgagacccgtgaaggccgccctgaagcagctggacagacccgagaagggcctgagcgagagagagcagctggagcacaccagacagtgcctgatcaagatcggcgaccacatcaccgagtgcctgaaggagtacaccaaccccgagcagatcaagcagtggagaaagaacctgtggatcttcgtgagcaagttcaccgagttcgacgccagaaagctgcacaagctgtacaagcacgccatcaagaagagacaggagagccagcagaacagcgaccagaacagcaacctgaacccccacgtgatcagaaaccccgacgtggagagactgaaggagaacaccaaccacgacgacagcagcagagacagctacagcagcgacagacacctgacccagtaccacgaccaccacaaggacagacaccagggcgacagctacaagaagagcgacagcagaaagagaccctacagcagcttcagcaacggcaaggaccacagagactgggaccactacaagcaggacagcagatactacagcgacagagagaagcacagaaagctggacgaccacagaagcagagaccacagaagcaacctggagggcagcctgaaggacagaagccacagcgaccacagaagccacagcgaccacagactgcacagcgaccacagaagcagcagcgagtacacccaccacaagagcagcagagactacagataccacagcgactggcagatggaccacagagccagcagcagcggccccagaagccccctggaccagagaagcccctacggcagcagaagccccttcgagcacagcgtggagcacaagagcacccccgagcacacctggagcagcagaaagacctag

SEQ ID NO: 76716 - DNA, 903 bp, Artificial Sequence
  Description of Artificial Sequence: Synthetic coding sequence
atgttcagcttcaccggcgtgctggtgatctacgaggtgctgaagaagtgcatcggcaagctgatcagcctgagagtgtgcagcatcgagggctgcgtgtgcgtgtacgtgttcgtgcccggcggcaaggagttccacgagaagctgaacatcttccaccagaccaacctgatctgcctgttcctgaacagcagcagaaacctgtggatcttcgtgagcaagttcaccgagttcgacgccagaaagctgcacaagctgtacaagcacgccatcaagaagagacaggagagccagcagaacagcgaccagaacagcaacctgaacccccacgtgatcagaaaccccgacgtggagagactgaaggagaacaccaaccacgacgacagcagcagagacagctacagcagcgacagacacctgacccagtaccacgaccaccacaaggacagacaccagggcgacagctacaagaagagcgacagcagaaagagaccctacagcagcttcagcaacggcaaggaccacagagactgggaccactacaagcaggacagcagatactacagcgacagagagaagcacagaaagctggacgaccacagaagcagagaccacagaagcaacctggagggcagcctgaaggacagaagccacagcgaccacagaagccacagcgaccacagactgcacagcgaccacagaagcagcagcgagtacacccaccacaagagcagcagagactacagataccacagcgactggcagatggaccacagagccagcagcagcggccccagaagccccctggaccagagaagcccctacggcagcagaagccccttcgagcacagcgtggagcacaagagcacccccgagcacacctggagcagcagaaagacctag

SEQ ID NO: 76717 - DNA, 624 bp, Artificial Sequence
  Description of Artificial Sequence: Synthetic coding sequence
atgaacggccacagcgacgaggagagcgtgagaaacagcagcggcgagagcagccagagcgacgacgacagcggcagcgccagcggcagcggcagcggcagcagcagcggcagcagcagcgacggcagcagcagccagagcggcagcagcgacagcgacagcggcagcgagagcggcagccagagcgagagcgagagcgacaccagcagagagaacaaggtgcaggccaagccccccaaggtggacggcgccgagttctggaagagcagccccagcatcctggccgtgcagagaagcgccatcctgaagaagcagcagcagcagcagcagcagcagcagcaccaggccagcagcaacagcggcagcgaggaggacagcagcagcagcgaggacagcgacgacagcagcagcgaggtgaagagaaagaagcacaaggacgaggactggcagatgagcggcagcggcagccccagccagagcggcagcgacagcgagagcgaggaggagagagagaagagcagctgcgacgagaccgagagcgactacgagcccaagaacaaggtgaagagcagaaagccccagaacagaagcaagagcaagaacgagaagaagaagaagaagtag

SEQ ID NO: 76718 - DNA, 660 bp, Artificial Sequence
  Description of Artificial Sequence: Synthetic coding sequence
gtgggcgccgacagagacagccccaccctgctgcccgccggcggcagcaactggctggcccagagattccactgccagaacggctgcatcctgggcgacgagatgggcctgggcaagacctgccagaccatcgccctgttcatctacctggccggcagactgaacgacgagggccccttcctgatcctgtgccccctgagcgtggagcagctggagagaagaaacgccgagatctgcagcagaagcttcctgtgcaacatctgcggcgacaaggaggagagagcctgcctgcagcaggacctgaagcaggagagcagattccacgtgctgctgaccacctacgagatctgcctgaaggacgccagcttcctgaagagcttcccctggagcgtgctggtggtggacgaggcccacagactgaagaaccagagcagcctgctgcacaagaccctgagcgagttcagcgtggtgttcagcctgctgctgaccggcacccccatccagaacagcctgcaggagctgtacagcctgctgagcttcgtggagcccgacctgttcagcaaggaggagtgggagatcctgttcaacgccaccagaatcctgagaaagaacctgagccagcaggtgaactgcaccaacagctgcagccacttctgctag

SEQ ID NO: 76719 - DNA, 1851 bp, Artificial Sequence
  Description of Artificial Sequence: Synthetic coding sequence
atgagcgccctgcagaagaagtactacaaggccatcctgatgaaggacctggacgccttcgagaacgagaccgccaagaaggtgaagctgcagaacatcctgagccagctgagaaagtgcgtggaccacccctacctgttcgacggcgtggagcccgagcccttcgaggtgggcgaccacctgaccgaggccagcggcaagctgcacctgctggacaagctgctggccttcctgtacagcggcggccacagagtgctgctgttcagccagatgacccagatgctggacatcctgcaggactacatggactacagaggctacagctacgagagagtggacggcagcgtgagaggcgaggagagacacctggccatcaagaacttcggccagcagcccatcttcgtgttcctgctgagcaccagagccggcggcgtgggcatgaacctgaccgccgccgacaccgtgatcttcgtggacagcgacttcaacccccagaacgacctgcaggccgccgccagagcccacagaatcggccagaacaagagcgtgaaggtgatcagactgatcggcagagacaccgtggaggagatcgtgtacagaaaggccgccagcaagctgcagctgaccaacatgatcatcgagggcggccacttcaccctgggcgcccagaagcccgccgccgacgccgacctgcagctgagcgagatcctgaagttcggcctggacaagctgctggccagcgagggcagcaccatggacgagatcgacctggagagcatcctgggcgagaccaaggacggccagtgggtgagcgacgccctgcccgccgccgagggcggcagcagagaccaggaggagggcaagaaccacatgtacctgttcgagggcaaggactacagcaaggagcccagcaaggaggacagaaagagcttcgagcagctggtgaacctgcagaagaccctgctggagaaggccagccaggagggcagaagcctgagaaacaagggcagcgtgctgatccccggcctggtggagggcagcaccaagagaaagagagtgctgagccccgaggagctggaggacagacagaagaagagacaggaggccgccgccaagagaagaagactgatcgaggagaagaagagacagaaggaggaggccgagcacaagaagaagatggcctggtgggagagcaacaactaccagagcttctgcctgcccagcgaggagagcgagcccgaggacctggagaacggcgaggagagcagcgccgagctggactaccaggaccccgacgccaccagcctgaagtacgtgagcggcgacgtgacccacccccaggccggcgccgaggacgccctgatcgtgcactgcgtggacgacagcggccactggggcagaggcggcctgttcaccgccctggagaagagaagcgccgagcccagaaagatctacgagctggccggcaagatgaaggacctgagcctgggcggcgtgctgctgttccccgtggacgacaaggagagcagaaacaagggccaggacctgctggccctgatcgtggcccagcacagagacagaagcaacgtgctgagcggcatcaagatggccgccctggaggagggcctgaagaagatcttcctggccgccaagaagaagaaggccagcgtgcacctgcccagaatcggccacgccaccaagggcttcaactggtacggcaccgagagactgatcagaaagcacctggccgccagaggcatccccacctacatctactacttccccagaagcaagagcgccgtgctgcacgcccagagcagcagcagcagcagcagacagctggtgccctag

SEQ ID NO: 76720 - DNA, 2694 bp, Artificial Sequence
  Description of Artificial Sequence: Synthetic coding sequence
atggagagagccggcgccaccagcagaggcggccaggcccccggcttcctgctgagactgcacaccgagggcagagccgaggccgccagagtgcaggagcaggacctgagacagtggggcctgaccggcatccacctgagaagctaccagctggagggcgtgaactggctggcccagagattccactgccagaacggctgcatcctgggcgacgagatgggcctgggcaagacctgccagaccatcgccctgttcatctacctggccggcagactgaacgacgagggccccttcctgatcctgtgccccctgagcgtgctgagcaactggaaggaggagatgcagagattcgcccccggcctgagctgcgtgacctacgccggcgacaaggaggagagagcctgcctgcagcaggacctgaagcaggagagcagattccacgtgctgctgaccacctacgagatctgcctgaaggacgccagcttcctgaagagcttcccctggagcgtgctggtggtggacgaggcccacagactgaagaaccagagcagcctgctgcacaagaccctgagcgagttcagcgtggtgttcagcctgctgctgaccggcacccccatccagaacagcctgcaggagctgtacagcctgctgagcttcgtggagcccgacctgttcagcaaggaggaggtgggcgacttcatccagagataccaggacatcgagaaggagagcgagagcgccagcgagctgcacaagctgctgcagcccttcctgctgagaagagtgaaggccgaggtggccaccgagctgcccaagaagaccgaggtggtgatctaccacggcatgagcgccctgcagaagaagtactacaaggccatcctgatgaaggacctggacgccttcgagaacgagaccgccaagaaggtgaagctgcagaacatcctgagccagctgagaaagtgcgtggaccacccctacctgttcgacggcgtggagcccgagcccttcgaggtgggcgaccacctgaccgaggccagcggcaagctgcacctgctggacaagctgctggccttcctgtacagcggcggccacagagtgctgctgttcagccagatgacccagatgctggacatcctgcaggactacatggactacagaggctacagctacgagagagtggacggcagcgtgagaggcgaggagagacacctggccatcaagaacttcggccagcagcccatcttcgtgttcctgctgagcaccagagccggcggcgtgggcatgaacctgaccgccgccgacaccgtgatcttcgtggacagcgacttcaacccccagaacgacctgcaggccgccgccagagcccacagaatcggccagaacaagagcgtgaaggtgatcagactgatcggcagagacaccgtggaggagatcgtgtacagaaaggccgccagcaagctgcagctgaccaacatgatcatcgagggcggccacttcaccctgggcgcccagaagcccgccgccgacgccgacctgcagctgagcgagatcctgaagttcggcctggacaagctgctggccagcgagggcagcaccatggacgagatcgacctggagagcatcctgggcgagaccaaggacggccagtgggtgagcgacgccctgcccgccgccgagggcggcagcagagaccaggaggagggcaagaaccacatgtacctgttcgagggcaaggactacagcaaggagcccagcaaggaggacagaaagagcttcgagcagctggtgaacctgcagaagaccctgctggagaaggccagccaggagggcagaagcctgagaaacaagggcagcgtgctgatccccggcctggtggagggcagcaccaagagaaagagagtgctgagccccgaggagctggaggacagacagaagaagagacaggaggccgccgccaagagaagaagactgatcgaggagaagaagagacagaaggaggaggccgagcacaagaagaagatggcctggtgggagagcaacaactaccagagcttctgcctgcccagcgaggagagcgagcccgaggacctggagaacggcgaggagagcagcgccgagctggactaccaggaccccgacgccaccagcctgaagtacgtgagcggcgacgtgacccacccccaggccggcgccgaggacgccctgatcgtgcactgcgtggacgacagcggccactggggcagaggcggcctgttcaccgccctggagaagagaagcgccgagcccagaaagatctacgagctggccggcaagatgaaggacctgagcctgggcggcgtgctgctgttccccgtggacgacaaggagagcagaaacaagggccaggacctgctggccctgatcgtggcccagcacagagacagaagcaacgtgctgagcggcatcaagatggccgccctggaggagggcctgaagaagatcttcctggccgccaagaagaagaaggccagcgtgcacctgcccagaatcggccacgccaccaagggcttcaactggtacggcaccgagagactgatcagaaagcacctggccgccagaggcatccccacctacatctactacttccccagaagcaagagcgccgtgctgcacgcccagagcagcagcagcagcagcagacagctggtgccctag

SEQ ID NO: 76721 - DNA, 2082 bp, Artificial Sequence
  Description of Artificial Sequence: Synthetic coding sequence
atggagagagccggcgccaccagcagaggcggccaggcccccggcttcctgctgagactgcacaccgagggcagagccgaggccgccagagtgcaggagcaggacctgagacagtggggcctgaccgccagcgagctgcacaagctgctgcagcccttcctgctgagaagagtgaaggccgaggtggccaccgagctgcccaagaagaccgaggtggtgatctaccacggcatgagcgccctgcagaagaagtactacaaggccatcctgatgaaggacctggacgccttcgagaacgagaccgccaagaaggtgaagctgcagaacatcctgagccagctgagaaagtgcgtggaccacccctacctgttcgacggcgtggagcccgagcccttcgaggtgggcgaccacctgaccgaggccagcggcaagctgcacctgctggacaagctgctggccttcctgtacagcggcggccacagagtgctgctgttcagccagatgacccagatgctggacatcctgcaggactacatggactacagaggctacagctacgagagagtggacggcagcgtgagaggcgaggagagacacctggccatcaagaacttcggccagcagcccatcttcgtgttcctgctgagcaccagagccggcggcgtgggcatgaacctgaccgccgccgacaccgtgatcttcgtggacagcgacttcaacccccagaacgacctgcaggccgccgccagagcccacagaatcggccagaacaagagcgtgaaggtgatcagactgatcggcagagacaccgtggaggagatcgtgtacagaaaggccgccagcaagctgcagctgaccaacatgatcatcgagggcggccacttcaccctgggcgcccagaagcccgccgccgacgccgacctgcagctgagcgagatcctgaagttcggcctggacaagctgctggccagcgagggcagcaccatggacgagatcgacctggagagcatcctgggcgagaccaaggacggccagtgggtgagcgacgccctgcccgccgccgagggcggcagcagagaccaggaggagggcaagaaccacatgtacctgttcgagggcaaggactacagcaaggagcccagcaaggaggacagaaagagcttcgagcagctggtgaacctgcagaagaccctgctggagaaggccagccaggagggcagaagcctgagaaacaagggcagcgtgctgatccccggcctggtggagggcagcaccaagagaaagagagtgctgagccccgaggagctggaggacagacagaagaagagacaggaggccgccgccaagagaagaagactgatcgaggagaagaagagacagaaggaggaggccgagcacaagaagaagatggcctggtgggagagcaacaactaccagagcttctgcctgcccagcgaggagagcgagcccgaggacctggagaacggcgaggagagcagcgccgagctggactaccaggaccccgacgccaccagcctgaagtacgtgagcggcgacgtgacccacccccaggccggcgccgaggacgccctgatcgtgcactgcgtggacgacagcggccactggggcagaggcggcctgttcaccgccctggagaagagaagcgccgagcccagaaagatctacgagctggccggcaagatgaaggacctgagcctgggcggcgtgctgctgttccccgtggacgacaaggagagcagaaacaagggccaggacctgctggccctgatcgtggcccagcacagagacagaagcaacgtgctgagcggcatcaagatggccgccctggaggagggcctgaagaagatcttcctggccgccaagaagaagaaggccagcgtgcacctgcccagaatcggccacgccaccaagggcttcaactggtacggcaccgagagactgatcagaaagcacctggccgccagaggcatccccacctacatctactacttccccagaagcaagagcgccgtgctgcacgcccagagcagcagcagcagcagcagacagctggtgccctag

SEQ ID NO: 76722 - DNA, 2412 bp, Artificial Sequence
  Description of Artificial Sequence: Synthetic coding sequence
atggagagagccggcgccaccagcagaggcggccaggcccccggcttcctgctgagactgcacaccgagggcagagccgaggccgccagagtgcaggagcaggacctgagacagtggggcctgaccggcatccacctgagaagctaccagctggagggcgtgaactggctggcccagagattccactgccagaacggctgcatcctgggcgacgagatgggcctgggcaagacctgccagaccatcgccctgttcatctacctggccggcagactgaacgacgagggccccttcctgatcctgtgccccctgagcgtgctgagcaactggaaggaggagatgcagagattcgcccccggcctgagctgcgtgacctacgccggcgacaaggaggagagagcctgcctgcagcaggacctgaagcaggagagcagattccacgtgctgctgaccacctacgagatctgcctgaaggacgccagcttcctgaagagcttcccctggagcgtgctggtggtggacgaggcccacagactgaagaaccagagcagcctgctgcacaagaccctgagcgagttcagcgtggtgttcagcctgctgctgaccggcacccccatccagaacagcctgcaggagctgtacagcctgctgagcttcgtggagcccgacctgttcagcaaggaggaggtgggcgacttcatccagagataccaggacatcgagaaggagagcgagagcgccagcgagctgcacaagctgctgcagcccttcctgctgagaagagtgaaggccgaggtggccaccgagctgcccaagaagaccgaggtggtgatctaccacggcatgagcgccctgcagaagaagtactacaaggccatcctgatgaaggacctggacgccttcgagaacgagaccgccaagaaggtgaagctgcagaacatcctgagccagctgagaaagtgcgtggaccacccctacctgttcgacggcggcgtgggcatgaacctgaccgccgccgacaccgtgatcttcgtggacagcgacttcaacccccagaacgacctgcaggccgccgccagagcccacagaatcggccagaacaagagcgtgaaggtgatcagactgatcggcagagacaccgtggaggagatcgtgtacagaaaggccgccagcaagctgcagctgaccaacatgatcatcgagggcggccacttcaccctgggcgcccagaagcccgccgccgacgccgacctgcagctgagcgagatcctgaagttcggcctggacaagctgctggccagcgagggcagcaccatggacgagatcgacctggagagcatcctgggcgagaccaaggacggccagtgggtgagcgacgccctgcccgccgccgagggcggcagcagagaccaggaggagggcaagaaccacatgtacctgttcgagggcaaggactacagcaaggagcccagcaaggaggacagaaagagcttcgagcagctggtgaacctgcagaagaccctgctggagaaggccagccaggagggcagaagcctgagaaacaagggcagcgtgctgatccccggcctggtggagggcagcaccaagagaaagagagtgctgagccccgaggagctggaggacagacagaagaagagacaggaggccgccgccaagagaagaagactgatcgaggagaagaagagacagaaggaggaggccgagcacaagaagaagatggcctggtgggagagcaacaactaccagagcttctgcctgcccagcgaggagagcgagcccgaggacctggagaacggcgaggagagcagcgccgagctggactaccaggaccccgacgccaccagcctgaagtacgtgagcggcgacgtgacccacccccaggccggcgccgaggacgccctgatcgtgcactgcgtggacgacagcggccactggggcagaggcggcctgttcaccgccctggagaagagaagcgccgagcccagaaagatctacgagctggccggcaagatgaaggacctgagcctgggcggcgtgctgctgttccccgtggacgacaaggagagcagaaacaagggccaggacctgctggccctgatcgtggcccagcacagagacagaagcaacgtgctgagcggcatcaagatggccgccctggaggagggcctgaagaagatcttcctggccgccaagaagaagaaggccagcgtgcacctgcccagaatcggccacgccaccaagggcttcaactggtacggcaccgagagactgatcagaaagcacctggccgccagaggcatccccacctacatctactacttccccagaagcaagagcgccgtgctgcacgcccagagcagcagcagcagcagcagacagctggtgccctag

SEQ ID NO: 76723 - DNA, 1305 bp, Artificial Sequence
  Description of Artificial Sequence: Synthetic coding sequence
atggccgtgagctgggagatgagatgggcctggggcagacccgccagattcgcccccggcctgagctgcgtgacctacgccggcgacaaggaggagagagcctgcctgcagcaggacctgaagcaggagagcagattccacgtgctgctgaccacctacgagatctgcctgaaggacgccagcttcctgaagagcttcccctggagcgtgctggtggtggacgaggcccacagactgaagaaccagagcagcctgctgcacaagaccctgagcgagttcagcgtggtgttcagcctgctgctgaccggcacccccatccagaacagcctgcaggagctgtacagcctgctgagcttcgtggagcccgacctgttcagcaaggaggaggtgggcgacttcatccagagataccaggacatcgagaaggagagcgagagcgccagcgagctgcacaagctgctgcagcccttcctgctgagaagagtgaaggccgaggtggccaccgagctgcccaagaagaccgaggtggtgatctaccacggcatgagcgccctgcagaagaagtactacaaggccatcctgatgaaggacctggacgccttcgagaacgagaccgccaagaaggtgaagctgcagaacatcctgagccagctgagaaagtgcgtggaccacccctacctgttcgacggcgtggagcccgagcccttcgaggtgggcgaccacctgaccgaggccagcggcaagctgcacctgctggacaagctgctggccttcctgtacagcggcggccacagagtgctgctgttcagccagatgacccagatgctggacatcctgcaggactacatggactacagaggctacagctacgagagagtggacggcagcgtgagaggcgaggagagacacctggccatcaagaacttcggccagcagcccatcttcgtgttcctgctgagcaccagagccggcggcgtgggcatgaacctgaccgccgccgacaccgtgatcttcgtggacagcgacttcaacccccagaacgacctgcaggccgccgccagagcccacagaatcggccagaacaagagcgtgaaggtgatcagactgatcggcagagacaccgtggaggagatcgtgtacagaaaggccgccagcaagctgcagctgaccaacatgatcatcgagggcggccacttcaccctgggcgcccagaagcccgccgccgacgccgacctgcaggtgagatacagcaacctggtgtggatcaactgctggcccctgagaggcgccccctggatgaagtag

SEQ ID NO: 76724 - DNA, 5487 bp, Artificial Sequence
  Description of Artificial Sequence: Synthetic coding sequence
atgatgagaaacaaggacaagagccaggaggaggacagcagcctgcacagcaacgccagcagccacagcgccagcgaggaggccagcggcagcgacagcggcagccagagcgagagcgagcagggcagcgaccccggcagcggccacggcagcgagagcaacagcagcagcgagagcagcgagagccagagcgagagcgagagcgagagcgccggcagcaagagccagcccgtgctgcccgaggccaaggagaagcccgccagcaagaaggagagaatcgccgacgtgaagaagatgtgggaggagtaccccgacgtgtacggcgtgagaagaagcaacagaagcagacaggagcccagcagattcaacatcaaggaggaggccagcagcggcagcgagagcggcagccccaagagaagaggccagagacagctgaagaagcaggagaagtggaagcaggagcccagcgaggacgagcaggagcagggcaccagcgccgagagcgagcccgagcagaagaaggtgaaggccagaagacccgtgcccagaagaaccgtgcccaagcccagagtgaagaagcagcccaagacccagagaggcaagagaaagaagcaggacagcagcgacgaggacgacgacgacgacgaggcccccaagagacagaccagaagaagagccgccaagaacgtgagctacaaggaggacgacgacttcgagaccgacagcgacgacctgatcgagatgaccggcgagggcgtggacgagcagcaggacaacagcgagaccatcgagaaggtgctggacagcagactgggcaagaagggcgccaccggcgccagcaccaccgtgtacgccatcgaggccaacggcgaccccagcggcgacttcgacaccgagaaggacgagggcgagatccagtacctgatcaagtggaagggctggagctacatccacagcacctgggagagcgaggagagcctgcagcagcagaaggtgaagggcctgaagaagctggagaacttcaagaagaaggaggacgagatcaagcagtggctgggcaaggtgagccccgaggacgtggagtacttcaactgccagcaggagctggccagcgagctgaacaagcagtaccagatcgtggagagagtgatcgccgtgaagaccagcaagagcaccctgggccagaccgacttccccgcccacagcagaaagcccgcccccagcaacgagcccgagtacctgtgcaagtggatgggcctgccctacagcgagtgcagctgggaggacgaggccctgatcggcaagaagttccagaactgcatcgacagcttccacagcagaaacaacagcaagaccatccccaccagagagtgcaaggccctgaagcagagacccagattcgtggccctgaagaagcagcccgcctacctgggcggcgagaacctggagctgagagactaccagctggagggcctgaactggctggcccacagctggtgcaagaacaacagcgtgatcctggccgacgagatgggcctgggcaagaccatccagaccatcagcttcctgagctacctgttccaccagcaccagctgtacggccccttcctgatcgtggtgcccctgagcaccctgaccagctggcagagagagttcgagatctgggcccccgagatcaacgtggtggtgtacatcggcgacctgatgagcagaaacaccatcagagagtacgagtggatccacagccagaccaagagactgaagttcaacgccctgatcaccacctacgagatcctgctgaaggacaagaccgtgctgggcagcatcaactgggccttcctgggcgtggacgaggcccacagactgaagaacgacgacagcctgctgtacaagaccctgatcgacttcaagagcaaccacagactgctgatcaccggcacccccctgcagaacagcctgaaggagctgtggagcctgctgcacttcatcatgcccgagaagttcgagttctgggaggacttcgaggaggaccacggcaagggcagagagaacggctaccagagcctgcacaaggtgctggagcccttcctgctgagaagagtgaagaaggacgtggagaagagcctgcccgccaaggtggagcagatcctgagagtggagatgagcgccctgcagaagcagtactacaagtggatcctgaccagaaactacaaggccctggccaagggcaccagaggcagcaccagcggcttcctgaacatcgtgatggagctgaagaagtgctgcaaccactgctacctgatcaagccccccgaggagaacgagagagagaacggccaggagatcctgctgagcctgatcagaagcagcggcaagctgatcctgctggacaagctgctgaccagactgagagagagaggcaacagagtgctgatcttcagccagatggtgagaatgctggacatcctggccgagtacctgaccatcaagcactaccccttccagagactggacggcagcatcaagggcgagatcagaaagcaggccctggaccacttcaacgccgacggcagcgaggacttctgcttcctgctgagcaccagagccggcggcctgggcatcaacctggccagcgccgacaccgtggtgatcttcgacagcgactggaacccccagaacgacctgcaggcccaggccagagcccacagaatcggccagaagaagcaggtgaacatctacagactggtgaccaagggcaccgtggaggaggagatcatcgagagagccaagaagaagatggtgctggaccacctggtgatccagagaatggacaccaccggcagaaccatcctggagaacaacagcggcagaagcaacagcaaccccttcaacaaggaggagctgaccgccatcctgaagttcggcgccgaggacctgttcaaggagctggagggcgaggagagcgagccccaggagatggacatcgacgagatcctgagactggccgagaccagagagaacgaggtgagcaccagcgccaccgacgagctgctgagccagttcaaggtggccaacttcgccaccatggaggacgaggaggagctggaggagagaccccacaaggactgggacgagatcatccccgaggagcagagaaagaaggtggaggaggaggagagacagaaggagctggaggagatctacatgctgcccagaatcagaagcagcaccaagaaggcccagaccaacgacagcgacagcgacaccgagagcaagagacaggcccagagaagcagcgccagcgagagcgagaccgaggacagcgacgacgacaagaagcccaagagaagaggcagacccagaagcgtgagaaaggacctggtggagggcttcaccgacgccgagatcagaagattcatcaaggcctacaagaagttcggcctgcccctggagagactggagtgcatcgccagagacgccgagctggtggacaagagcgtggccgacctgaagagactgggcgagctgatccacaacagctgcgtgagcgccatgcaggagtacgaggagcagctgaaggagaacgccagcgagggcaagggccccggcaagagaagaggccccaccatcaagatcagcggcgtgcaggtgaacgtgaagagcatcatccagcacgaggaggagttcgagatgctgcacaagagcatccccgtggaccccgaggagaagaagaagtactgcctgacctgcagagtgaaggccgcccacttcgacgtggagtggggcgtggaggacgacagcagactgctgctgggcatctacgagcacggctacggcaactgggagctgatcaagaccgaccccgagctgaagctgaccgacaagatcctgcccgtggagaccgacaagaagccccagggcaagcagctgcagaccagagccgactacctgctgaagctgctgagaaagggcctggagaagaagggcgccgtgaccggcggcgaggaggccaagctgaagaagagaaagcccagagtgaagaaggagaacaaggtgcccagactgaaggaggagcacggcatcgagctgagcagccccagacacagcgacaaccccagcgaggagggcgaggtgaaggacgacggcctggagaagagccccatgaagaagaagcagaagaagaaggagaacaaggagaacaaggagaagcagatgagcagcagaaaggacaaggagggcgacaaggagagaaagaagagcaaggacaagaaggagaagcccaagagcggcgacgccaagagcagcagcaagagcaagagaagccagggccccgtgcacatcaccgccggcagcgagcccgtgcccatcggcgaggacgaggacgacgacctggaccaggagaccttcagcatctgcaaggagagaatgagacccgtgaagaaggccctgaagcagctggacaagcccgacaagggcctgaacgtgcaggagcagctggagcacaccagaaactgcctgctgaagatcggcgacagaatcgccgagtgcctgaaggcctacagcgaccaggagcacatcaagctgtggagaagaaacctgtggatcttcgtgagcaagttcaccgagttcgacgccagaaagctgcacaagctgtacaagatggcccacaagaagagaagccaggaggaggaggagcagaagaagaaggacgacgtgaccggcggcaagaagcccttcagacccgaggccagcggcagcagcagagacagcctgatcagccagagccacaccagccacaacctgcacccccagaagccccacctgcccgccagccacggcccccagatgcacggccaccccagagacaactacaaccaccccaacaagagacacttcagcaacgccgacagaggcgactggcagagagagagaaagttcaactacggcggcggcaacaacaaccccccctggggcagcgacagacaccaccagtacgagcagcactggtacaaggaccaccactacggcgacagaagacacatggacgcccacagaagcggcagctacagacccaacaacatgagcagaaagagaccctacgaccagtacagcagcgacagagaccacagaggccacagagactactacgacagacaccaccacgacagcaagagaagaagaagcgacgagttcagaccccagaactaccaccagcaggacttcagaagaatgagcgaccacagacccgccatgggctaccacggccagggccccagcgaccactacagaagcttccacaccgacaagctgggcgagtacaagcagcccctgccccccctgcaccccgccgtgagcgaccccagaagcccccccagccagaagagcccccacgacagcaagagccccctggaccacagaagccccctggagagaagcctggagcagaagaacaaccccgactacaactggaacgtgagaaagacctag

SEQ ID NO: 76725 - DNA, 1506 bp, Artificial Sequence
  Description of Artificial Sequence: Synthetic coding sequence
atgatgagaaacaaggacaagagccaggaggaggacagcagcctgcacagcaacgccagcagccacagcgccagcgaggaggccagcggcagcgacagcggcagccagagcgagagcgagcagggcagcgaccccggcagcggccacggcagcgagagcaacagcagcagcgagagcagcgagagccagagcgagagcgagagcgagagcgccggcagcaagagccagcccgtgctgcccgaggccaaggagaagcccgccagcaagaaggagagaatcgccgacgtgaagaagatgtgggaggagtaccccgacgtgtacggcgtgagaagaagcaacagaagcagacaggagcccagcagattcaacatcaaggaggaggccagcagcggcagcgagagcggcagccccaagagaagaggccagagacagctgaagaagcaggagaagtggaagcaggagcccagcgaggacgagcaggagcagggcaccagcgccgagagcgagcccgagcagaagaaggtgaaggccagaagacccgtgcccagaagaaccgtgcccaagcccagagtgaagaagcagcccaagacccagagaggcaagagaaagaagcaggacagcagcgacgaggacgacgacgacgacgaggcccccaagagacagaccagaagaagagccgccaagaacgtgagctacaaggaggacgacgacttcgagaccgacagcgacgacctgatcgagatgaccggcgagggcgtggacgagcagcaggacaacagcgagaccatcgagaaggtgctggacagcagactgggcaagaagggcgccaccggcgccagcaccaccgtgtacgccatcgaggccaacggcgaccccagcggcgacttcgacaccgagaaggacgagggcgagatccagtacctgatcaagtggaagggctggagctacatccacagcacctgggagagcgaggagagcctgcagcagcagaaggtgaagggcctgaagaagctggagaacttcaagaagaaggaggacgagatcaagcagtggctgggcaaggtgagccccgaggacgtggagtacttcaactgccagcaggagctggccagcgagctgaacaagcagtaccagatcgtggagagagtgatcgccgtgaagaccagcaagagcaccctgggccagaccgacttccccgcccacagcagaaagcccgcccccagcaacgagcccgagtacctgtgcaagtggatgggcctgccctacagcgagtgcagctgggaggacgaggccctgatcggcaagaagttccagaactgcatcgacagcttccacagcagaaacaacagcaagaccatccccaccagagagtgcaaggccctgaagcagagacccagattcgtggccctgaagaagcagcccgcctacctgggcggcgagaacctggagctgagagactaccagctggagggcctgaactggctggcccacagctggtgcaagtag

SEQ ID NO: 76726 - DNA, 1545 bp, Artificial Sequence
  Description of Artificial Sequence: Synthetic coding sequence
atggcccacaagcagagagaggactacctgaacctgagcccctgcgtgttcacctggtacagaaccttcagccagctggccttcgacggcgagaagctgagccacagcgccagcgaggaggccagcggcagcgacagcggcagccagagcgagagcgagcagggcagcgaccccggcagcggccacggcagcgagagcaacagcagcagcgagagcagcgagagccagagcgagagcgagagcgagagcgccggcagcaagagccagcccgtgctgcccgaggccaaggagaagcccgccagcaagaaggagagaatcgccgacgtgaagaagatgtgggaggagtaccccgacgtgtacggcgtgagaagaagcaacagaagcagacaggagcccagcagattcaacatcaaggaggaggccagcagcggcagcgagagcggcagccccaagagaagaggccagagacagctgaagaagcaggagaagtggaagcaggagcccagcgaggacgagcaggagcagggcaccagcgccgagagcgagcccgagcagaagaaggtgaaggccagaagacccgtgcccagaagaaccgtgcccaagcccagagtgaagaagcagcccaagacccagagaggcaagagaaagaagcaggacagcagcgacgaggacgacgacgacgacgaggcccccaagagacagaccagaagaagagccgccaagaacgtgagctacaaggaggacgacgacttcgagaccgacagcgacgacctgatcgagatgaccggcgagggcgtggacgagcagcaggacaacagcgagaccatcgagaaggtgctggacagcagactgggcaagaagggcgccaccggcgccagcaccaccgtgtacgccatcgaggccaacggcgaccccagcggcgacttcgacaccgagaaggacgagggcgagatccagtacctgatcaagtggaagggctggagctacatccacagcacctgggagagcgaggagagcctgcagcagcagaaggtgaagggcctgaagaagctggagaacttcaagaagaaggaggacgagatcaagcagtggctgggcaaggtgagccccgaggacgtggagtacttcaactgccagcaggagctggccagcgagctgaacaagcagtaccagatcgtggagagagtgatcgccgtgaagaccagcaagagcaccctgggccagaccgacttccccgcccacagcagaaagcccgcccccagcaacgagcccgagtacctgtgcaagtggatgggcctgccctacagcgagtgcagctgggaggacgaggccctgatcggcaagaagttccagaactgcatcgacagcttccacagcagaaacaacagcaagaccatccccaccagagagtgcaaggccctgaagcagagacccagattcgtggccctgaagaagcagcccgcctacctgggcggcgagaacctggagctgagagactaccagctggagggcctgaactggctggcccacagctggtgcaagtag

SEQ ID NO: 76727 - DNA, 552 bp, Artificial Sequence
  Description of Artificial Sequence: Synthetic coding sequence
atgatgagaaacaaggacaagagccaggaggaggacagcagcctgcacagcaacgccagcagccacagcgccagcgaggaggccagcggcagcgacagcggcagccagagcgagagcgagcagggcagcgaccccggcagcggccacggcagcgagagcaacagcagcagcgagagcagcgagagccagagcgagagcgagagcgagagcgccggcagcaagagccagcccgtgctgcccgaggccaaggagaagcccgccagcaagaaggagagaatcgccgacgtgaagaagatgtgggaggagtaccccgacgtgtacggcgtgagaagaagcaacagaagcagacaggagcccagcagattcaacatcaaggaggaggccagcagcggcagcgagagcggcagccccaagagaagaggccagagacagctgaagaagcaggagaagtggaagcaggagcccagcgaggacgagcaggagcagggcaccagcgccgagagcgagcccgagcagaagaaggtgaaggccagaagacccgtgcccagatag

SEQ ID NO: 76728 - DNA, 5220 bp, Artificial Sequence
  Description of Artificial Sequence: Synthetic coding sequence
atgatgagaaacaaggacaagagccaggaggaggacagcagcctgcacagcaacgccagcagccacagcgccagcgaggaggccagcggcagcgacagcggcagccagagcgagagcgagcagggcagcgaccccggcagcggccacggcagcgagagcaacagcagcagcgagagcagcgagagccagagcgagagcgagagcgagagcgccggcagcaagagccagcccgtgctgcccgaggccaaggagaagcccgccagcaagaaggagagaatcgccgacgtgaagaagatgtgggaggagtaccccgacgtgtacggcgtgagaagaagcaacagaagcagacaggagcccagcagattcaacatcaaggaggaggccagcagcggcagcgagagcggcagccccaagagaagaggccagagacagctgaagaagcaggagaagtggaagcaggagcccagcgaggacgagcaggagcagggcaccagcgccgagagcgagcccgagcagaagaaggtgaaggccagaagacccgtgcccagaagaaccgtgcccaagcccagagtgaagaagcagcccaagacccagagaggcaagagaaagaagcaggacagcagcgacgaggacgacgacgacgacgaggcccccaagagacagaccagaagaagagccgccaagaacgtgagctacaaggaggacgacgacttcgagaccgacagcgacgacctgatcgagatgaccggcgagggcgtggacgagcagcaggacaacagcgagaccatcgagaaggtgctggacagcagactgggcaagaagggcgccaccggcgccagcaccaccgtgtacgccatcgaggccaacggcgaccccagcggcgacttcgacaccgagaaggacgagggcgagatccagtacctgatcaagtggaagggctggagctacatccacagcacctgggagagcgaggagagcctgcagcagcagaaggtgaagggcctgaagaagctggagaacttcaagaagaaggaggacgagatcaagcagtggctgggcaaggtgagccccgaggacgtggagtacttcaactgccagcaggagctggccagcgagctgaacaagcagtaccagatcgtggagagagtgatcgccgtgaagaccagcaagagcaccctgggccagaccgacttccccgcccacagcagaaagcccgcccccagcaacgagcccgagtacctgtgcaagtggatgggcctgccctacagcgagtgcagctgggaggacgaggccctgatcggcaagaagttccagaactgcatcgacagcttccacagcagaaacaacagcaagaccatccccaccagagagtgcaaggccctgaagcagagacccagattcgtggccctgaagaagcagcccgcctacctgggcggcgagaacctggagctgagagactaccagctggagggcctgaactggctggcccacagctggtgcaagaacaacagcgtgatcctggccgacgagatgggcctgggcaagaccatccagaccatcagcttcctgagctacctgttccaccagcaccagctgtacggccccttcctgatcgtggtgcccctgagcaccctgaccagctggcagagagagttcgagatctgggcccccgagatcaacgtggtggtgtacatcggcgacctgatgagcagaaacaccatcagagagtacgagtggatccacagccagaccaagagactgaagttcaacgccctgatcaccacctacgagatcctgctgaaggacaagaccgtgctgggcagcatcaactgggccttcctgggcgtggacgaggcccacagactgaagaacgacgacagcctgctgtacaagaccctgatcgacttcaagagcaaccacagactgctgatcaccggcacccccctgcagaacagcctgaaggagctgtggagcctgctgcacttcatcatgcccgagaagttcgagttctgggaggacttcgaggaggaccacggcaagggcagagagaacggctaccagagcctgcacaaggtgctggagcccttcctgctgagaagagtgaagaaggacgtggagaagagcctgcccgccaaggtggagcagatcctgagagtggagatgagcgccctgcagaagcagtactacaagtggatcctgaccagaaactacaaggccctggccaagggcaccagaggcagcaccagcggcttcctgaacatcgtgatggagctgaagaagtgctgcaaccactgctacctgatcaagccccccgaggagaacgagagagagaacggccaggagatcctgctgagcctgatcagaagcagcggcaagctgatcctgctggacaagctgctgaccagactgagagagagaggcaacagagtgctgatcttcagccagatggtgagaatgctggacatcctggccgagtacctgaccatcaagcactaccccttccagagactggacggcagcatcaagggcgagatcagaaagcaggccctggaccacttcaacgccgacggcagcgaggacttctgcttcctgctgagcaccagagccggcggcctgggcatcaacctggccagcgccgacaccgtggtgatcttcgacagcgactggaacccccagaacgacctgcaggcccaggccagagcccacagaatcggccagaagaagcaggtgaacatctacagactggtgaccaagggcaccgtggaggaggagatcatcgagagagccaagaagaagatggtgctggaccacctggtgatccagagaatggacaccaccggcagaaccatcctggagaacaacagcggcagaagcaacagcaaccccttcaacaaggaggagctgaccgccatcctgaagttcggcgccgaggacctgttcaaggagctggagggcgaggagagcgagccccaggagatggacatcgacgagatcctgagactggccgagaccagagagaacgaggtgagcaccagcgccaccgacgagctgctgagccagttcaaggtggccaacttcgccaccatggaggacgaggaggagctggaggagagaccccacaaggactgggacgagatcatccccgaggagcagagaaagaaggtggaggaggaggagagacagaaggagctggaggagatctacatgctgcccagaatcagaagcagcaccaagaaggcccagaccaacgacagcgacagcgacaccgagagcaagagacaggcccagagaagcagcgccagcgagagcgagaccgaggacagcgacgacgacaagaagcccaagagaagaggcagacccagaagcgtgagaaaggacctggtggagggcttcaccgacgccgagatcagaagattcatcaaggcctacaagaagttcggcctgcccctggagagactggagtgcatcgccagagacgccgagctggtggacaagagcgtggccgacctgaagagactgggcgagctgatccacaacagctgcgtgagcgccatgcaggagtacgaggagcagctgaaggagaacgccagcgagggcaagggccccggcaagagaagaggccccaccatcaagatcagcggcgtgcaggtgaacgtgaagagcatcatccagcacgaggaggagttcgagatgctgcacaagagcatccccgtggaccccgaggagaagaagaagtactgcctgacctgcagagtgaaggccgcccacttcgacgtggagtggggcgtggaggacgacagcagactgctgctgggcatctacgagcacggctacggcaactgggagctgatcaagaccgaccccgagctgaagctgaccgacaagatcctgcccgtggagaccgacaagaagccccagggcaagcagctgcagaccagagccgactacctgctgaagctgctgagaaagggcctggagaagaagggcgccgtgaccggcggcgaggaggccaagctgaagaagagaaagcccagagtgaagaaggagaacaaggtgcccagactgaaggaggagcacggcatcgagctgagcagccccagacacagcgacaaccccagcgaggagggcgaggtgaaggacgacggcctggagaagagccccatgaagaagaagcagaagaagaaggagaacaaggagaacaaggagaagcagatgagcagcagaaaggacaaggagggcgacaaggagagaaagaagagcaaggacaagaaggagaagcccaagagcggcgacgccaagagcagcagcaagagcaagagaagccagggccccgtgcacatcaccgccggcagcgagcccgtgcccatcggcgaggacgaggacgacgacctggaccaggagaccttcagcatctgcaaggagagaatgagacccgtgaagaaggccctgaagcagctggacaagcccgacaagggcctgaacgtgcaggagcagctggagcacaccagaaactgcctgctgaagatcggcgacagaatcgccgagtgcctgaaggcctacagcgaccaggagcacatcaagctgtggagaagaaacctgtggatcttcgtgagcaagttcaccgagttcgacgccagaaagctgcacaagctgtacaagatggcccacaagaagagaagccaggaggaggaggagcagaagaagaaggacgacgtgaccggcggcaagaagcccttcagacccgaggccagcggcagcagcagagacagcctgatcagccagagccacaccagccacaacctgcacccccagaagccccacctgcccgccagccacggcccccagatgcacggccaccccagagacaactacaaccaccccaacaagagacacttcagcaacgccgacagaggcgactggcagagagagagaaagttcaactacggcggcggcaacaacaaccccccctggggcagcgacagacaccaccagtacgagcagcactggtacaaggaccaccactacggcgacagaagacacatggacgcccacagaagcggcagctacagacccaacaacatgagcagaaagagaccctacgaccagtacagcagcgacagagaccacagaggccacagagactactacgacagatacgccaagggctgcgagacccccggcgccaacctgtgccaggagctgttcctgggcagaaagtag

SEQ ID NO: 76729 - DNA, 6003 bp, Artificial Sequence
  Description of Artificial Sequence: Synthetic coding sequence
atgaaggccgccgacaccgtgatcctgtgggccagaagcaagaacgaccagctgagaatcagcttcccccccggcctgtgctggggcgacagaatgcccgacaaggacgacatcagactgctgcccagcgccctgggcgtgaagaagagaaagagaggccccaagaagcagaaggagaacaagcccggcaagcccagaaagagaaagaagagagacagcgaggaggagttcggcagcgagagagacgagtacagagagaagagcgagagcggcggcagcgagtacggcaccggccccggcagaaagagaagaagaaagcacagagagaagaaggagaagaagaccaagagaagaaagaagggcgagggcgacggcggccagaagcaggtggagcagaagagcagcgccaccctgctgctgacctggggcctggaggacgtggagcacgtgttcagcgaggaggactaccacaccctgaccaactacaaggccttcagccagttcatgagacccctgatcgccaagaagaaccccaagatccccatgagcaagatgatgaccatcctgggcgccaagtggagagagttcagcgccaacaaccccttcaagggcagcgccgccgccgtggccgccgccgccgccgccgccgccgccgccgtggccgagcaggtgagcgccgccgtgagcagcgccacccccatcgcccccagcggcccccccgccctgccccccccccccgccgccgacatccagcccccccccatcagaagagccaagaccaaggagggcaagggccccggccacaagagaagaagcaagagccccagagtgcccgacggcagaaagaagctgagaggcaagaagatggcccccctgaagatcaagctgggcctgctgggcggcaagagaaagaagggcggcagctacgtgttccagagcgacgagggccccgagcccgaggccgaggagagcgacctggacagcggcagcgtgcacagcgccagcggcagacccgacggccccgtgagaaccaagaagctgaagagaggcagacccggcagaaagaagaagaaggtgctgggctgccccgccgtggccggcgaggaggaggtggacggctacgagaccgaccaccaggactactgcgaggtgtgccagcagggcggcgagatcatcctgtgcgacacctgccccagagcctaccacctggtgtgcctggaccccgagctggacagagcccccgagggcaagtggagctgcccccactgcgagaaggagggcgtgcagtgggaggccaaggaggaggaggaggagtacgaggaggagggcgaggaggagggcgagaaggaggaggaggacgaccacatggagtactgcagagtgtgcaaggacggcggcgagctgctgtgctgcgacgcctgcatcagcagctaccacatccactgcctgaacccccccctgcccgacatccccaacggcgagtggctgtgccccagatgcacctgccccgtgctgaagggcagagtgcagaagatcctgcactggagatggggcgagccccccgtggccgtgcccgccccccagcaggccgacggcaaccccgacgtgcccccccccagacccctgcagggcagaagcgagagagagttcttcgtgaagtgggtgggcctgagctactggcactgcagctgggccaaggagctgcagctggagatcttccacctggtgatgtacagaaactaccagagaaagaacgacatggacgagcccccccccctggactacggcagcggcgaggacgacggcaagagcgacaagagaaaggtgaaggacccccactacgccgagatggaggagaagtactacagattcggcatcaagcccgagtggatgaccgtgcacagaatcatcaaccacagcgtggacaagaagggcaactaccactacctggtgaagtggagagacctgccctacgaccagagcacctgggaggaggacgagatgaacatccccgagtacgaggagcacaagcagagctactggagacacagagagctgatcatgggcgaggaccccgcccagcccagaaagtacaagaagaagaagaaggagctgcagggcgacggcccccccagcagccccaccaacgaccccaccgtgaagtacgagacccagcccagattcatcaccgccaccggcggcaccctgcacatgtaccagctggagggcctgaactggctgagattcagctgggcccagggcaccgacaccatcctggccgacgagatgggcctgggcaagaccatccagaccatcgtgttcctgtacagcctgtacaaggagggccacaccaagggccccttcctggtgagcgcccccctgagcaccatcatcaactgggagagagagttccagatgtgggcccccaagttctacgtggtgacctacaccggcgacaaggacagcagagccatcatcagagagaacgagttcagcttcgaggacaacgccatcaagggcggcaagaaggccttcaagatgaagagagaggcccaggtgaagttccacgtgctgctgaccagctacgagctgatcaccatcgaccaggccgccctgggcagcatcagatgggcctgcctggtggtggacgaggcccacagactgaagaacaaccagagcaagttcttcagagtgctgaacggctacaagatcgaccacaagctgctgctgaccggcacccccctgcagaacaacctggaggagctgttccacctgctgaacttcctgacccccgagagattcaacaacctggagggcttcctggaggagttcgccgacatcagcaaggaggaccagatcaagaagctgcacgacctgctgggcccccacatgctgagaagactgaaggccgacgtgttcaagaacatgcccgccaagaccgagctgatcgtgagagtggagctgagccccatgcagaagaagtactacaagtacatcctgaccagaaacttcgaggccctgaacagcagaggcggcggcaaccaggtgagcctgctgaacatcatgatggacctgaagaagtgctgcaaccacccctacctgttccccgtggccgccatggagagccccaagctgcccagcggcgcctacgagggcggcgccctgatcaagagcagcggcaagctgatgctgctgcagaagatgctgagaaagctgaaggagcagggccacagagtgctgatcttcagccagatgaccaagatgctggacctgctggaggacttcctggactacgagggctacaagtacgagagaatcgacggcggcatcaccggcgccctgagacaggaggccatcgacagattcaacgcccccggcgcccagcagttctgcttcctgctgagcaccagagccggcggcctgggcatcaacctggccaccgccgacaccgtgatcatcttcgacagcgactggaacccccacaacgacatccaggccttcagcagagcccacagaatcggccaggccaacaaggtgatgatctacagattcgtgaccagagccagcgtggaggagagaatcacccaggtggccaagagaaagatgatgctgacccacctggtggtgagacccggcctgggcagcaaggccggcagcatgagcaagcaggagctggacgacatcctgaagttcggcaccgaggagctgttcaaggacgagaacgagggcgagaacaaggaggaggacagcagcgtgatccactacgacaacgaggccatcgccagactgctggacagaaaccaggacgccaccgaggacaccgacgtgcagaacatgaacgagtacctgagcagcttcaaggtggcccagtacgtggtgagagaggaggacaagatcgaggagatcgagagagagatcatcaagcaggaggagaacgtggaccccgactactgggagaagctgctgagacaccactacgagcagcagcaggaggacctggccagaaacctgggcaagggcaagagagtgagaaagcaggtgaactacaacgacgccgcccaggaggaccaggacaaccagagcgagtacagcgtgggcagcgaggaggaggacgaggacttcgacgagagacccgagggcagaagacagagcaagagacagctgagaaacgagaaggacaagcccctgccccccctgctggccagagtgggcggcaacatcgaggtgctgggcttcaacaccagacagagaaaggccttcctgaacgccgtgatgagatggggcatgcccccccaggacgccttcaccacccagtggctggtgagagacctgagaggcaagaccgagaaggagttcaaggcctacgtgagcctgttcatgagacacctgtgcgagcccggcgccgacggcagcgagaccttcgccgacggcgtgcccagagagggcctgagcagacagcaggtgctgaccagaatcggcgtgatgagcctggtgaagaagaaggtgcaggagttcgagcacatcaacggcagatggagcatgcccgagctgatgcccgaccccagcgccgacagcaagagaagcagcagagccagcagccccaccaagaccagccccaccacccccgaggccagcgccaccaacagcccctgcaccagcaagcccgccacccccgcccccagcgagaagggcgagggcatcagaacccccctggagaaggaggaggccgagaaccaggaggagaagcccgagaagaacagcagaatcggcgagaagatggagaccgaggccgacgcccccagccccgcccccagcctgggcgagagactggagcccagaaagatccccctggaggacgaggtgcccggcgtgcccggcgagatggagcccgagcccggctacagaggcgacagagagaagagcgccaccgagagcacccccggcgagagaggcgaggagaagcccctggacggccaggagcacagagagagacccgagggcgagaccggcgacctgggcaagagagaggacgtgaagggcgacagagagctgagacccggccccagagacgagcccagaagcaacggcagaagagaggagaagaccgagaagcccagattcatgttcaacatcgccgacggcggcttcaccgagctgcacaccctgtggcagaacgaggagagagccgccatcagcagcggcaagctgaacgagatctggcacagaagacacgactactggctgctggccggcatcgtgctgcacggctacgccagatggcaggacatccagaacgacgcccagttcgccatcatcaacgagcccttcaagaccgaggccaacaagggcaacttcctggagatgaagaacaagttcctggccagaagattcaagctgctggagcaggccctggtgatcgaggagcagctgagaagagccgcctacctgaacctgagccaggagcccgcccaccccgccatggccctgcacgccagattcgccgaggccgagtgcctggccgagagccaccagcacctgagcaaggagagcctggccggcaacaagcccgccaacgccgtgctgcacaaggtgctgaaccagctggaggagctgctgagcgacatgaaggccgacgtgaccagactgcccgccaccctgagcagaatcccccccatcgccgccagactgcagatgagcgagagaagcatcctgagcagactggccagcaagggcaccgagccccaccccacccccgcctacccccccggcccctacgccaccccccccggctacggcgccgccttcagcgccgcccccgtgggcgccctggccgccgccggcgccaactacagccagatgcccgccggcagcttcatcaccgccgccaccaacggcccccccgtgctggtgaagaaggagaaggagatggtgggcgccctggtgagcgacggcctggacagaaaggagcccagagccggcgaggtgatctgcatcgacgactag

SEQ ID NO: 76730 - DNA, 5901 bp, Artificial Sequence
  Description of Artificial Sequence: Synthetic coding sequence
atgaaggccgccgacaccgtgatcctgtgggccagaagcaagaacgaccagctgagaatcagcttcccccccggcctgtgctggggcgacagaatgcccgacaaggacgacatcagactgctgcccagcgccctgggcgtgaagaagagaaagagaggccccaagaagcagaaggagaacaagcccggcaagcccagaaagagaaagaagagagacagcgaggaggagttcggcagcgagagagacgagtacagagagaagagcgagagcggcggcagcgagtacggcaccggccccggcagaaagagaagaagaaagcacagagagaagaaggagaagaagaccaagagaagaaagaagggcgagggcgacggcggccagaagcaggtggagcagaagagcagcgccaccctgctgctgacctggggcctggaggacgtggagcacgtgttcagcgaggaggactaccacaccctgaccaactacaaggccttcagccagttcatgagacccctgatcgccaagaagaaccccaagatccccatgagcaagatgatgaccatcctgggcgccaagtggagagagttcagcgccaacaaccccttcaagggcagcgccgccgccgtggccgccgccgccgccgccgccgccgccgccgtggccgagcaggtgagcgccgccgtgagcagcgccacccccatcgcccccagcggcccccccgccctgccccccccccccgccgccgacatccagcccccccccatcagaagagccaagaccaaggagggcaagggccccggccacaagagaagaagcaagagccccagagtgcccgacggcagaaagaagctgagaggcaagaagatggcccccctgaagatcaagctgggcctgctgggcggcaagagaaagaagggcggcagctacgtgttccagagcgacgagggccccgagcccgaggccgaggagagcgacctggacagcggcagcgtgcacagcgccagcggcagacccgacggccccgtgagaaccaagaagctgaagagaggcagacccggcagaaagaagaagaaggtgctgggctgccccgccgtggccggcgaggaggaggtggacggctacgagaccgaccaccaggactactgcgaggtgtgccagcagggcggcgagatcatcctgtgcgacacctgccccagagcctaccacctggtgtgcctggaccccgagctggacagagcccccgagggcaagtggagctgcccccactgcgagaaggagggcgtgcagtgggaggccaaggaggaggaggaggagtacgaggaggagggcgaggaggagggcgagaaggaggaggaggacgaccacatggagtactgcagagtgtgcaaggacggcggcgagctgctgtgctgcgacgcctgcatcagcagctaccacatccactgcctgaacccccccctgcccgacatccccaacggcgagtggctgtgccccagatgcacctgccccgtgctgaagggcagagtgcagaagatcctgcactggagatggggcgagccccccgtggccgtgcccgccccccagcaggccgacggcaaccccgacgtgcccccccccagacccctgcagggcagaagcgagagagagttcttcgtgaagtgggtgggcctgagctactggcactgcagctgggccaaggagctgcagctggagatcttccacctggtgatgtacagaaactaccagagaaagaacgacatggacgagcccccccccctggactacggcagcggcgaggacgacggcaagagcgacaagagaaaggtgaaggacccccactacgccgagatggaggagaagtactacagattcggcatcaagcccgagtggatgaccgtgcacagaatcatcaaccacagcgtggacaagaagggcaactaccactacctggtgaagtggagagacctgccctacgaccagagcacctgggaggaggacgagatgaacatccccgagtacgaggagcacaagcagagctactggagacacagagagctgatcatgggcgaggaccccgcccagcccagaaagtacaagaagaagaagaaggagctgcagggcgacggcccccccagcagccccaccaacgaccccaccgtgaagtacgagacccagcccagattcatcaccgccaccggcggcaccctgcacatgtaccagctggagggcctgaactggctgagattcagctgggcccagggcaccgacaccatcctggccgacgagatgggcctgggcaagaccatccagaccatcgtgttcctgtacagcctgtacaaggagggccacaccaagggccccttcctggtgagcgcccccctgagcaccatcatcaactgggagagagagttccagatgtgggcccccaagttctacgtggtgacctacaccggcgacaaggacagcagagccatcatcagagagaacgagttcagcttcgaggacaacgccatcaagggcggcaagaaggccttcaagatgaagagagaggcccaggtgaagttccacgtgctgctgaccagctacgagctgatcaccatcgaccaggccgccctgggcagcatcagatgggcctgcctggtggtggacgaggcccacagactgaagaacaaccagagcaagttcttcagagtgctgaacggctacaagatcgaccacaagctgctgctgaccggcacccccctgcagaacaacctggaggagctgttccacctgctgaacttcctgacccccgagagattcaacaacctggagggcttcctggaggagttcgccgacatcagcaaggaggaccagatcaagaagctgcacgacctgctgggcccccacatgctgagaagactgaaggccgacgtgttcaagaacatgcccgccaagaccgagctgatcgtgagagtggagctgagccccatgcagaagaagtactacaagtacatcctgaccagaaacttcgaggccctgaacagcagaggcggcggcaaccaggtgagcctgctgaacatcatgatggacctgaagaagtgctgcaaccacccctacctgttccccgtggccgccatggagagccccaagctgcccagcggcgcctacgagggcggcgccctgatcaagagcagcggcaagctgatgctgctgcagaagatgctgagaaagctgaaggagcagggccacagagtgctgatcttcagccagatgaccaagatgctggacctgctggaggacttcctggactacgagggctacaagtacgagagaatcgacggcggcatcaccggcgccctgagacaggaggccatcgacagattcaacgcccccggcgcccagcagttctgcttcctgctgagcaccagagccggcggcctgggcatcaacctggccaccgccgacaccgtgatcatcttcgacagcgactggaacccccacaacgacatccaggccttcagcagagcccacagaatcggccaggccaacaaggtgatgatctacagattcgtgaccagagccagcgtggaggagagaatcacccaggtggccaagagaaagatgatgctgacccacctggtggtgagacccggcctgggcagcaaggccggcagcatgagcaagcaggagctggacgacatcctgaagttcggcaccgaggagctgttcaaggacgagaacgagggcgagaacaaggaggaggacagcagcgtgatccactacgacaacgaggccatcgccagactgctggacagaaaccaggacgccaccgaggacaccgacgtgcagaacatgaacgagtacctgagcagcttcaaggtggcccagtacgtggtgagagaggaggacaagatcgaggagatcgagagagagatcatcaagcaggaggagaacgtggaccccgactactgggagaagctgctgagacaccactacgagcagcagcaggaggacctggccagaaacctgggcaagggcaagagagtgagaaagcaggtgaactacaacgacgccgcccaggaggaccaggacaaccagagcgagtacagcgtgggcagcgaggaggaggacgaggacttcgacgagagacccgagggcagaagacagagcaagagacagctgagaaacgagaaggacaagcccctgccccccctgctggccagagtgggcggcaacatcgaggtgctgggcttcaacaccagacagagaaaggccttcctgaacgccgtgatgagatggggcatgcccccccaggacgccttcaccacccagtggctggtgagagacctgagaggcaagaccgagaaggagttcaaggcctacgtgagcctgttcatgagacacctgtgcgagcccggcgccgacggcagcgagaccttcgccgacggcgtgcccagagagggcctgagcagacagcaggtgctgaccagaatcggcgtgatgagcctggtgaagaagaaggtgcaggagttcgagcacatcaacggcagatggagcatgcccgagctgatgcccgaccccagcgccgacagcaagagaagcagcagagccagcagccccaccaagaccagccccaccacccccgaggccagcgccaccaacagcccctgcaccagcaagcccgccacccccgcccccagcgagaagggcgagggcatcagaacccccctggagaaggaggaggccgagaaccaggaggagaagcccgagaagaacagcagaatcggcgagaagatggagaccgaggccgacgcccccagccccgcccccagcctgggcgagagactggagcccagaaagatccccctggaggacgaggtgcccggcgtgcccggcgagatggagcccgagcccggctacagaggcgacagagagaagagcgaggacgtgaagggcgacagagagctgagacccggccccagagacgagcccagaagcaacggcagaagagaggagaagaccgagaagcccagattcatgttcaacatcgccgacggcggcttcaccgagctgcacaccctgtggcagaacgaggagagagccgccatcagcagcggcaagctgaacgagatctggcacagaagacacgactactggctgctggccggcatcgtgctgcacggctacgccagatggcaggacatccagaacgacgcccagttcgccatcatcaacgagcccttcaagaccgaggccaacaagggcaacttcctggagatgaagaacaagttcctggccagaagattcaagctgctggagcaggccctggtgatcgaggagcagctgagaagagccgcctacctgaacctgagccaggagcccgcccaccccgccatggccctgcacgccagattcgccgaggccgagtgcctggccgagagccaccagcacctgagcaaggagagcctggccggcaacaagcccgccaacgccgtgctgcacaaggtgctgaaccagctggaggagctgctgagcgacatgaaggccgacgtgaccagactgcccgccaccctgagcagaatcccccccatcgccgccagactgcagatgagcgagagaagcatcctgagcagactggccagcaagggcaccgagccccaccccacccccgcctacccccccggcccctacgccaccccccccggctacggcgccgccttcagcgccgcccccgtgggcgccctggccgccgccggcgccaactacagccagatgcccgccggcagcttcatcaccgccgccaccaacggcccccccgtgctggtgaagaaggagaaggagatggtgggcgccctggtgagcgacggcctggacagaaaggagcccagagccggcgaggtgatctgcatcgacgactag

SEQ ID NO: 76731 - DNA, 6180 bp, Artificial Sequence
  Description of Artificial Sequence: Synthetic coding sequence
atggccagccccctgagagacgaggaggaggaggaggaggagatggtggtgagcgaggaggaggaggaggaggaggaggagggcgacgaggaggaggaggaggaggtggaggccgccgacgaggacgacgaggaggacgacgacgagggcgtgctgggcagaggccccggccacgacagaggcagagacagacacagcccccccggctgccacctgttccccccccccccccccccccccccccccctgcccccccccccccccccccccccccccgacaaggacgacatcagactgctgcccagcgccctgggcgtgaagaagagaaagagaggccccaagaagcagaaggagaacaagcccggcaagcccagaaagagaaagaagagagacagcgaggaggagttcggcagcgagagagacgagtacagagagaagagcgagagcggcggcagcgagtacggcaccggccccggcagaaagagaagaagaaagcacagagagaagaaggagaagaagaccaagagaagaaagaagggcgagggcgacggcggccagaagcaggtggagcagaagagcagcgccaccctgctgctgacctggggcctggaggacgtggagcacgtgttcagcgaggaggactaccacaccctgaccaactacaaggccttcagccagttcatgagacccctgatcgccaagaagaaccccaagatccccatgagcaagatgatgaccatcctgggcgccaagtggagagagttcagcgccaacaaccccttcaagggcagcgccgccgccgtggccgccgccgccgccgccgccgccgccgccgtggccgagcaggtgagcgccgccgtgagcagcgccacccccatcgcccccagcggcccccccgccctgccccccccccccgccgccgacatccagcccccccccatcagaagagccaagaccaaggagggcaagggccccggccacaagagaagaagcaagagccccagagtgcccgacggcagaaagaagctgagaggcaagaagatggcccccctgaagatcaagctgggcctgctgggcggcaagagaaagaagggcggcagctacgtgttccagagcgacgagggccccgagcccgaggccgaggagagcgacctggacagcggcagcgtgcacagcgccagcggcagacccgacggccccgtgagaaccaagaagctgaagagaggcagacccggcagaaagaagaagaaggtgctgggctgccccgccgtggccggcgaggaggaggtggacggctacgagaccgaccaccaggactactgcgaggtgtgccagcagggcggcgagatcatcctgtgcgacacctgccccagagcctaccacctggtgtgcctggaccccgagctggacagagcccccgagggcaagtggagctgcccccactgcgagaaggagggcgtgcagtgggaggccaaggaggaggaggaggagtacgaggaggagggcgaggaggagggcgagaaggaggaggaggacgaccacatggagtactgcagagtgtgcaaggacggcggcgagctgctgtgctgcgacgcctgcatcagcagctaccacatccactgcctgaacccccccctgcccgacatccccaacggcgagtggctgtgccccagatgcacctgccccgtgctgaagggcagagtgcagaagatcctgcactggagatggggcgagccccccgtggccgtgcccgccccccagcaggccgacggcaaccccgacgtgcccccccccagacccctgcagggcagaagcgagagagagttcttcgtgaagtgggtgggcctgagctactggcactgcagctgggccaaggagctgcagctggagatcttccacctggtgatgtacagaaactaccagagaaagaacgacatggacgagcccccccccctggactacggcagcggcgaggacgacggcaagagcgacaagagaaaggtgaaggacccccactacgccgagatggaggagaagtactacagattcggcatcaagcccgagtggatgaccgtgcacagaatcatcaaccacagcgtggacaagaagggcaactaccactacctggtgaagtggagagacctgccctacgaccagagcacctgggaggaggacgagatgaacatccccgagtacgaggagcacaagcagagctactggagacacagagagctgatcatgggcgaggaccccgcccagcccagaaagtacaagaagaagaagaaggagctgcagggcgacggcccccccagcagccccaccaacgaccccaccgtgaagtacgagacccagcccagattcatcaccgccaccggcggcaccctgcacatgtaccagctggagggcctgaactggctgagattcagctgggcccagggcaccgacaccatcctggccgacgagatgggcctgggcaagaccatccagaccatcgtgttcctgtacagcctgtacaaggagggccacaccaagggccccttcctggtgagcgcccccctgagcaccatcatcaactgggagagagagttccagatgtgggcccccaagttctacgtggtgacctacaccggcgacaaggacagcagagccatcatcagagagaacgagttcagcttcgaggacaacgccatcaagggcggcaagaaggccttcaagatgaagagagaggcccaggtgaagttccacgtgctgctgaccagctacgagctgatcaccatcgaccaggccgccctgggcagcatcagatgggcctgcctggtggtggacgaggcccacagactgaagaacaaccagagcaagttcttcagagtgctgaacggctacaagatcgaccacaagctgctgctgaccggcacccccctgcagaacaacctggaggagctgttccacctgctgaacttcctgacccccgagagattcaacaacctggagggcttcctggaggagttcgccgacatcagcaaggaggaccagatcaagaagctgcacgacctgctgggcccccacatgctgagaagactgaaggccgacgtgttcaagaacatgcccgccaagaccgagctgatcgtgagagtggagctgagccccatgcagaagaagtactacaagtacatcctgaccagaaacttcgaggccctgaacagcagaggcggcggcaaccaggtgagcctgctgaacatcatgatggacctgaagaagtgctgcaaccacccctacctgttccccgtggccgccatggagagccccaagctgcccagcggcgcctacgagggcggcgccctgatcaagagcagcggcaagctgatgctgctgcagaagatgctgagaaagctgaaggagcagggccacagagtgctgatcttcagccagatgaccaagatgctggacctgctggaggacttcctggactacgagggctacaagtacgagagaatcgacggcggcatcaccggcgccctgagacaggaggccatcgacagattcaacgcccccggcgcccagcagttctgcttcctgctgagcaccagagccggcggcctgggcatcaacctggccaccgccgacaccgtgatcatcttcgacagcgactggaacccccacaacgacatccaggccttcagcagagcccacagaatcggccaggccaacaaggtgatgatctacagattcgtgaccagagccagcgtggaggagagaatcacccaggtggccaagagaaagatgatgctgacccacctggtggtgagacccggcctgggcagcaaggccggcagcatgagcaagcaggagctggacgacatcctgaagttcggcaccgaggagctgttcaaggacgagaacgagggcgagaacaaggaggaggacagcagcgtgatccactacgacaacgaggccatcgccagactgctggacagaaaccaggacgccaccgaggacaccgacgtgcagaacatgaacgagtacctgagcagcttcaaggtggcccagtacgtggtgagagaggaggacaagatcgaggagatcgagagagagatcatcaagcaggaggagaacgtggaccccgactactgggagaagctgctgagacaccactacgagcagcagcaggaggacctggccagaaacctgggcaagggcaagagagtgagaaagcaggtgaactacaacgacgccgcccaggaggaccaggacaaccagagcgagtacagcgtgggcagcgaggaggaggacgaggacttcgacgagagacccgagggcagaagacagagcaagagacagctgagaaacgagaaggacaagcccctgccccccctgctggccagagtgggcggcaacatcgaggtgctgggcttcaacaccagacagagaaaggccttcctgaacgccgtgatgagatggggcatgcccccccaggacgccttcaccacccagtggctggtgagagacctgagaggcaagaccgagaaggagttcaaggcctacgtgagcctgttcatgagacacctgtgcgagcccggcgccgacggcagcgagaccttcgccgacggcgtgcccagagagggcctgagcagacagcaggtgctgaccagaatcggcgtgatgagcctggtgaagaagaaggtgcaggagttcgagcacatcaacggcagatggagcatgcccgagctgatgcccgaccccagcgccgacagcaagagaagcagcagagccagcagccccaccaagaccagccccaccacccccgaggccagcgccaccaacagcccctgcaccagcaagcccgccacccccgcccccagcgagaagggcgagggcatcagaacccccctggagaaggaggaggccgagaaccaggaggagaagcccgagaagaacagcagaatcggcgagaagatggagaccgaggccgacgcccccagccccgcccccagcctgggcgagagactggagcccagaaagatccccctggaggacgaggtgcccggcgtgcccggcgagatggagcccgagcccggctacagaggcgacagagagaagagcgccaccgagagcacccccggcgagagaggcgaggagaagcccctggacggccaggagcacagagagagacccgagggcgagaccggcgacctgggcaagagagaggacgtgaagggcgacagagagctgagacccggccccagagacgagcccagaagcaacggcagaagagaggagaagaccgagaagcccagattcatgttcaacatcgccgacggcggcttcaccgagctgcacaccctgtggcagaacgaggagagagccgccatcagcagcggcaagctgaacgagatctggcacagaagacacgactactggctgctggccggcatcgtgctgcacggctacgccagatggcaggacatccagaacgacgcccagttcgccatcatcaacgagcccttcaagaccgaggccaacaagggcaacttcctggagatgaagaacaagttcctggccagaagattcaagctgctggagcaggccctggtgatcgaggagcagctgagaagagccgcctacctgaacctgagccaggagcccgcccaccccgccatggccctgcacgccagattcgccgaggccgagtgcctggccgagagccaccagcacctgagcaaggagagcctggccggcaacaagcccgccaacgccgtgctgcacaaggtgctgaaccagctggaggagctgctgagcgacatgaaggccgacgtgaccagactgcccgccaccctgagcagaatcccccccatcgccgccagactgcagatgagcgagagaagcatcctgagcagactggccagcaagggcaccgagccccaccccacccccgcctacccccccggcccctacgccaccccccccggctacggcgccgccttcagcgccgcccccgtgggcgccctggccgccgccggcgccaactacagccagatgcccgccggcagcttcatcaccgccgccaccaacggcccccccgtgctggtgaagaaggagaaggagatggtgggcgccctggtgagcgacggcctggacagaaaggagcccagagccggcgaggtgatctgcatcgacgactag

SEQ ID NO: 76732 - DNA, 5865 bp, Artificial Sequence
  Description of Artificial Sequence: Synthetic coding sequence
atgagaggccccgtgggcaccgaggaggagctgcccagactgttcgccgaggagatggagaacgaggacgagatgagcgaggaggaggacggcggcctggaggccttcgacgacttcttccccgtggagcccgtgagcctgcccaagaagaagaagcccaagaagctgaaggagaacaagtgcaagggcaagagaaagaagaaggagggcagcaacgacgagctgagcgagaacgaggaggacctggaggagaagagcgagagcgagggcagcgactacagccccaacaagaagaagaagaagaagctgaaggacaagaaggagaagaaggccaagagaaagaagaaggacgaggacgaggacgacaacgacgacggctgcctgaaggagcccaagagcagcggccagctgatggccgagtggggcctggacgacgtggactacctgttcagcgaggaggactaccacaccctgaccaactacaaggccttcagccagttcctgagacccctgatcgccaagaagaaccccaagatccccatgagcaagatgatgaccgtgctgggcgccaagtggagagagttcagcgccaacaaccccttcaagggcagcagcgccgccgccgccgccgccgccgtggccgccgccgtggagaccgtgaccatcagcccccccctggccgtgagccccccccaggtgccccagcccgtgcccatcagaaaggccaagaccaaggagggcaagggccccggcgtgagaaagaagatcaagggcagcaaggacggcaagaagaagggcaagggcaagaagaccgccggcctgaagttcagattcggcggcatcagcaacaagagaaagaagggcagcagcagcgaggaggacgagagagaggagagcgacttcgacagcgccagcatccacagcgccagcgtgagaagcgagtgcagcgccgccctgggcaagaagagcaagagaagaagaaagaagaagagaatcgacgacggcgacggctacgagaccgaccaccaggactactgcgaggtgtgccagcagggcggcgagatcatcctgtgcgacacctgccccagagcctaccacctggtgtgcctggaccccgagctggagaaggcccccgagggcaagtggagctgcccccactgcgagaaggagggcatccagtgggagcccaaggacgacgacgacgaggaggaggagggcggctgcgaggaggaggaggacgaccacatggagttctgcagagtgtgcaaggacggcggcgagctgctgtgctgcgacgcctgccccagcagctaccacctgcactgcctgaacccccccctgcccgagatccccaacggcgagtggctgtgccccagatgcacctgcccccccctgaagggcaaggtgcagagaatcctgcactggagatggaccgagccccccgcccccttcatggtgggcctgcccggccccgacgtggagcccagcctgcccccccccaagcccctggagggcatccccgagagagagttcttcgtgaagtgggccggcctgagctactggcactgcagctgggtgaaggagctgcagctggagctgtaccacaccgtgatgtacagaaactaccagagaaagaacgacatggacgagcccccccccttcgactacggcagcggcgacgaggacggcaagagcgagaagagaaagaacaaggaccccctgtacgccaagatggaggagagattctacagatacggcatcaagcccgagtggatgatgatccacagaatcctgaaccacagcttcgacaagaagggcgacgtgcactacctgatcaagtggaaggacctgccctacgaccagtgcacctgggagatcgacgacatcgacatcccctactacgacaacctgaagcaggcctactggggccacagagagctgatgctgggcgaggacaccagactgcccaagagactgctgaagaagggcaagaagctgagagacgacaagcaggagaagccccccgacacccccatcgtggaccccaccgtgaagttcgacaagcagccctggtacatcgacagcaccggcggcaccctgcacccctaccagctggagggcctgaactggctgagattcagctgggcccagggcaccgacaccatcctggccgacgagatgggcctgggcaagaccgtgcagaccatcgtgttcctgtacagcctgtacaaggagggccacagcaagggcccctacctggtgagcgcccccctgagcaccatcatcaactgggagagagagttcgagatgtgggcccccgacttctacgtggtgacctacaccggcgacaaggagagcagaagcgtgatcagagagaacgagttcagcttcgaggacaacgccatcagaagcggcaagaaggtgttcagaatgaagaaggaggtgcagatcaagttccacgtgctgctgaccagctacgagctgatcaccatcgaccaggccatcctgggcagcatcgagtgggcctgcctggtggtggacgaggcccacagactgaagaacaaccagagcaagttcttcagagtgctgaacagctacaagatcgactacaagctgctgctgaccggcacccccctgcagaacaacctggaggagctgttccacctgctgaacttcctgacccccgagagattcaacaacctggagggcttcctggaggagttcgccgacatcagcaaggaggaccagatcaagaagctgcacgacctgctgggcccccacatgctgagaagactgaaggccgacgtgttcaagaacatgcccgccaagaccgagctgatcgtgagagtggagctgagccagatgcagaagaagtactacaagttcatcctgaccagaaacttcgaggccctgaacagcaagggcggcggcaaccaggtgagcctgctgaacatcatgatggacctgaagaagtgctgcaaccacccctacctgttccccgtggccgccgtggaggcccccgtgctgcccaacggcagctacgacggcagcagcctggtgaagagcagcggcaagctgatgctgctgcagaagatgctgaagaagctgagagacgagggccacagagtgctgatcttcagccagatgaccaagatgctggacctgctggaggacttcctggagtacgagggctacaagtacgagagaatcgacggcggcatcaccggcggcctgagacaggaggccatcgacagattcaacgcccccggcgcccagcagttctgcttcctgctgagcaccagagccggcggcctgggcatcaacctggccaccgccgacaccgtgatcatctacgacagcgactggaacccccacaacgacatccaggccttcagcagagcccacagaatcggccagaacaagaaggtgatgatctacagattcgtgaccagagccagcgtggaggagagaatcacccaggtggccaagagaaagatgatgctgacccacctggtggtgagacccggcctgggcagcaagagcggcagcatgaccaagcaggagctggacgacatcctgaagttcggcaccgaggagctgttcaaggacgacgtggagggcatgatgagccagggccagagacccgtgacccccatccccgacgtgcagagcagcaagggcggcaacctggccgccagcgccaagaagaagcacggcagcaccccccccggcgacaacaaggacgtggaggacagcagcgtgatccactacgacgacgccgccatcagcaagctgctggacagaaaccaggacgccaccgacgacaccgagctgcagaacatgaacgagtacctgagcagcttcaaggtggcccagtacgtggtgagagaggaggacggcgtggaggaggtggagagagagatcatcaagcaggaggagaacgtggaccccgactactgggagaagctgctgagacaccactacgagcagcagcaggaggacctggccagaaacctgggcaagggcaagagaatcagaaagcaggtgaactacaacgacgccagccaggaggaccaggagtggcaggacgagctgagcgacaaccagagcgagtacagcatcggcagcgaggacgaggacgaggacttcgaggagagacccgagggccagagcggcagaagacagagcagaagacagctgaagagcgacagagacaagcccctgccccccctgctggccagagtgggcggcaacatcgaggtgctgggcttcaacgccagacagagaaaggccttcctgaacgccatcatgagatggggcatgcccccccaggacgccttcaacagccactggctggtgagagacctgagaggcaagagcgagaaggagttcagagcctacgtgagcctgttcatgagacacctgtgcgagcccggcgccgacggcgccgagaccttcgccgacggcgtgcccagagagggcctgagcagacagcacgtgctgaccagaatcggcgtgatgagcctggtgagaaagaaggtgcaggagttcgagcacgtgaacggcaagtacagcacccccgacctgatccccgagggccccgagggcaagaagagcggcgaggtgatcagcagcgaccccaacacccccgtgcccgccagccccgcccacctgctgcccgcccccctgggcctgcccgacaagatggaggcccagctgggctacatggacgagaaggaccccggcgcccagaagcccagacagcccctggaggtgcaggccctgcccgccgccctggacagagtggagagcgaggacaagcacgagagccccgccagcaaggagagagccagagaggagagacccgaggagaccgagaaggccccccccagccccgagcagctgcccagagaggaggtgctgcccgagaaggagaagatcctggacaagctggagctgagcctgatccacagcagaggcgacagcagcgagctgagacccgacgacaccaaggccgaggagaaggagcccatcgagacccagcagaacggcgacaaggaggaggacgacgagggcaagaaggaggacaagaagggcaagttcaagttcatgttcaacatcgccgacggcggcttcaccgagctgcacaccctgtggcagaacgaggagagagccgccgtgagcagcggcaagatctacgacatctggcacagaagacacgactactggctgctggccggcatcgtgacccacggctacgccagatggcaggacatccagaacgaccccagatacatgatcctgaacgagcccttcaagagcgaggtgcacaagggcaactacctggagatgaagaacaagttcctggccagaagattcaagctgctggagcaggccctggtgatcgaggagcagctgagaagagccgcctacctgaacatgacccaggaccccaaccaccccgccatggccctgaacgccagactggccgaggtggagtgcctggccgagagccaccagcacctgagcaaggagagcctggccggcaacaagcccgccaacgccgtgctgcacaaggtgctgaaccagctggaggagctgctgagcgacatgaaggccgacgtgaccagactgcccagcatgctgagcagaatcccccccgtggccgccagactgcagatgagcgagagaagcatcctgagcagactgaccaacagagccggcgaccccaccatccagcagggcgccttcggcagcagccagatgtacagcaacaacttcggccccaacttcagaggccccggccccggcggcatcgtgaactacaaccagatgcccctgggcccctacgtgaccgacatctag

SEQ ID NO: 76733 - DNA, 2427 bp, Artificial Sequence
  Description of Artificial Sequence: Synthetic coding sequence
atgatctacagattcgtgaccagagccagcgtggaggagagaatcacccaggtggccaagagaaagatgatgctgacccacctggtggtgagacccggcctgggcagcaagagcggcagcatgaccaagcaggagctggacgacatcctgaagttcggcaccgaggagctgttcaaggacgacgtggagggcatgatgagccagggccagagacccgtgacccccatccccgacgtgcagagcagcaagggcggcaacctggccgccagcgccaagaagaagcacggcagcaccccccccggcgacaacaaggacgtggaggacagcagcgtgatccactacgacgacgccgccatcagcaagctgctggacagaaaccaggacgccaccgacgacaccgagctgcagaacatgaacgagtacctgagcagcttcaaggtggcccagtacgtggtgagagaggaggacggcgtggaggaggtggagagagagatcatcaagcaggaggagaacgtggaccccgactactgggagaagctgctgagacaccactacgagcagcagcaggaggacctggccagaaacctgggcaagggcaagagaatcagaaagcaggtgaactacaacgacgccagccaggaggaccaggagtggcaggacgagctgagcgacaaccagagcgagtacagcatcggcagcgaggacgaggacgaggacttcgaggagagacccgagggccagagcggcagaagacagagcagaagacagctgaagagcgacagagacaagcccctgccccccctgctggccagagtgggcggcaacatcgaggtgctgggcttcaacgccagacagagaaaggccttcctgaacgccatcatgagatggggcatgcccccccaggacgccttcaacagccactggctggtgagagacctgagaggcaagagcgagaaggagttcagagcctacgtgagcctgttcatgagacacctgtgcgagcccggcgccgacggcgccgagaccttcgccgacggcgtgcccagagagggcctgagcagacagcacgtgctgaccagaatcggcgtgatgagcctggtgagaaagaaggtgcaggagttcgagcacgtgaacggcaagtacagcacccccgacctgatccccgagggccccgagggcaagaagagcggcgaggtgatcagcagcgaccccaacacccccgtgcccgccagccccgcccacctgctgcccgcccccctgggcctgcccgacaagatggaggcccagctgggctacatggacgagaaggaccccggcgcccagaagcccagacagcccctggaggtgcaggccctgcccgccgccctggacagagtggagagcgaggacaagcacgagagccccgccagcaaggagagagccagagaggagagacccgaggagaccgagaaggccccccccagccccgagcagctgcccagagaggaggtgctgcccgagaaggagaagatcctggacaagctggagctgagcctgatccacagcagaggcgacagcagcgagctgagacccgacgacaccaaggccgaggagaaggagcccatcgagacccagcagaacggcgacaaggaggaggacgacgagggcaagaaggaggacaagaagggcaagttcaagttcatgttcaacatcgccgacggcggcttcaccgagctgcacaccctgtggcagaacgaggagagagccgccgtgagcagcggcaagatctacgacatctggcacagaagacacgactactggctgctggccggcatcgtgacccacggctacgccagatggcaggacatccagaacgaccccagatacatgatcctgaacgagcccttcaagagcgaggtgcacaagggcaactacctggagatgaagaacaagttcctggccagaagattcaagctgctggagcaggccctggtgatcgaggagcagctgagaagagccgcctacctgaacatgacccaggaccccaaccaccccgccatggccctgaacgccagactggccgaggtggagtgcctggccgagagccaccagcacctgagcaaggagagcctggccggcaacaagcccgccaacgccgtgctgcacaaggtgctgaaccagctggaggagctgctgagcgacatgaaggccgacgtgaccagactgcccagcatgctgagcagaatcccccccgtggccgccagactgcagatgagcgagagaagcatcctgagcagactgaccaacagagccggcgaccccaccatccagcagatcagcagcagacccagagacttccccgtgctgcagagaagcttccccgccgagcccagactgcccggccacctgcccgacccccacggcagagagaagctgccccccttctag

SEQ ID NO: 76734 - DNA, 3588 bp, Artificial Sequence
  Description of Artificial Sequence: Synthetic coding sequence
atggtgggcctgcccggccccgacgtggagcccagcctgcccccccccaagcccctggagggcatccccgagagagagttcttcgtgaagtgggccggcctgagctactggcactgcagctgggtgaaggagctgcagctggagctgtaccacaccgtgatgtacagaaactaccagagaaagaacgacatggacgagcccccccccttcgactacggcagcggcgacgaggacggcaagagcgagaagagaaagaacaaggaccccctgtacgccaagatggaggagagattctacagatacggcatcaagcccgagtggatgatgatccacagaatcctgaaccacagcttcgacaagaagggcgacgtgcactacctgatcaagtggaaggacctgccctacgaccagtgcacctgggagatcgacgacatcgacatcccctactacgacaacctgaagcaggcctactggggccacagagagctgatgctgggcgaggacaccagactgcccaagagactgctgaagaagggcaagaagctgagagacgacaagcaggagaagccccccgacacccccatcgtggaccccaccgtgaagttcgacaagcagccctggtacatcgacagcaccggcggcaccctgcacccctaccagctggagggcctgaactggctgagattcagctgggcccagggcaccgacaccatcctggccgacgagatgggcctgggcaagaccgtgcagaccatcgtgttcctgtacagcctgtacaaggagggccacagcaagggcccctacctggtgagcgcccccctgagcaccatcatcaactgggagagagagttcgagatgtgggcccccgacttctacgtggtgacctacaccggcgacaaggagagcagaagcgtgatcagagagaacgagttcagcttcgaggacaacgccatcagaagcggcaagaaggtgttcagaatgaagaaggaggtgcagatcaagttccacgtgctgctgaccagctacgagctgatcaccatcgaccaggccatcctgggcagcatcgagtgggcctgcctggtggtggacgaggcccacagactgaagaacaaccagagcaagttcttcagagtgctgaacagctacaagatcgactacaagctgctgctgaccggcacccccctgcagaacaacctggaggagctgttccacctgctgaacttcctgacccccgagagattcaacaacctggagggcttcctggaggagttcgccgacatcagcaaggaggaccagatcaagaagctgcacgacctgctgggcccccacatgctgagaagactgaaggccgacgtgttcaagaacatgcccgccaagaccgagctgatcgtgagagtggagctgagccagatgcagaagaagtactacaagttcatcctgaccagaaacttcgaggccctgaacagcaagggcggcggcaaccaggtgagcctgctgaacatcatgatggacctgaagaagtgctgcaaccacccctacctgttccccgtggccgccgtggaggcccccgtgctgcccaacggcagctacgacggcagcagcctggtgaagagcagcggcaagctgatgctgctgcagaagatgctgaagaagctgagagacgagggccacagagtgctgatcttcagccagatgaccaagatgctggacctgctggaggacttcctggagtacgagggctacaagtacgagagaatcgacggcggcatcaccggcggcctgagacaggaggccatcgacagattcaacgcccccggcgcccagcagttctgcttcctgctgagcaccagagccggcggcctgggcatcaacctggccaccgccgacaccgtgatcatctacgacagcgactggaacccccacaacgacatccaggccttcagcagagcccacagaatcggccagaacaagaaggtgatgatctacagattcgtgaccagagccagcgtggaggagagaatcacccaggtggccaagagaaagatgatgctgacccacctggtggtgagacccggcctgggcagcaagagcggcagcatgaccaagcaggagctggacgacatcctgaagttcggcaccgaggagctgttcaaggacgacgtggagggcatgatgagccagggccagagacccgtgacccccatccccgacgtgcagagcagcaagggcggcaacctggccgccagcgccaagaagaagcacggcagcaccccccccggcgacaacaaggacgtggaggacagcagcgtgatccactacgacgacgccgccatcagcaagctgctggacagaaaccaggacgccaccgacgacaccgagctgcagaacatgaacgagtacctgagcagcttcaaggtggcccagtacgtggtgagagaggaggacggcgtggaggaggtggagagagagatcatcaagcaggaggagaacgtggaccccgactactgggagaagctgctgagacaccactacgagcagcagcaggaggacctggccagaaacctgggcaagggcaagagaatcagaaagcaggtgaactacaacgacgccagccaggaggaccaggagtggcaggacgagctgagcgacaaccagagcgagtacagcatcggcagcgaggacgaggacgaggacttcgaggagagacccgagggccagagcggcagaagacagagcagaagacagctgaagagcgacagagacaagcccctgccccccctgctggccagagtgggcggcaacatcgaggtgctgggcttcaacgccagacagagaaaggccttcctgaacgccatcatgagatggggcatgcccccccaggacgccttcaacagccactggctggtgagagacctgagaggcaagagcgagaaggagttcagagcctacgtgagcctgttcatgagacacctgtgcgagcccggcgccgacggcgccgagaccttcgccgacggcgtgcccagagagggcctgagcagacagcacgtgctgaccagaatcggcgtgatgagcctggtgagaaagaaggtgcaggagttcgagcacgtgaacggcaagtacagcacccccgacctgatccccgagggccccgagggcaagaagagcggcgaggtgatcagcagcgaccccaacacccccgtgcccgccagccccgcccacctgctgcccgcccccctgggcctgcccgacaagatggaggcccagctgggctacatggacgagaaggaccccggcgcccagaagcccagacagcccctggaggtgcaggccctgcccgccgccctggacagagtggagagcgaggacaagcacgagagccccgccagcaaggagagagccagagaggagagacccgagcagaccccccccgcccaggcccagctgagaggcggcagacccctgagccccggcaccgcccccggctggcagagagagggccccggcctgggcgccagaagagccagaagccccagccagggcggccccggcggcggcggcagcagcttcggcagccaggcccccctgtag

SEQ ID NO: 76735 - DNA, 2427 bp, Artificial Sequence; identical to SEQ ID NO: 76733
  Description of Artificial Sequence: Synthetic coding sequence

SEQ ID NO: 76736 - DNA, 3288 bp, Artificial Sequence
  Description of Artificial Sequence: Synthetic coding sequence
atgatccacagaatcctgaaccacagcttcgacaagaagggcgacgtgcactacctgatcaagtggaaggacctgccctacgaccagtgcacctgggagatcgacgacatcgacatcccctactacgacaacctgaagcaggcctactggggccacagagagctgatgctgggcgaggacaccagactgcccaagagactgctgaagaagggcaagaagctgagagacgacaagcaggagaagccccccgacacccccatcgtggaccccaccgtgaagttcgacaagcagccctggtacatcgacagcaccggcggcaccctgcacccctaccagctggagggcctgaactggctgagattcagctgggcccagggcaccgacaccatcctggccgacgagatgggcctgggcaagaccgtgcagaccatcgtgttcctgtacagcctgtacaaggagggccacagcaagggcccctacctggtgagcgcccccctgagcaccatcatcaactgggagagagagttcgagatgtgggcccccgacttctacgtggtgacctacaccggcgacaaggagagcagaagcgtgatcagagagaacgagttcagcttcgaggacaacgccatcagaagcggcaagaaggtgttcagaatgaagaaggaggtgcagatcaagttccacgtgctgctgaccagctacgagctgatcaccatcgaccaggccatcctgggcagcatcgagtgggcctgcctggtggtggacgaggcccacagactgaagaacaaccagagcaagttcttcagagtgctgaacagctacaagatcgactacaagctgctgctgaccggcacccccctgcagaacaacctggaggagctgttccacctgctgaacttcctgacccccgagagattcaacaacctggagggcttcctggaggagttcgccgacatcagcaaggaggaccagatcaagaagctgcacgacctgctgggcccccacatgctgagaagactgaaggccgacgtgttcaagaacatgcccgccaagaccgagctgatcgtgagagtggagctgagccagatgcagaagaagtactacaagttcatcctgaccagaaacttcgaggccctgaacagcaagggcggcggcaaccaggtgagcctgctgaacatcatgatggacctgaagaagtgctgcaaccacccctacctgttccccgtggccgccgtggaggcccccgtgctgcccaacggcagctacgacggcagcagcctggtgaagagcagcggcaagctgatgctgctgcagaagatgctgaagaagctgagagacgagggccacagagtgctgatcttcagccagatgaccaagatgctggacctgctggaggacttcctggagtacgagggctacaagtacgagagaatcgacggcggcatcaccggcggcctgagacaggaggccatcgacagattcaacgcccccggcgcccagcagttctgcttcctgctgagcaccagagccggcggcctgggcatcaacctggccaccgccgacaccgtgatcatctacgacagcgactggaacccccacaacgacatccaggccttcagcagagcccacagaatcggccagaacaagaaggtgatgatctacagattcgtgaccagagccagcgtggaggagagaatcacccaggtggccaagagaaagatgatgctgacccacctggtggtgagacccggcctgggcagcaagagcggcagcatgaccaagcaggagctggacgacatcctgaagttcggcaccgaggagctgttcaaggacgacgtggagggcatgatgagccagggccagagacccgtgacccccatccccgacgtgcagagcagcaagggcggcaacctggccgccagcgccaagaagaagcacggcagcaccccccccggcgacaacaaggacgtggaggacagcagcgtgatccactacgacgacgccgccatcagcaagctgctggacagaaaccaggacgccaccgacgacaccgagctgcagaacatgaacgagtacctgagcagcttcaaggtggcccagtacgtggtgagagaggaggacggcgtggaggaggtggagagagagatcatcaagcaggaggagaacgtggaccccgactactgggagaagctgctgagacaccactacgagcagcagcaggaggacctggccagaaacctgggcaagggcaagagaatcagaaagcaggtgaactacaacgacgccagccaggaggaccaggagtggcaggacgagctgagcgacaaccagagcgagtacagcatcggcagcgaggacgaggacgaggacttcgaggagagacccgagggccagagcggcagaagacagagcagaagacagctgaagagcgacagagacaagcccctgccccccctgctggccagagtgggcggcaacatcgaggtgctgggcttcaacgccagacagagaaaggccttcctgaacgccatcatgagatggggcatgcccccccaggacgccttcaacagccactggctggtgagagacctgagaggcaagagcgagaaggagttcagagcctacgtgagcctgttcatgagacacctgtgcgagcccggcgccgacggcgccgagaccttcgccgacggcgtgcccagagagggcctgagcagacagcacgtgctgaccagaatcggcgtgatgagcctggtgagaaagaaggtgcaggagttcgagcacgtgaacggcaagtacagcacccccgacctgatccccgagggccccgagggcaagaagagcggcgaggtgatcagcagcgaccccaacacccccgtgcccgccagccccgcccacctgctgcccgcccccctgggcctgcccgacaagatggaggcccagctgggctacatggacgagaaggaccccggcgcccagaagcccagacagcccctggaggtgcaggccctgcccgccgccctggacagagtggagagcgaggacaagcacgagagccccgccagcaaggagagagccagagaggagagacccgaggagaccgagaaggccccccccagccccgagcagctgcccagagccagctgcagcgtgacccaggccggcgtgcagtggagacacagactgatgggcgccttcatcagcagcgcccaggccaccctgcccccccagctgcccgagcagagaagatgcttcctgagaagaagaagaagctggaccagctggagctag

SEQ ID NO: 76737 - DNA, 3258 bp, Artificial Sequence
  Description of Artificial Sequence: Synthetic coding sequence
atgatccacagaatcctgaaccacagcttcgacaagaagggcgacgtgcactacctgatcaagtggaaggacctgccctacgaccagtgcacctgggagatcgacgacatcgacatcccctactacgacaacctgaagcaggcctactggggccacagagagctgatgctgggcgaggacaccagactgcccaagagactgctgaagaagggcaagaagctgagagacgacaagcaggagaagccccccgacacccccatcgtggaccccaccgtgaagttcgacaagcagccctggtacatcgacagcaccggcggcaccctgcacccctaccagctggagggcctgaactggctgagattcagctgggcccagggcaccgacaccatcctggccgacgagatgggcctgggcaagaccgtgcagaccatcgtgttcctgtacagcctgtacaaggagggccacagcaagggcccctacctggtgagcgcccccctgagcaccatcatcaactgggagagagagttcgagatgtgggcccccgacttctacgtggtgacctacaccggcgacaaggagagcagaagcgtgatcagagagaacgagttcagcttcgaggacaacgccatcagaagcggcaagaaggtgttcagaatgaagaaggaggtgcagatcaagttccacgtgctgctgaccagctacgagctgatcaccatcgaccaggccatcctgggcagcatcgagtgggcctgcctggtggtggacgaggcccacagactgaagaacaaccagagcaagttcttcagagtgctgaacagctacaagatcgactacaagctgctgctgaccggcacccccctgcagaacaacctggaggagctgttccacctgctgaacttcctgacccccgagagattcaacaacctggagggcttcctggaggagttcgccgacatcagcaaggaggaccagatcaagaagctgcacgacctgctgggcccccacatgctgagaagactgaaggccgacgtgttcaagaacatgcccgccaagaccgagctgatcgtgagagtggagctgagccagatgcagaagaagtactacaagttcatcctgaccagaaacttcgaggccctgaacagcaagggcggcggcaaccaggtgagcctgctgaacatcatgatggacctgaagaagtgctgcaaccacccctacctgttccccgtggccgccgtggaggcccccgtgctgcccaacggcagctacgacggcagcagcctggtgaagagcagcggcaagctgatgctgctgcagaagatgctgaagaagctgagagacgagggccacagagtgctgatcttcagccagatgaccaagatgctggacctgctggaggacttcctggagtacgagggctacaagtacgagagaatcgacggcggcatcaccggcggcctgagacaggaggccatcgacagattcaacgcccccggcgcccagcagttctgcttcctgctgagcaccagagccggcggcctgggcatcaacctggccaccgccgacaccgtgatcatctacgacagcgactggaacccccacaacgacatccaggccttcagcagagcccacagaatcggccagaacaagaaggtgatgatctacagattcgtgaccagagccagcgtggaggagagaatcacccaggtggccaagagaaagatgatgctgacccacctggtggtgagacccggcctgggcagcaagagcggcagcatgaccaagcaggagctggacgacatcctgaagttcggcaccgaggagctgttcaaggacgacgtggagggcatgatgagccagggccagagacccgtgacccccatccccgacgtgcagagcagcaagggcggcaacctggccgccagcgccaagaagaagcacggcagcaccccccccggcgacaacaaggacgtggaggacagcagcgtgatccactacgacgacgccgccatcagcaagctgctggacagaaaccaggacgccaccgacgacaccgagctgcagaacatgaacgagtacctgagcagcttcaaggtggcccagtacgtggtgagagaggaggacggcgtggaggaggtggagagagagatcatcaagcaggaggagaacgtggaccccgactactgggagaagctgctgagacaccactacgagcagcagcaggaggacctggccagaaacctgggcaagggcaagagaatcagaaagcaggtgaactacaacgacgccagccaggaggaccaggagtggcaggacgagctgagcgacaaccagagcgagtacagcatcggcagcgaggacgaggacgaggacttcgaggagagacccgagggccagagcggcagaagacagagcagaagacagctgaagagcgacagagacaagcccctgccccccctgctggccagagtgggcggcaacatcgaggtgctgggcttcaacgccagacagagaaaggccttcctgaacgccatcatgagatggggcatgcccccccaggacgccttcaacagccactggctggtgagagacctgagaggcaagagcgagaaggagttcagagcctacgtgagcctgttcatgagacacctgtgcgagcccggcgccgacggcgccgagaccttcgccgacggcgtgcccagagagggcctgagcagacagcacgtgctgaccagaatcggcgtgatgagcctggtgagaaagaaggtgcaggagttcgagcacgtgaacggcaagtacagcacccccgacctgatccccgagggccccgagggcaagaagagcggcgaggtgatcagcagcgaccccaacacccccgtgcccgccagccccgcccacctgctgcccgcccccctgggcctgcccgacaagatggaggcccagctgggctacatggacgagaaggaccccggcgcccagaagcccagacagcccctggaggtgcaggccctgcccgccgccctggacagagtggagagcgaggacaagcacgagagccccgccagcaaggagagagccagagaggagagacccgaggagaccgagaaggccccccccagccccgagcagctgcccagagccagctgcagcgtgacccaggccggcgtgcagtggagacacctgggcagctgggagcccctgagccccagactgaagagacccagccacctgagcttcctgaacagaggcggcgccagctag

SEQ ID NO: 76738 - DNA, 8994 bp, Artificial Sequence
  Description of Artificial Sequence: Synthetic coding sequence
atggccgaccccggcatgatgagcctgttcggcgaggacggcaacatcttcagcgagggcctggagggcctgggcgagtgcggctaccccgagaaccccgtgaaccccatgggccagcagatgcccatcgaccagggcttcgccagcctgcagcccagcctgcaccaccccagcaccaaccagaaccagaccaagctgacccacttcgaccactacaaccagtacgagcagcagaagatgcacctgatggaccagcccaacagaatgatgagcaacacccccggcaacggcctggccagcccccacagccagtaccacaccccccccgtgccccaggtgccccacggcggcagcggcggcggccagatgggcgtgtaccccggcatgcagaacgagagacacggccagagcttcgtggacagcagcagcatgtggggccccagagccgtgcaggtgcccgaccagatcagagccccctaccagcagcagcagccccagccccagcccccccagcccgcccccagcggcccccccgcccagggccacccccagcacatgcagcagatgggcagctacatggccagaggcgacttcagcatgcagcagcacggccagccccagcagagaatgagccagttcagccagggccaggagggcctgaaccagggcaaccccttcatcgccaccagcggccccggccacctgagccacgtgccccagcagagccccagcatggcccccagcctgagacacagcgtgcagcagttccaccaccaccccagcaccgccctgcacggcgagagcgtggcccacagccccagattcagccccaaccccccccagcagggcgccgtgagaccccagaccctgaacttcagcagcagaagccagaccgtgcccagccccaccatcaacaacagcggccagtacagcagatacccctacagcaacctgaaccagggcctggtgaacaacaccggcatgaaccagaacctgggcctgaccaacaacacccccatgaaccagagcgtgcccagataccccaacgccgtgggcttccccagcaacagcggccagggcctgatgcaccagcagcccatccaccccagcggcagcctgaaccagatgaacacccagaccatgcaccccagccagccccagggcacctacgccagccccccccccatgagccccatgaaggccatgagcaaccccgccggcaccccccccccccaggtgagacccggcagcgccggcatccccatggaggtgggcagctaccccaacatgccccacccccagcccagccaccagccccccggcgccatgggcatcggccagagaaacatgggccccagaaacatgcagcagagcagacccttcatcggcatgagcagcgcccccagagagctgaccggccacatgagacccaacggctgccccggcgtgggcctgggcgacccccaggccatccaggagagactgatccccggccagcagcaccccggccagcagcccagcttccagcagctgcccacctgcccccccctgcagccccaccccggcctgcaccaccagagcagccccccccacccccaccaccagccctgggcccagctgcaccccagcccccagaacaccccccagaaggtgcccgtgcaccagcacagccccagcgagcccttcctggagaagcccgtgcccgacatgacccaggtgagcggccccaacgcccagctggtgaagagcgacgactacctgcccagcatcgagcagcagccccagcagaagaagaagaagaagaagaacaaccacatcgtggccgaggaccccagcaagggcttcggcaaggacgacttccccggcggcgtggacaaccaggagctgaacagaaacagcctggacggcagccaggaggagaagaagaagaagaagagaagcaaggccaagaaggaccccaaggagcccaaggagcccaaggagaagaaggagcccaaggagcccaagacccccaaggcccccaagatccccaaggagcccaaggagaagaaggccaagaccgccacccccaagcccaagagcagcaagaagagcagcaacaagaagcccgacagcgaggccagcgccctgaagaagaaggtgaacaagggcaagaccgagggcagcgagaacagcgacctggacaagacccccccccccagccccccccccgaggaggacgaggaccccggcgtgcagaagagaagaagcagcagacaggtgaagagaaagagatacaccgaggacctggagttcaagatcagcgacgaggaggccgacgacgccgacgccgccggcagagacagccccagcaacaccagccagagcgagcagcaggagagcgtggacgccgagggccccgtggtggagaagatcatgagcagcagaagcgtgaagaagcagaaggagagcggcgaggaggtggagatcgaggagttctacgtgaagtacaagaacttcagctacctgcactgccagtgggccagcatcgaggacctggagaaggacaagagaatccagcagaagatcaagagattcaaggccaagcagggccagaacaagttcctgagcgagatcgaggacgagctgttcaaccccgactacgtggaggtggacagaatcatggacttcgccagaagcaccgacgacagaggcgagcccgtgacccactacctggtgaagtggtgcagcctgccctacgaggacagcacctgggagagaagacaggacatcgaccaggccaagatcgaggagttcgagaagctgatgagcagagagcccgagaccgagagagtggagagaccccccgccgacgactggaagaagagcgagagcagcagagagtacaagaacaacaacaagctgagagagtaccagctggagggcgtgaactggctgctgttcaactggtacaacatgagaaactgcatcctggccgacgagatgggcctgggcaagaccatccagagcatcaccttcctgtacgagatctacctgaagggcatccacggccccttcctggtgatcgcccccctgagcaccatccccaactgggagagagagttcagaacctggaccgagctgaacgtggtggtgtaccacggcagccaggccagcagaagaaccatccagctgtacgagatgtacttcaaggacccccagggcagagtgatcaagggcagctacaagttccacgccatcatcaccaccttcgagatgatcctgaccgactgccccgagctgagaaacatcccctggagatgcgtggtgatcgacgaggcccacagactgaagaacagaaactgcaagctgctggagggcctgaagatgatggacctggagcacaaggtgctgctgaccggcacccccctgcagaacaccgtggaggagctgttcagcctgctgcacttcctggagcccagcagattccccagcgagaccaccttcatgcaggagttcggcgacctgaagaccgaggagcaggtgcagaagctgcaggccatcctgaagcccatgatgctgagaagactgaaggaggacgtggagaagaacctggcccccaaggaggagaccatcatcgaggtggagctgaccaacatccagaagaagtactacagagccatcctggagaagaacttcaccttcctgagcaagggcggcggccaggccaacgtgcccaacctgctgaacaccatgatggagctgagaaagtgctgcaaccacccctacctgatcaacggcgccgaggagaagatcctggaggagttcaaggagacccacaacgccgagagccccgacttccagctgcaggccatgatccaggccgccggcaagctggtgctgatcgacaagctgctgcccaagctgaaggccggcggccacagagtgctgatcttcagccagatggtgagatgcctggacatcctggaggactacctgatccagagaagatacccctacgagagaatcgacggcagagtgagaggcaacctgagacaggccgccatcgacagattcagcaagcccgacagcgacagattcgtgttcctgctgtgcaccagagccggcggcctgggcatcaacctgaccgccgccgacacctgcatcatcttcgacagcgactggaacccccagaacgacctgcaggcccaggccagatgccacagaatcggccagagcaagagcgtgaagatctacagactgatcaccagaaacagctacgagagagagatgttcgacaaggccagcctgaagctgggcctggacaaggccgtgctgcagagcatgagcggcagagagaacgccaccaacggcgtgcagcagctgagcaagaaggagatcgaggacctgctgagaaagggcgcctacggcgccctgatggacgaggaggacgagggcagcaagttctgcgaggaggacatcgaccagatcctgctgagaagaacccacaccatcaccatcgagagcgagggcaagggcagcaccttcgccaaggccagcttcgtggccagcggcaacagaaccgacatcagcctggacgaccccaacttctggcagaagtgggccaagaaggccgagctggacatcgacgccctgaacggcagaaacaacctggtgatcgacacccccagagtgagaaagcagaccagactgtacagcgccgtgaaggaggacgagctgatggagttcagcgacctggagagcgacagcgaggagaagccctgcgccaagcccagaagaccccaggacaagagccagggctacgccagaagcgagtgcttcagagtggagaagaacctgctggtgtacggctggggcagatggaccgacatcctgagccacggcagatacaagagacagctgaccgagcaggacgtggagaccatctgcagaaccatcctggtgtactgcctgaaccactacaagggcgacgagaacatcaagagcttcatctgggacctgatcacccccaccgccgacggccagaccagagccctggtgaaccacagcggcctgagcgcccccgtgcccagaggcagaaagggcaagaaggtgaaggcccagagcacccagcccgtggtgcaggacgccgactggctggccagctgcaaccccgacgccctgttccaggaggacagctacaagaagcacctgaagcaccactgcaacaaggtgctgctgagagtgagaatgctgtactacctgagacaggaggtgatcggcgaccaggccgacaagatcctggagggcgccgacagcagcgaggccgacgtgtggatccccgagcccttccacgccgaggtgcccgccgactggtgggacaaggaggccgacaagagcctgctgatcggcgtgttcaagcacggctacgagaagtacaacagcatgagagccgaccccgccctgtgcttcctggagagagtgggcatgcccgacgccaaggccatcgccgccgagcagagaggcaccgacatgctggccgacggcggcgacggcggcgagttcgacagagaggacgaggaccccgagtacaagcccaccagaacccccttcaaggacgagatcgacgagttcgccaacagccccagcgaggacaaggaggagagcatggagatccacgccaccggcaagcacagcgagagcaacgccgagctgggccagctgtactggcccaacaccagcaccctgaccaccagactgagaagactgatcaccgcctaccagagaagctacaagagacagcagatgagacaggaggccctgatgaagaccgacagaagaagaagaagacccagagaggaggtgagagccctggaggccgagagagaggccatcatcagcgagaagagacagaagtggaccagaagagaggaggccgacttctacagagtggtgagcaccttcggcgtgatcttcgaccccgtgaagcagcagttcgactggaaccagttcagagccttcgccagactggacaagaagagcgacgagagcctggagaagtacttcagctgcttcgtggccatgtgcagaagagtgtgcagaatgcccgtgaagcccgacgacgagccccccgacctgagcagcatcatcgagcccatcaccgaggagagagccagcagaaccctgtacagaatcgagctgctgagaaagatcagagagcaggtgctgcaccacccccagctgggcgagagactgaagctgtgccagcccagcctggacctgcccgagtggtgggagtgcggcagacacgacagagacctgctggtgggcgccgccaagcacggcgtgagcagaaccgactaccacatcctgaacgaccccgagctgagcttcctggacgcccacaagaacttcgcccagaacagaggcgccggcaacaccagcagcctgaaccccctggccgtgggcttcgtgcagaccccccccgtgatcagcagcgcccacatccaggacgagagagtgctggagcaggccgagggcaaggtggaggagcccgagaaccccgccgccaaggagaagtgcgagggcaaggaggaggaggaggagaccgacggcagcggcaaggagagcaagcaggagtgcgaggccgaggccagcagcgtgaagaacgagctgaagggcgtggaggtgggcgccgacaccggcagcaagagcatcagcgagaagggcagcgaggaggacgaggaggagaagctggaggacgacgacaagagcgaggagagcagccagcccgaggccggcgccgtgagcagaggcaagaacttcgacgaggagagcaacgccagcatgagcaccgccagagacgagaccagagacggcttctacatggaggacggcgaccccagcgtggcccagctgctgcacgagagaaccttcgccttcagcttctggcccaaggacagagtgatgatcaacagactggacaacatctgcgaggccgtgctgaagggcaagtggcccgtgaacagaagacagatgttcgacttccagggcctgatccccggctacacccccaccaccgtggacagccccctgcagaagagaagcttcgccgagctgagcatggtgggccaggccagcatcagcggcagcgaggacatcaccaccagcccccagctgagcaaggaggacgccctgaacctgagcgtgcccagacagagaagaagaagaagaagaaagatcgagatcgaggccgagagagccgccaagagaagaaacctgatggagatggtggcccagctgagagagagccaggtggtgagcgagaacggccaggagaaggtggtggacctgagcaaggccagcagagaggccaccagcagcaccagcaacttcagcagcctgagcagcaagttcatcctgcccaacgtgagcacccccgtgagcgacgccttcaagacccagatggagctgctgcaggccggcctgagcagaacccccaccagacacctgctgaacggcagcctggtggacggcgagccccccatgaagagaagaagaggcagaagaaagaacgtggagggcctggacctgctgttcatgagccacaagagaaccagcctgagcgccgaggacgccgaggtgaccaaggccttcgaggaggacatcgagaccccccccaccagaaacatccccagccccggccagctggaccccgacaccagaatccccgtgatcaacctggaggacggcaccagactggtgggcgaggacgcccccaagaacaaggacctggtggagtggctgaagctgcaccccacctacaccgtggacatgcccagctacgtgcccaagaacgccgacgtgctgttcagcagcttccagaagcccaagcagaagagacacagatgcagaaaccccaacaagctggacatcaacaccctgaccggcgaggagagagtgcccgtggtgaacaagagaaacggcaagaagatgggcggcgccatggccccccccatgaaggacctgcccagatggctggaggagaaccccgagttcgccgtggcccccgactggaccgacatcgtgaagcagagcggcttcgtgcccgagagcatgttcgacagactgctgaccggccccgtggtgagaggcgagggcgccagcagaagaggcagaagacccaagagcgagatcgccagagccgccgccgccgccgccgccgtggccagcaccagcggcatcaaccccctgctggtgaacagcctgttcgccggcatggacctgaccagcctgcagaacctgcagaacctgcagagcctgcagctggccggcctgatgggcttcccccccggcctggccaccgccgccaccgccggcggcgacgccaagaaccccgccgccgtgctgcccctgatgctgcccggcatggccggcctgcccaacgtgttcggcctgggcggcctgctgaacaaccccctgagcgccgccaccggcaacaccaccaccgccagcagccagggcgagcccgaggacagcaccagcaagggcgaggagaagggcaacgagaacgaggacgagaacaaggacagcgagaagagcaccgacgccgtgagcgccgccgacagcgccaacggcagcgtgggcgccgccaccgcccccgccggcctgcccagcaaccccctggccttcaaccccttcctgctgagcaccatggcccccggcctgttctaccccagcatgttcctgccccccggcctgggcggcctgaccctgcccggcttccccgccctggccggcctgcagaacgccgtgggcagcagcgaggagaaggccgccgacaaggccgagggcggccccttcaaggacggcgagaccctggagggcagcgacgccgaggagagcctggacaagaccgccgagagcagcctgctggaggacgagatcgcccagggcgaggagctggacagcctggacggcggcgacgagatcgagaacaacgagaacgacgagtag

SEQ ID NO: 76739 - DNA, 8994 bp, Artificial Sequence; identical to SEQ ID NO: 76738
  Description of Artificial Sequence: Synthetic coding sequence

SEQ ID NO: 76740 - DNA, 102 bp, Artificial Sequence
  Description of Artificial Sequence: Synthetic coding sequence
atggccgaccccggcatgatgagcctgttcggcgaggacggcaacatcttcagcgagggcctggagggcctgggcgagtgcggctaccccgagaacccctag

SEQ ID NO: 76741 - DNA, 6906 bp, Artificial Sequence
  Description of Artificial Sequence: Synthetic coding sequence
aagggcgagagcaagagaatcaccctggtgctgcagcagccccagagcggcggcccccagggccacagacacgtggtgctgggcagcctgcccggcaagatcgtgctgcagggcaaccagctggccgccctgacccaggccaagaacgcccagggccagcccgccaaggtggtgaccatccagctgcaggtgcagcagccccagcagaagatccagatcgtgccccagccccccagcagccagccccagccccagcagccccccagcacccagcccgtgaccctgagcagcgtgcagcaggcccagatcatgggccccggccagagccccggccagagactgagcgtgcccgtgaaggtggtgctgcagccccaggccggcagcagccagggcgccagcagcggcctgagcgtggtgaaggtgctgagcgccagcgaggtggccgccctgagcagccccgccagcagcgccccccacagcggcggcaagaccggcatggaggagaacagaagactggagcaccagaagaagcaggagaaggccaacagaatcgtggccgaggccatcgccagagccagagccagaggcgagcagaacatccccagagtgctgaacgaggacgagctgcccagcgtgagacccgaggaggagggcgagaagaagagaagaaagaagagcgccggcgagagactgaaggaggagaagcccaagaagagcaagaccagcggcgccagcaagaccaagggcaagagcaagctgaacaccatcacccccgtggtgggcaagaagagaaagagaaacaccagcagcgacaacagcgacgtggaggtgatgcccgcccagagccccagagaggacgaggagagcagcatccagaagagaagaagcaacagacaggtgaagagaaagaagtacaccgaggacctggacatcaagatcaccgacgacgaggaggaggaggaggtggacgtgaccggccccatcaagcccgagcccatcctgcccgagcccgtgcaggagcccgacggcgagaccctgcccagcatgcagttcttcgtggagaaccccagcgaggaggacgccgccatcgtggacaaggtgctgagcatgagaatcgtgaagaaggagctgcccagcggccagtacaccgaggccgaggagttcttcgtgaagtacaagaactacagctacctgcactgcgagtgggccaccatcagccagctggagaaggacaagagaatccaccagaagctgaagagattcaagaccaagatggcccagatgagacacttcttccacgaggacgaggagcccttcaaccccgactacgtggaggtggacagaatcctggacgagagccacagcatcgacaaggacaacggcgagcccgtgatctactacctggtgaagtggtgcagcctgccctacgaggacagcacctgggagctgaaggaggacgtggacgagggcaagatcagagagttcaagagaatccagagcagacaccccgagctgaagagagtgaacagaccccaggccagcgcctggaagaagctggagctgagccacgagtacaagaacagaaaccagctgagagagtaccagctggagggcgtgaactggctgctgttcaactggtacaacagacagaactgcatcctggccgacgagatgggcctgggcaagaccatccagagcatcgccttcctgcaggaggtgtacaacgtgggcatccacggccccttcctggtgatcgcccccctgagcaccatcaccaactgggagagagagttcaacacctggaccgagatgaacaccatcgtgtaccacggcagcctggccagcagacagatgatccagcagtacgagatgtactgcaaggacagcagaggcagactgatccccggcgcctacaagttcgacgccctgatcaccaccttcgagatgatcctgagcgactgccccgagctgagagagatcgagtggagatgcgtgatcatcgacgaggcccacagactgaagaacagaaactgcaagctgctggacagcctgaagcacatggacctggagcacaaggtgctgctgaccggcacccccctgcagaacaccgtggaggagctgttcagcctgctgcacttcctggagcccagccagttccccagcgagagcgagttcctgaaggacttcggcgacctgaagaccgaggagcaggtgcagaagctgcaggccatcctgaagcccatgatgctgagaagactgaaggaggacgtggagaagaacctggcccccaagcaggagaccatcatcgaggtggagctgaccaacatccagaagaagtactacagagccatcctggagaagaacttcagcttcctgagcaagggcgccggccacaccaacatgcccaacctgctgaacaccatgatggagctgagaaagtgctgcaaccacccctacctgatcaacggcgccgaggagaagatcctgaccgagttcagagaggcctgccacatcatcccccacgacttccacctgcaggccatggtgagaagcgccggcaagctggtgctgatcgacaagctgctgcccaagctgaaggccggcggccacaaggtgctgatcttcagccagatggtgagatgcctggacatcctggaggactacctgatccagagaagatacctgtacgagagaatcgacggcagagtgagaggcaacctgagacaggccgccatcgacagattcagcaagcccgacagcgacagattcgtgttcctgctgtgcaccagagccggcggcctgggcatcaacctgaccgccgccgacacctgcatcatcttcgacagcgactggaacccccagaacgacctgcaggcccaggccagatgccacagaatcggccagagcaaggccgtgaaggtgtacagactgatcaccagaaacagctacgagagagagatgttcgacaaggccagcctgaagctgggcctggacaaggccgtgctgcagagcatgagcggcagagacggcaacatcaccggcatccagcagttcagcaagaaggagatcgaggacctgctgagaaagggcgcctacgccgccatcatggaggaggacgacgagggcagcaagttctgcgaggaggacatcgaccagatcctgctgagaagaaccaccaccatcaccatcgagagcgagggcaagggcagcaccttcgccaaggccagcttcgtggccagcgagaacagaaccgacatcagcctggacgaccccaacttctggcagaagtgggccaagaaggccgacctggacatggacctgctgaacagcaagaacaacctggtgatcgacacccccagagtgagaaagcagaccagacacttcagcaccctgaaggacgacgacctggtggagttcagcgacctggagagcgaggacgacgagagacccagaagcagaagacacgacagacaccacgcctacggcagaaccgactgcttcagagtggagaagcacctgctggtgtacggctggggcagatggagagacatcctgagccacggcagattcaagagaagaatgaccgagagagacgtggagaccatctgcagagccatcctggtgtactgcctgctgcactacagaggcgacgagaacatcaagggcttcatctgggacctgatcagccccgccgagaacggcaagaccaaggagctgcagaaccacagcggcctgagcatccccgtgcccagaggcagaaagggcaagaaggtgaagagccagagcaccttcgacatccacaaggccgactggatcagaaagtacaaccccgacaccctgttccaggacgagagctacaagaagcacctgaagcaccagtgcaacaaggtgctgctgagagtgagaatgctgtactacctgagacaggaggtgatcggcgaccaggccgagaaggtgctgggcggcgccatcgccagcgagatcgacatctggttccccgtggtggaccagctggaggtgcccaccacctggtgggacagcgaggccgacaagagcctgctgatcggcgtgttcaagcacggctacgagaagtacaacaccatgagagccgaccccgccctgtgcttcctggagaaggccggcagacccgacgacaaggccatcgccgccgagcacagagtgctggacaacttcagcgacatcgtggagggcgtggacttcgacaaggactgcgaggaccccgagtacaagcccctgcagggcccccccaaggaccaggacgacgagggcgaccccctgatgatgatggacgaggagatcagcgtgatcgacggcgacgaggcccaggtgacccagcagcccggccacctgttctggccccccggcagcgccctgaccgccagactgagaagactggtgaccgcctaccagagaagctacaagagagagcagatgaagatcgaggccgccgagagaggcgacagaagaagaagaagatgcgaggccgccttcaagctgaaggagatcgccagaagagagaagcagcagagatggaccagaagagagcagaccgacttctacagagtggtgagcaccttcggcgtggagtacgaccccgacaccatgcagttccactgggacagattcagaaccttcgccagactggacaagaagaccgacgagagcctgaccaagtacttccacggcttcgtggccatgtgcagacaggtgtgcagactgccccccgccgccggcgacgagccccccgaccccaacctgttcatcgagcccatcaccgaggagagagccagcagaaccctgtacagaatcgagctgctgagaagactgagagagcaggtgctgtgccaccccctgctggaggacagactggccctgtgccagccccccggccccgagctgcccaagtggtgggagcccgtgagacacgacggcgagctgctgagaggcgccgccagacacggcgtgagccagaccgactgcaacatcatgcaggaccccgacttcagcttcctggccgccagaatgaactacatgcagaaccaccaggccggcgcccccgcccccagcctgagcagatgcagcacccccctgctgcaccagcagtacaccagcagaaccgccagccccctgcccctgagacccgacgcccccgtggagaagagccccgaggagaccgccacccaggtgcccagcctggagagcctgaccctgaagctggagcacgaggtggtggccagaagcagacccaccccccaggactacgagatgagagtgagccccagcgacaccacccccctggtgagcagaagcgtgccccccgtgaagctggaggacgaggacgacagcgacagcgagctggacctgagcaagctgagccccagcagcagcagcagcagcagcagcagcagcagcagcagcagcaccgacgagagcgaggacgagaaggaggagaagctgaccgaccagagcagaagcaagctgtacgacgaggagagcctgctgagcctgaccatgagccaggacggcttccccaacgaggacggcgagcagatgacccccgagctgctgctgctgcaggagagacagagagccagcgagtggcccaaggacagagtgctgatcaacagaatcgacctggtgtgccaggccgtgctgagcggcaagtggcccagcagcagaagaagccaggagatggtgaccggcggcatcctgggccccggcaaccacctgctggacagccccagcctgacccccggcgagtacggcgacagccccgtgcccacccccagaagcagcagcgccgccagcatggccgaggaggaggccagcgccgtgagcaccgccgccgcccagttcaccaagctgagaagaggcatggacgagaaggagttcaccgtgcagatcaaggacgaggagggcctgaagctgaccttccagaagcacaagctgatggccaacggcgtgatgggcgacggccaccccctgttccacaagaagaagggcaacagaaagaagctggtggagctggaggtggagtgcatggaggagcccaaccacctggacgtggacctggagaccagaatccccgtgatcaacaaggtggacggcaccctgctggtgggcgaggacgcccccagaagagccgagctggagatgtggctgcagggccaccccgagttcgccgtggaccccagattcctggcctacatggaggacagaagaaagcagaagtggcagagatgcaagaagaacaacaaggccgagctgaactgcctgggcatggagcccgtgcagaccgccaacagcagaaacggcaagaagggccaccacaccgagaccgtgttcaacagagtgctgcccggccccatcgcccccgagagcagcaagaagagagccagaagaatgagacccgacctgagcaagatgatggccctgatgcagggcggcagcaccggcagcctgagcctgcacaacaccttccagcacagcagcagcggcctgcagagcgtgagcagcctgggccacagcagcgccaccagcgccagcctgcccttcatgcccttcgtgatgggcggcgcccccagcagcccccacgtggacagcagcaccatgctgcaccaccaccaccaccacccccacccccaccaccaccaccaccaccaccccggcctgagagcccccggctaccccagcagccccgtgaccaccgccagcggcaccaccctgagactgccccccctgcagcccgaggaggacgacgacgaggacgaggaggacgacgacgacctgagccagggctacgacagcagcgagagagacttcagcctgatcgacgaccccatgatgcccgccaacagcgacagcagcgaggacgccgacgactag

SEQ ID NO: 76742 - DNA, 7746 bp, Artificial Sequence
  Description of Artificial Sequence: Synthetic coding sequence
atggccgaccccatcatggacctgttcgacgaccccaacctgttcggcctggacagcctgaccgacgacagcttcaaccaggtgacccaggaccccatcgaggaggccctgggcctgcccagcagcctggacagcctggaccagatgaaccaggacggcggcggcggcgacgtgggcaacagcagcgccagcgagctggtgcccccccccgaggagaccgcccccaccgagctgagcaaggagagcaccgcccccgcccccgagagcatcaccctgcacgactacaccacccagcccgccagccaggagcagcccgcccagcccgtgctgcagaccagcacccccaccagcggcctgctgcaggtgagcaagagccaggagatcctgagccagggcaaccccttcatgggcgtgagcgccaccgccgtgagcagcagcagcgccggcggccagcccccccagagcgcccccaagatcgtgatcctgaaggccccccccagcagcagcgtgaccggcgcccacgtggcccagatccaggcccagggcatcaccagcaccgcccagcccctggtggccggcaccgccaacggcggcaaggtgaccttcaccaaggtgctgaccggcacccccctgagacccggcgtgagcatcgtgagcggcaacaccgtgctggccgccaaggtgcccggcaaccaggccgccgtgcagagaatcgtgcagcccagcagacccgtgaagcagctggtgctgcagcccgtgaagggcagcgcccccgccggcaaccccggcgccaccggcccccccctgaagcccgccgtgaccctgaccagcacccccacccagggcgagagcaagagaatcaccctggtgctgcagcagccccagagcggcggcccccagggccacagacacgtggtgctgggcagcctgcccggcaagatcgtgctgcagggcaaccagctggccgccctgacccaggccaagaacgcccagggccagcccgccaaggtggtgaccatccagctgcaggtgcagcagccccagcagaagatccagatcgtgccccagccccccagcagccagccccagccccagcagccccccagcacccagcccgtgaccctgagcagcgtgcagcaggcccagatcatgggccccggccagagccccggccagagactgagcgtgcccgtgaaggtggtgctgcagccccaggccggcagcagccagggcgccagcagcggcctgagcgtggtgaaggtgctgagcgccagcgaggtggccgccctgagcagccccgccagcagcgccccccacagcggcggcaagaccggcatggaggagaacagaagactggagcaccagaagaagcaggagaaggccaacagaatcgtggccgaggccatcgccagagccagagccagaggcgagcagaacatccccagagtgctgaacgaggacgagctgcccagcgtgagacccgaggaggagggcgagaagaagagaagaaagaagagcgccggcgagagactgaaggaggagaagcccaagaagagcaagaccagcggcgccagcaagaccaagggcaagagcaagctgaacaccatcacccccgtggtgggcaagaagagaaagagaaacaccagcagcgacaacagcgacgtggaggtgatgcccgcccagagccccagagaggacgaggagagcagcatccagaagagaagaagcaacagacaggtgaagagaaagaagtacaccgaggacctggacatcaagatcaccgacgacgaggaggaggaggaggtggacgtgaccggccccatcaagcccgagcccatcctgcccgagcccgtgcaggagcccgacggcgagaccctgcccagcatgcagttcttcgtggagaaccccagcgaggaggacgccgccatcgtggacaaggtgctgagcatgagaatcgtgaagaaggagctgcccagcggccagtacaccgaggccgaggagttcttcgtgaagtacaagaactacagctacctgcactgcgagtgggccaccatcagccagctggagaaggacaagagaatccaccagaagctgaagagattcaagaccaagatggcccagatgagacacttcttccacgaggacgaggagcccttcaaccccgactacgtggaggtggacagaatcctggacgagagccacagcatcgacaaggacaacggcgagcccgtgatctactacctggtgaagtggtgcagcctgccctacgaggacagcacctgggagctgaaggaggacgtggacgagggcaagatcagagagttcaagagaatccagagcagacaccccgagctgaagagagtgaacagaccccaggccagcgcctggaagaagctggagctgagccacgagtacaagaacagaaaccagctgagagagtaccagctggagggcgtgaactggctgctgttcaactggtacaacagacagaactgcatcctggccgacgagatgggcctgggcaagaccatccagagcatcgccttcctgcaggaggtgtacaacgtgggcatccacggccccttcctggtgatcgcccccctgagcaccatcaccaactgggagagagagttcaacacctggaccgagatgaacaccatcgtgtaccacggcagcctggccagcagacagatgatccagcagtacgagatgtactgcaaggacagcagaggcagactgatccccggcgcctacaagttcgacgccctgatcaccaccttcgagatgatcctgagcgactgccccgagctgagagagatcgagtggagatgcgtgatcatcgacgaggcccacagactgaagaacagaaactgcaagctgctggacagcctgaagcacatggacctggagcacaaggtgctgctgaccggcacccccctgcagaacaccgtggaggagctgttcagcctgctgcacttcctggagcccagccagttccccagcgagagcgagttcctgaaggacttcggcgacctgaagaccgaggagcaggtgcagaagctgcaggccatcctgaagcccatgatgctgagaagactgaaggaggacgtggagaagaacctggcccccaagcaggagaccatcatcgaggtggagctgaccaacatccagaagaagtactacagagccatcctggagaagaacttcagcttcctgagcaagggcgccggccacaccaacatgcccaacctgctgaacaccatgatggagctgagaaagtgctgcaaccacccctacctgatcaacggcgccgaggagaagatcctgaccgagttcagagaggcctgccacatcatcccccacgacttccacctgcaggccatggtgagaagcgccggcaagctggtgctgatcgacaagctgctgcccaagctgaaggccggcggccacaaggtgctgatcttcagccagatggtgagatgcctggacatcctggaggactacctgatccagagaagatacctgtacgagagaatcgacggcagagtgagaggcaacctgagacaggccgccatcgacagattcagcaagcccgacagcgacagattcgtgttcctgctgtgcaccagagccggcggcctgggcatcaacctgaccgccgccgacacctgcatcatcttcgacagcgactggaacccccagaacgacctgcaggcccaggccagatgccacagaatcggccagagcaaggccgtgaaggtgtacagactgatcaccagaaacagctacgagagagagatgttcgacaaggccagcctgaagctgggcctggacaaggccgtgctgcagagcatgagcggcagagacggcaacatcaccggcatccagcagttcagcaagaaggagatcgaggacctgctgagaaagggcgcctacgccgccatcatggaggaggacgacgagggcagcaagttctgcgaggaggacatcgaccagatcctgctgagaagaaccaccaccatcaccatcgagagcgagggcaagggcagcaccttcgccaaggccagcttcgtggccagcgagaacagaaccgacatcagcctggacgaccccaacttctggcagaagtgggccaagaaggccgacctggacatggacctgctgaacagcaagaacaacctggtgatcgacacccccagagtgagaaagcagaccagacacttcagcaccctgaaggacgacgacctggtggagttcagcgacctggagagcgaggacgacgagagacccagaagcagaagacacgacagacaccacgcctacggcagaaccgactgcttcagagtggagaagcacctgctggtgtacggctggggcagatggagagacatcctgagccacggcagattcaagagaagaatgaccgagagagacgtggagaccatctgcagagccatcctggtgtactgcctgctgcactacagaggcgacgagaacatcaagggcttcatctgggacctgatcagccccgccgagaacggcaagaccaaggagctgcagaaccacagcggcctgagcatccccgtgcccagaggcagaaagggcaagaaggtgaagagccagagcaccttcgacatccacaaggccgactggatcagaaagtacaaccccgacaccctgttccaggacgagagctacaagaagcacctgaagcaccagtgcaacaaggtgctgctgagagtgagaatgctgtactacctgagacaggaggtgatcggcgaccaggccgagaaggtgctgggcggcgccatcgccagcgagatcgacatctggttccccgtggtggaccagctggaggtgcccaccacctggtgggacagcgaggccgacaagagcctgctgatcggcgtgttcaagcacggctacgagaagtacaacaccatgagagccgaccccgccctgtgcttcctggagaaggccggcagacccgacgacaaggccatcgccgccgagcacagagtgctggacaacttcagcgacatcgtggagggcgtggacttcgacaaggactgcgaggaccccgagtacaagcccctgcagggcccccccaaggaccaggacgacgagggcgaccccctgatgatgatggacgaggagatcagcgtgatcgacggcgacgaggcccaggtgacccagcagcccggccacctgttctggccccccggcagcgccctgaccgccagactgagaagactggtgaccgcctaccagagaagctacaagagagagcagatgaagatcgaggccgccgagagaggcgacagaagaagaagaagatgcgaggccgccttcaagctgaaggagatcgccagaagagagaagcagcagagatggaccagaagagagcagaccgacttctacagagtggtgagcaccttcggcgtggagtacgaccccgacaccatgcagttccactgggacagattcagaaccttcgccagactggacaagaagaccgacgagagcctgaccaagtacttccacggcttcgtggccatgtgcagacaggtgtgcagactgccccccgccgccggcgacgagccccccgaccccaacctgttcatcgagcccatcaccgaggagagagccagcagaaccctgtacagaatcgagctgctgagaagactgagagagcaggtgctgtgccaccccctgctggaggacagactggccctgtgccagccccccggccccgagctgcccaagtggtgggagcccgtgagacacgacggcgagctgctgagaggcgccgccagacacggcgtgagccagaccgactgcaacatcatgcaggaccccgacttcagcttcctggccgccagaatgaactacatgcagaaccaccaggccggcgcccccgcccccagcctgagcagatgcagcacccccctgctgcaccagcagtacaccagcagaaccgccagccccctgcccctgagacccgacgcccccgtggagaagagccccgaggagaccgccacccaggtgcccagcctggagagcctgaccctgaagctggagcacgaggtggtggccagaagcagacccaccccccaggactacgagatgagagtgagccccagcgacaccacccccctggtgagcagaagcgtgccccccgtgaagctggaggacgaggacgacagcgacagcgagctggacctgagcaagctgagccccagcagcagcagcagcagcagcagcagcagcagcagcagcagcaccgacgagagcgaggacgagaaggaggagaagctgaccgaccagagcagaagcaagctgtacgacgaggagagcctgctgagcctgaccatgagccaggacggcttccccaacgaggacggcgagcagatgacccccgagctgctgctgctgcaggagagacagagagccagcgagtggcccaaggacagagtgctgatcaacagaatcgacctggtgtgccaggccgtgctgagcggcaagtggcccagcagcagaagaagccaggagatggtgaccggcggcatcctgggccccggcaaccacctgctggacagccccagcctgacccccggcgagtacggcgacagccccgtgcccacccccagaagcagcagcgccgccagcatggccgaggaggaggccagcgccgtgagcaccgccgccgcccagttcaccaagctgagaagaggcatggacgagaaggagttcaccgtgcagatcaaggacgaggagggcctgaagctgaccttccagaagcacaagctgatggccaacggcgtgatgggcgacggccaccccctgttccacaagaagaagggcaacagaaagaagctggtggagctggaggtggagtgcatggaggagcccaaccacctggacgtggacctggagaccagaatccccgtgatcaacaaggtggacggcaccctgctggtgggcgaggacgcccccagaagagccgagctggagatgtggctgcagggccaccccgagttcgccgtggaccccagattcctggcctacatggaggacagaagaaagcagaagtggcagagatgcaagaagaacaacaaggccgagctgaactgcctgggcatggagcccgtgcagaccgccaacagcagaaacggcaagaagggccaccacaccgagaccgtgttcaacagagtgctgcccggccccatcgcccccgagagcagcaagaagagagccagaagaatgagacccgacctgagcaagatgatggccctgatgcagggcggcagcaccggcagcctgagcctgcacaacaccttccagcacagcagcagcggcctgcagagcgtgagcagcctgggccacagcagcgccaccagcgccagcctgcccttcatgcccttcgtgatgggcggcgcccccagcagcccccacgtggacagcagcaccatgctgcaccaccaccaccaccacccccacccccaccaccaccaccaccaccaccccggcctgagagcccccggctaccccagcagccccgtgaccaccgccagcggcaccaccctgagactgccccccctgcagcccgaggaggacgacgacgaggacgaggaggacgacgacgacctgagccagggctacgacagcagcgagagagacttcagcctgatcgacgaccccatgatgcccgccaacagcgacagcagcgaggacgccgacgactag

SEQ ID NO: 76743 - DNA, 6909 bp, Artificial Sequence
  Description of Artificial Sequence: Synthetic coding sequence
atgaagggcgagagcaagagaatcaccctggtgctgcagcagccccagagcggcggcccccagggccacagacacgtggtgctgggcagcctgcccggcaagatcgtgctgcagggcaaccagctggccgccctgacccaggccaagaacgcccagggccagcccgccaaggtggtgaccatccagctgcaggtgcagcagccccagcagaagatccagatcgtgccccagccccccagcagccagccccagccccagcagccccccagcacccagcccgtgaccctgagcagcgtgcagcaggcccagatcatgggccccggccagagccccggccagagactgagcgtgcccgtgaaggtggtgctgcagccccaggccggcagcagccagggcgccagcagcggcctgagcgtggtgaaggtgctgagcgccagcgaggtggccgccctgagcagccccgccagcagcgccccccacagcggcggcaagaccggcatggaggagaacagaagactggagcaccagaagaagcaggagaaggccaacagaatcgtggccgaggccatcgccagagccagagccagaggcgagcagaacatccccagagtgctgaacgaggacgagctgcccagcgtgagacccgaggaggagggcgagaagaagagaagaaagaagagcgccggcgagagactgaaggaggagaagcccaagaagagcaagaccagcggcgccagcaagaccaagggcaagagcaagctgaacaccatcacccccgtggtgggcaagaagagaaagagaaacaccagcagcgacaacagcgacgtggaggtgatgcccgcccagagccccagagaggacgaggagagcagcatccagaagagaagaagcaacagacaggtgaagagaaagaagtacaccgaggacctggacatcaagatcaccgacgacgaggaggaggaggaggtggacgtgaccggccccatcaagcccgagcccatcctgcccgagcccgtgcaggagcccgacggcgagaccctgcccagcatgcagttcttcgtggagaaccccagcgaggaggacgccgccatcgtggacaaggtgctgagcatgagaatcgtgaagaaggagctgcccagcggccagtacaccgaggccgaggagttcttcgtgaagtacaagaactacagctacctgcactgcgagtgggccaccatcagccagctggagaaggacaagagaatccaccagaagctgaagagattcaagaccaagatggcccagatgagacacttcttccacgaggacgaggagcccttcaaccccgactacgtggaggtggacagaatcctggacgagagccacagcatcgacaaggacaacggcgagcccgtgatctactacctggtgaagtggtgcagcctgccctacgaggacagcacctgggagctgaaggaggacgtggacgagggcaagatcagagagttcaagagaatccagagcagacaccccgagctgaagagagtgaacagaccccaggccagcgcctggaagaagctggagctgagccacgagtacaagaacagaaaccagctgagagagtaccagctggagggcgtgaactggctgctgttcaactggtacaacagacagaactgcatcctggccgacgagatgggcctgggcaagaccatccagagcatcgccttcctgcaggaggtgtacaacgtgggcatccacggccccttcctggtgatcgcccccctgagcaccatcaccaactgggagagagagttcaacacctggaccgagatgaacaccatcgtgtaccacggcagcctggccagcagacagatgatccagcagtacgagatgtactgcaaggacagcagaggcagactgatccccggcgcctacaagttcgacgccctgatcaccaccttcgagatgatcctgagcgactgccccgagctgagagagatcgagtggagatgcgtgatcatcgacgaggcccacagactgaagaacagaaactgcaagctgctggacagcctgaagcacatggacctggagcacaaggtgctgctgaccggcacccccctgcagaacaccgtggaggagctgttcagcctgctgcacttcctggagcccagccagttccccagcgagagcgagttcctgaaggacttcggcgacctgaagaccgaggagcaggtgcagaagctgcaggccatcctgaagcccatgatgctgagaagactgaaggaggacgtggagaagaacctggcccccaagcaggagaccatcatcgaggtggagctgaccaacatccagaagaagtactacagagccatcctggagaagaacttcagcttcctgagcaagggcgccggccacaccaacatgcccaacctgctgaacaccatgatggagctgagaaagtgctgcaaccacccctacctgatcaacggcgccgaggagaagatcctgaccgagttcagagaggcctgccacatcatcccccacgacttccacctgcaggccatggtgagaagcgccggcaagctggtgctgatcgacaagctgctgcccaagctgaaggccggcggccacaaggtgctgatcttcagccagatggtgagatgcctggacatcctggaggactacctgatccagagaagatacctgtacgagagaatcgacggcagagtgagaggcaacctgagacaggccgccatcgacagattcagcaagcccgacagcgacagattcgtgttcctgctgtgcaccagagccggcggcctgggcatcaacctgaccgccgccgacacctgcatcatcttcgacagcgactggaacccccagaacgacctgcaggcccaggccagatgccacagaatcggccagagcaaggccgtgaaggtgtacagactgatcaccagaaacagctacgagagagagatgttcgacaaggccagcctgaagctgggcctggacaaggccgtgctgcagagcatgagcggcagagacggcaacatcaccggcatccagcagttcagcaagaaggagatcgaggacctgctgagaaagggcgcctacgccgccatcatggaggaggacgacgagggcagcaagttctgcgaggaggacatcgaccagatcctgctgagaagaaccaccaccatcaccatcgagagcgagggcaagggcagcaccttcgccaaggccagcttcgtggccagcgagaacagaaccgacatcagcctggacgaccccaacttctggcagaagtgggccaagaaggccgacctggacatggacctgctgaacagcaagaacaacctggtgatcgacacccccagagtgagaaagcagaccagacacttcagcaccctgaaggacgacgacctggtggagttcagcgacctggagagcgaggacgacgagagacccagaagcagaagacacgacagacaccacgcctacggcagaaccgactgcttcagagtggagaagcacctgctggtgtacggctggggcagatggagagacatcctgagccacggcagattcaagagaagaatgaccgagagagacgtggagaccatctgcagagccatcctggtgtactgcctgctgcactacagaggcgacgagaacatcaagggcttcatctgggacctgatcagccccgccgagaacggcaagaccaaggagctgcagaaccacagcggcctgagcatccccgtgcccagaggcagaaagggcaagaaggtgaagagccagagcaccttcgacatccacaaggccgactggatcagaaagtacaaccccgacaccctgttccaggacgagagctacaagaagcacctgaagcaccagtgcaacaaggtgctgctgagagtgagaatgctgtactacctgagacaggaggtgatcggcgaccaggccgagaaggtgctgggcggcgccatcgccagcgagatcgacatctggttccccgtggtggaccagctggaggtgcccaccacctggtgggacagcgaggccgacaagagcctgctgatcggcgtgttcaagcacggctacgagaagtacaacaccatgagagccgaccccgccctgtgcttcctggagaaggccggcagacccgacgacaaggccatcgccgccgagcacagagtgctggacaacttcagcgacatcgtggagggcgtggacttcgacaaggactgcgaggaccccgagtacaagcccctgcagggcccccccaaggaccaggacgacgagggcgaccccctgatgatgatggacgaggagatcagcgtgatcgacggcgacgaggcccaggtgacccagcagcccggccacctgttctggccccccggcagcgccctgaccgccagactgagaagactggtgaccgcctaccagagaagctacaagagagagcagatgaagatcgaggccgccgagagaggcgacagaagaagaagaagatgcgaggccgccttcaagctgaaggagatcgccagaagagagaagcagcagagatggaccagaagagagcagaccgacttctacagagtggtgagcaccttcggcgtggagtacgaccccgacaccatgcagttccactgggacagattcagaaccttcgccagactggacaagaagaccgacgagagcctgaccaagtacttccacggcttcgtggccatgtgcagacaggtgtgcagactgccccccgccgccggcgacgagccccccgaccccaacctgttcatcgagcccatcaccgaggagagagccagcagaaccctgtacagaatcgagctgctgagaagactgagagagcaggtgctgtgccaccccctgctggaggacagactggccctgtgccagccccccggccccgagctgcccaagtggtgggagcccgtgagacacgacggcgagctgctgagaggcgccgccagacacggcgtgagccagaccgactgcaacatcatgcaggaccccgacttcagcttcctggccgccagaatgaactacatgcagaaccaccaggccggcgcccccgcccccagcctgagcagatgcagcacccccctgctgcaccagcagtacaccagcagaaccgccagccccctgcccctgagacccgacgcccccgtggagaagagccccgaggagaccgccacccaggtgcccagcctggagagcctgaccctgaagctggagcacgaggtggtggccagaagcagacccaccccccaggactacgagatgagagtgagccccagcgacaccacccccctggtgagcagaagcgtgccccccgtgaagctggaggacgaggacgacagcgacagcgagctggacctgagcaagctgagccccagcagcagcagcagcagcagcagcagcagcagcagcagcagcaccgacgagagcgaggacgagaaggaggagaagctgaccgaccagagcagaagcaagctgtacgacgaggagagcctgctgagcctgaccatgagccaggacggcttccccaacgaggacggcgagcagatgacccccgagctgctgctgctgcaggagagacagagagccagcgagtggcccaaggacagagtgctgatcaacagaatcgacctggtgtgccaggccgtgctgagcggcaagtggcccagcagcagaagaagccaggagatggtgaccggcggcatcctgggccccggcaaccacctgctggacagccccagcctgacccccggcgagtacggcgacagccccgtgcccacccccagaagcagcagcgccgccagcatggccgaggaggaggccagcgccgtgagcaccgccgccgcccagttcaccaagctgagaagaggcatggacgagaaggagttcaccgtgcagatcaaggacgaggagggcctgaagctgaccttccagaagcacaagctgatggccaacggcgtgatgggcgacggccaccccctgttccacaagaagaagggcaacagaaagaagctggtggagctggaggtggagtgcatggaggagcccaaccacctggacgtggacctggagaccagaatccccgtgatcaacaaggtggacggcaccctgctggtgggcgaggacgcccccagaagagccgagctggagatgtggctgcagggccaccccgagttcgccgtggaccccagattcctggcctacatggaggacagaagaaagcagaagtggcagagatgcaagaagaacaacaaggccgagctgaactgcctgggcatggagcccgtgcagaccgccaacagcagaaacggcaagaagggccaccacaccgagaccgtgttcaacagagtgctgcccggccccatcgcccccgagagcagcaagaagagagccagaagaatgagacccgacctgagcaagatgatggccctgatgcagggcggcagcaccggcagcctgagcctgcacaacaccttccagcacagcagcagcggcctgcagagcgtgagcagcctgggccacagcagcgccaccagcgccagcctgcccttcatgcccttcgtgatgggcggcgcccccagcagcccccacgtggacagcagcaccatgctgcaccaccaccaccaccacccccacccccaccaccaccaccaccaccaccccggcctgagagcccccggctaccccagcagccccgtgaccaccgccagcggcaccaccctgagactgccccccctgcagcccgaggaggacgacgacgaggacgaggaggacgacgacgacctgagccagggctacgacagcagcgagagagacttcagcctgatcgacgaccccatgatgcccgccaacagcgacagcagcgaggacgccgacgactag

SEQ ID NO: 76744 - DNA, 7746 bp, Artificial Sequence; identical to SEQ ID NO: 76742
  Description of Artificial Sequence: Synthetic coding sequence

SEQ ID NO: 76745 - DNA, 1797 bp, Artificial Sequence
  Description of Artificial Sequence: Synthetic coding sequence
atgaccttccaggccagccacagaagcgcctggggcaagagcagaaagaagaactggcagtacgagggccccacccagaagctgttcctgaagagaaacaacgtgagcgcccccgacggccccagcgaccccagcatcagcgtgagcagcgagcagagcggcgcccagcagccccccgccctgcaggtggagagaatcgtggacaagagaaagaacaagaagggcaagaccgagtacctggtgagatggaagggctacgacagcgaggacgacacctgggagcccgagcagcacctggtgaactgcgaggagtacatccacgacttcaacagaagacacaccgagaagcagaaggagagcaccctgaccagaaccaacagaaccagccccaacaacgccagaaagcagatcagcagaagcaccaacagcaacttcagcaagaccagccccaaggccctggtgatcggcaaggaccacgagagcaagaacagccagctgttcgccgccagccagaagttcagaaagaacaccgcccccagcctgagcagcagaaagaacatggacctggccaagagcggcatcaagatcctggtgcccaagagccccgtgaagagcagaaccgccgtggacggcttccagagcgagagccccgagaagctggaccccgtggagcagggccaggaggacaccgtggcccccgaggtggccgccgagaagcccgtgggcgccctgctgggccccggcgccgagagagccagaatgggcagcagacccagaatccaccccctggtgccccaggtgcccggccccgtgaccgccgccatggccaccggcctggccgtgaacggcaagggcaccagccccttcatggacgccctgaccgccaacggcaccaccaacatccagaccagcgtgaccggcgtgaccgccagcaagagaaagttcatcgacgacagaagagaccagcccttcgacaagagactgagattcagcgtgagacagaccgagagcgcctacagatacagagacatcgtggtgagaaagcaggacggcttcacccacatcctgctgagcaccaagagcagcgagaacaacagcctgaaccccgaggtgatgagagaggtgcagagcgccctgagcaccgccgccgccgacgacagcaagctggtgctgctgagcgccgtgggcagcgtgttctgctgcggcctggacttcatctacttcatcagaagactgaccgacgacagaaagagagagagcaccaagatggccgaggccatcagaaacttcgtgaacaccttcatccagttcaagaagcccatcatcgtggccgtgaacggccccgccatcggcctgggcgccagcatcctgcccctgtgcgacgtggtgtgggccaacgagaaggcctggttccagaccccctacaccaccttcggccagagccccgacggctgcagcaccgtgatgttccccaagatcatgggcggcgccagcgccaacgagatgctgctgagcggcagaaagctgaccgcccaggaggcctgcggcaagggcctggtgagccaggtgttctggcccggcaccttcacccaggaggtgatggtgagaatcaaggagctggccagctgcaaccccgtggtgctggaggagagcaaggccctggtgagatgcaacatgaagatggagctggagcaggccaacgagagagagtgcgaggtgctgaagaagatctggggcagcgcccagggcatggacagcatgctgaagtacctgcagagaaagatcgacgagttctag

SEQ ID NO: 76746 - DNA, 1239 bp, Artificial Sequence
  Description of Artificial Sequence: Synthetic coding sequence
atggacctggccaagagcggcatcaagatcctggtgcccaagagccccgtgaagagcagaaccgccgtggacggcttccagagcgagagccccgagaagctggaccccgtggagcagggccaggaggacaccgtggcccccgaggtggccgccgagaagcccgtgggcgccctgctgggccccggcgccgagagagccagaatgggcagcagacccagaatccaccccctggtgccccaggtgcccggccccgtgaccgccgccatggccaccggcctggccgtgaacggcaagggcaccagccccttcatggacgccctgaccgccaacggcaccaccaacatccagaccagcgtgaccggcgtgaccgccagcaagagaaagttcatcgacgacagaagagaccagcccttcgacaagagactgagattcagcgtgagacagaccgagagcgcctacagatacagagacatcgtggtgagaaagcaggacggcttcacccacatcctgctgagcaccaagagcagcgagaacaacagcctgaaccccgaggtgatgagagaggtgcagagcgccctgagcaccgccgccgccgacgacagcaagctggtgctgctgagcgccgtgggcagcgtgttctgctgcggcctggacttcatctacttcatcagaagactgaccgacgacagaaagagagagagcaccaagatggccgaggccatcagaaacttcgtgaacaccttcatccagttcaagaagcccatcatcgtggccgtgaacggccccgccatcggcctgggcgccagcatcctgcccctgtgcgacgtggtgtgggccaacgagaaggcctggttccagaccccctacaccaccttcggccagagccccgacggctgcagcaccgtgatgttccccaagatcatgggcggcgccagcgccaacgagatgctgctgagcggcagaaagctgaccgcccaggaggcctgcggcaagggcctggtgagccaggtgttctggcccggcaccttcacccaggaggtgatggtgagaatcaaggagctggccagctgcaaccccgtggtgctggaggagagcaaggccctggtgagatgcaacatgaagatggagctggagcaggccaacgagagagagtgcgaggtgctgaagaagatctggggcagcgcccagggcatggacagcatgctgaagtacctgcagagaaagatcgacgagttctag

SEQ ID NO: 76747 - DNA, 1635 bp, Artificial Sequence
  Description of Artificial Sequence: Synthetic coding sequence
atggccagcgaggagctgtacgaggtggagagaatcgtggacaagagaaagaacaagaagggcaagaccgagtacctggtgagatggaagggctacgacagcgaggacgacacctgggagcccgagcagcacctggtgaactgcgaggagtacatccacgacttcaacagaagacacaccgagaagcagaaggagagcaccctgaccagaaccaacagaaccagccccaacaacgccagaaagcagatcagcagaagcaccaacagcaacttcagcaagaccagccccaaggccctggtgatcggcaaggaccacgagagcaagaacagccagctgttcgccgccagccagaagttcagaaagaacaccgcccccagcctgagcagcagaaagaacatggacctggccaagagcggcatcaagatcctggtgcccaagagccccgtgaagagcagaaccgccgtggacggcttccagagcgagagccccgagaagctggaccccgtggagcagggccaggaggacaccgtggcccccgaggtggccgccgagaagcccgtgggcgccctgctgggccccggcgccgagagagccagaatgggcagcagacccagaatccaccccctggtgccccaggtgcccggccccgtgaccgccgccatggccaccggcctggccgtgaacggcaagggcaccagccccttcatggacgccctgaccgccaacggcaccaccaacatccagaccagcgtgaccggcgtgaccgccagcaagagaaagttcatcgacgacagaagagaccagcccttcgacaagagactgagattcagcgtgagacagaccgagagcgcctacagatacagagacatcgtggtgagaaagcaggacggcttcacccacatcctgctgagcaccaagagcagcgagaacaacagcctgaaccccgaggtgatgagagaggtgcagagcgccctgagcaccgccgccgccgacgacagcaagctggtgctgctgagcgccgtgggcagcgtgttctgctgcggcctggacttcatctacttcatcagaagactgaccgacgacagaaagagagagagcaccaagatggccgaggccatcagaaacttcgtgaacaccttcatccagttcaagaagcccatcatcgtggccgtgaacggccccgccatcggcctgggcgccagcatcctgcccctgtgcgacgtggtgtgggccaacgagaaggcctggttccagaccccctacaccaccttcggccagagccccgacggctgcagcaccgtgatgttccccaagatcatgggcggcgccagcgccaacgagatgctgctgagcggcagaaagctgaccgcccaggaggcctgcggcaagggcctggtgagccaggtgttctggcccggcaccttcacccaggaggtgatggtgagaatcaaggagctggccagctgcaaccccgtggtgctggaggagagcaaggccctggtgagatgcaacatgaagatggagctggagcaggccaacgagagagagtgcgaggtgctgaagaagatctggggcagcgcccagggcatggacagcatgctgaagtacctgcagagaaagatcgacgagttctag

SEQ ID NO: 76748 - DNA, 1239 bp, Artificial Sequence; identical to SEQ ID NO: 76746
  Description of Artificial Sequence: Synthetic coding sequence

SEQ ID NO: 76749 - DNA, 1665 bp, Artificial Sequence
  Description of Artificial Sequence: Synthetic coding sequence
atggccagccaggagttcgaggtggaggccatcgtggacaagagacaggacaagaacggcaacacccagtacctggtgagatggaagggctacgacaagcaggacgacacctgggagcccgagcagcacctgatgaactgcgagaagtgcgtgcacgacttcaacagaagacagaccgagaagcagaagaagctgacctggaccaccaccagcagaatcttcagcaacaacgccagaagaagaaccagcagaagcaccaaggccaactacagcaagaacagccccaagacccccgtgaccgacaagcaccacagaagcaagaacagaaagctgttcgccgccagcaagaacgtgagaagaaaggccgccagcatcctgagcgacaccaagaacatggagatcatcaacagcaccatcgagaccctggcccccgacagccccttcgaccacaagaccgtgagcggcttccagaagctggagaagctggaccccatcgccgccgaccagcaggacaccgtggtgttcaaggtgaccgagggcaagctgctgagagaccccctgagcagacccggcgccgagcagaccggcatccagaacaagacccagatccaccccctgatgagccagatgagcggcagcgtgaccgccagcatggccaccggcagcgccaccagaaagggcatcgtggtgctgatcgaccccctggccgccaacggcaccaccgacatgcacaccagcgtgcccagagtgaagggcggccagagaaacatcaccgacgacagcagagaccagcccttcatcaagaagatgcacttcaccatcagactgaccgagagcgccagcacctacagagacatcgtggtgaagaaggaggacggcttcacccagatcgtgctgagcaccagaagcaccgagaagaacgccctgaacaccgaggtgatcaaggagatcgtgaacgccctgaacagcgccgccgccgacgacagcaagctggtgctgttcagcgccgccggcagcgtgttctgctgcggcctggacttcggctacttcgtgaagcacctgagaaacaacagaaacaccgccagcctggagatggtggacaccatcaagaacttcgtgaacaccttcatccagttcaagaagcccatcgtggtgagcgtgaacggccccgccatcggcctgggcgccagcatcctgcccctgtgcgacctggtgtgggccaacgagaaggcctggttccagaccccctacaccaccttcggccagagccccgacggctgcagcagcatcaccttccccaagatgatgggcaaggccagcgccaacgagatgctgatcgccggcagaaagctgaccgccagagaggcctgcgccaagggcctggtgagccaggtgttcctgaccggcaccttcacccaggaggtgatgatccagatcaaggagctggccagctacaaccccatcgtgctggaggagtgcaaggccctggtgagatgcaacatcaagctggagctggagcaggccaacgagagagagtgcgaggtgctgagaaagatctggagcagcgcccagggcatcgagagcatgctgaagatccccctgctgggctacaaggccgccttcccccccagaaagacccagaacgaccagagatggtgcccctag

SEQ ID NO: 76750 - DNA, 1623 bp, Artificial Sequence
  Description of Artificial Sequence: Synthetic coding sequence
atggccagccaggagttcgaggtggaggccatcgtggacaagagacaggacaagaacggcaacacccagtacctggtgagatggaagggctacgacaagcaggacgacacctgggagcccgagcagcacctgatgaactgcgagaagtgcgtgcacgacttcaacagaagacagaccgagaagcagaagaagctgacctggaccaccaccagcagaatcttcagcaacaacgccagaagaagaaccagcagaagcaccaaggccaactacagcaagaacagccccaagacccccgtgaccgacaagcaccacagaagcaagaacagaaagctgttcgccgccagcaagaacgtgagaagaaaggccgccagcatcctgagcgacaccaagaacatggagatcatcaacagcaccatcgagaccctggcccccgacagccccttcgaccacaagaccgtgagcggcttccagaagctggagaagctggaccccatcgccgccgaccagcaggacaccgtggtgttcaaggtgaccgagggcaagctgctgagagaccccctgagcagacccggcgccgagcagaccggcatccagaacaagacccagatccaccccctgatgagccagatgagcggcagcgtgaccgccagcatggccaccggcagcgccaccagaaagggcatcgtggtgctgatcgaccccctggccgccaacggcaccaccgacatgcacaccagcgtgcccagagtgaagggcggccagagaaacatcaccgacgacagcagagaccagcccttcatcaagaagatgcacttcaccatcagactgaccgagagcgccagcacctacagagacatcgtggtgaagaaggaggacggcttcacccagatcgtgctgagcaccagaagcaccgagaagaacgccctgaacaccgaggtgatcaaggagatcgtgaacgccctgaacagcgccgccgccgacgacagcaagctggtgctgttcagcgccgccggcagcgtgttctgctgcggcctggacttcggctacttcgtgaagcacctgagaaacaacagaaacaccgccagcctggagatggtggacaccatcaagaacttcgtgaacaccttcatccagttcaagaagcccatcgtggtgagcgtgaacggccccgccatcggcctgggcgccagcatcctgcccctgtgcgacctggtgtgggccaacgagaaggcctggttccagaccccctacaccaccttcggccagagccccgacggctgcagcagcatcaccttccccaagatgatgggcaaggccagcgccaacgagatgctgatcgccggcagaaagctgaccgccagagaggcctgcgccaagggcctggtgagccaggtgttcctgaccggcaccttcacccaggaggtgatgatccagatcaaggagctggccagctacaaccccatcgtgctggaggagtgcaaggccctggtgagatgcaacatcaagctggagctggagcaggccaacgagagagagtgcgaggtgctgagaaagatctggagcagcgcccagggcatcgagagcatgctgaagtacgtggagaacaagatcgacgagttctag

SEQ ID NO: 76751 - DNA, 1170 bp, Artificial Sequence
  Description of Artificial Sequence: Synthetic coding sequence
atgggcaagatggccgccgccgtgggcagcgtggccaccctggccaccgagcccggcgaggacgccttcagaaagctgttcagattctacagacagagcagacccggcaccgccgacctggagggcgtgatcgacttcagcgccgcccacgccgccagaggcaagggccccggcgcccagaaggtgatcaagagccagctgaacgtgagcagcgtgagcgagcagaacgcctacagagccggcctgcagcccgtgagcaagtggcaggcctacggcctgaagggctaccccggcttcatcttcatccccaaccccttcctgcccggctaccagtggcactgggtgaagcagtgcctgaagctgtacagccagaagcccaacgtgtgcaacctggacaagcacatgagcaaggaggagacccaggacctgtgggagcagagcaaggagttcctgagatacaaggaggccaccaagagaagacccagaagcctgctggagaagctgagatgggtgaccgtgggctaccactacaactgggacagcaagaagtacagcgccgaccactacacccccttccccagcgacctgggcttcctgagcgagcaggtggccgccgcctgcggcttcgaggacttcagagccgaggccggcatcctgaactactacagactggacagcaccctgggcatccacgtggacagaagcgagctggaccacagcaagcccctgctgagcttcagcttcggccagagcgccatcttcctgctgggcggcctgcagagagacgaggcccccaccgccatgttcatgcacagcggcgacatcatgatcatgagcggcttcagcagactgctgaaccacgccgtgcccagagtgctgcccaaccccgagggcgagggcctgccccactgcctggaggcccccctgcccgccgtgctgcccagagacagcatggtggagccctgcagcatggaggactggcaggtgtgcgccagctacctgaagaccgccagagtgaacatgaccgtgagacaggtgctggccaccgaccagaacttccccctggagcccatcgaggacgagaagagagacatcagcaccgagggcttctgccacctggacgaccagaacagcgaggtgaagagagccagaatcaaccccgacagctag

SEQ ID NO: 76752 - DNA, 921 bp, Artificial Sequence
  Description of Artificial Sequence: Synthetic coding sequence
atgagaagcgccgccgtgctggccctgctgctgtgcgccggccaggtgaccgccctgcccgtgaacagccccatgaacaagggcgacaccgaggtgatgaagtgcatcgtggaggtgatcagcgacaccctgagcaagcccagccccatgcccgtgagccaggagtgcttcgagaccctgagaggcgacgagagaatcctgagcatcctgagacaccagaacctgctgaaggagctgcaggacctggccctgcagggcgccaaggagagagcccaccagcagaagaagcacagcggcttcgaggacgagctgagcgaggtgctggagaaccagagcagccaggccgagctgaagggcagaagcgaggccctggccgtggacggcgccggcaagcccggcgccgaggaggcccaggaccccgagggcaagggcgagcaggagcacagccagcagaaggaggaggaggaggagatggccgtggtgccccagggcctgttcagaggcggcaagagcggcgagctggagcaggaggaggagagactgagcaaggagtgggaggacagcaagagatggagcaagatggaccagctggccaaggagctgaccgccgagaagagactggagggccaggaggaggaggaggacaacagagacagcagcatgaagctgagcttcagagccagagcctacggcttcagaggccccggcccccagctgagaagaggctggagacccagcagcagagaggacagcctggaggccggcctgcccctgcaggtgagaggctaccccgaggagaagaaggaggaggagggcagcgccaacagaagacccgaggaccaggagctggagagcctgagcgccatcgaggccgagctggagaaggtggcccaccagctgcaggccctgagaagaggctag

SEQ ID NO: 76753 - DNA, 2034 bp, Artificial Sequence
  Description of Artificial Sequence: Synthetic coding sequence
atgcagcccaccctgctgctgagcctgctgggcgccgtgggcctggccgccgtgaacagcatgcccgtggacaacagaaaccacaacgagggcatggtgaccagatgcatcatcgaggtgctgagcaacgccctgagcaagagcagcgccccccccatcacccccgagtgcagacaggtgctgaagaccagcagaaaggacgtgaaggacaaggagaccaccgagaacgagaacaccaagttcgaggtgagactgctgagagaccccgccgacgccagcgaggcccacgagagcagcagcagaggcgaggccggcgcccccggcgaggaggacatccagggccccaccaaggccgacaccgagaagtgggccgagggcggcggccacagcagagagagagccgacgagccccagtggagcctgtaccccagcgacagccaggtgagcgaggaggtgaagaccagacacagcgagaagagccagagagaggacgaggaggaggaggagggcgagaactaccagaagggcgagagaggcgaggacagcagcgaggagaagcacctggaggagcccggcgagacccagaacgccttcctgaacgagagaaagcaggccagcgccatcaagaaggaggagctggtggccagaagcgagacccacgccgccggccacagccaggagaagacccacagcagagagaagagcagccaggagagcggcgaggagaccggcagccaggagaaccacccccaggagagcaagggccagcccagaagccaggaggagagcgaggagggcgaggaggacgccaccagcgaggtggacaagagaagaaccagacccagacaccaccacggcagaagcagacccgacagaagcagccagggcggcagcctgcccagcgaggagaagggccacccccaggaggagagcgaggagagcaacgtgagcatggccagcctgggcgagaagagagaccaccacagcacccactacagagccagcgaggaggagcccgagtacggcgaggagatcaagggctaccccggcgtgcaggcccccgaggacctggagtgggagagatacagaggcagaggcagcgaggagtacagagcccccagaccccagagcgaggagagctgggacgaggaggacaagagaaactaccccagcctggagctggacaagatggcccacggctacggcgaggagagcgaggaggagagaggcctggagcccggcaagggcagacaccacagaggcagaggcggcgagcccagagcctacttcatgagcgacaccagagaggagaagagattcctgggcgagggccaccacagagtgcaggagaaccagatggacaaggccagaagacacccccagggcgcctggaaggagctggacagaaactacctgaactacggcgaggagggcgcccccggcaagtggcagcagcagggcgacctgcaggacaccaaggagaacagagaggaggccagattccaggacaagcagtacagcagccaccacaccgccgagaagagaaagagactgggcgagctgttcaacccctactacgaccccctgcagtggaagagcagccacttcgagagaagagacaacatgaacgacaacttcctggagggcgaggaggagaacgagctgaccctgaacgagaagaacttcttccccgagtacaactacgactggtgggagaagaagcccttcagcgaggacgtgaactggggctacgagaagagaaacctggccagagtgcccaagctggacctgaagagacagtacgacagagtggcccagctggaccagctgctgcactacagaaagaagagcgccgagttccccgacttctacgacagcgaggagcccgtgagcacccaccaggaggccgagaacgagaaggacagagccgaccagaccgtgctgaccgaggacgagaagaaggagctggagaacctggccgccatggacctggagctgcagaagatcgccgagaagttcagccagagaggctag

SEQ ID NO: 76754 - DNA, 870 bp, Artificial Sequence
  Description of Artificial Sequence: Synthetic coding sequence
atgcccgtggacaacagaaaccacaacgagggcatggtgaccagatgcatcatcgaggtgctgagcaacgccctgagcaagagcagcgccccccccatcacccccgagtgcagacaggtgctgaagaccagcagaaaggacgtgaaggacaaggagaccaccgagaacgagaacaccaagttcgaggtgagactgctgagagaccccgccgacgccagcgaggcccacgagagcagcagcagaggcgaggccggcgcccccggcgaggaggacatccagggccccaccaaggccgacaccgagaagtgggccgagggcggcggccacagcagagagagagccgacgagccccagtggagcctgtaccccagcgacagccaggtgagcgaggaggtgaagaccagacacagcgagaagagccagagagaggacgaggaggaggaggagggcgagaactaccagaagggcgagagaggcgaggacagcagcgaggagaagcacctggaggagcccggcgagacccagaacgccttcctgaacgagagaaagcaggccagcgccatcaagaaggaggagctggtggccagaagcgagacccacgccgccggccacagccaggagaagacccacagcagagagaagagcagccaggagagcggcgaggagaccggcagccaggagaaccacccccaggagagcaagggccagcccagaagccaggaggagagcgaggagggcgaggaggacgccaccagcgaggtggacaagagaagaaccagacccagacaccaccacggcagaagcagacccgacagaagcagccagggcggcagcctgcccagcgaggagaagggccacccccaggagtag

SEQ ID NO: 76755 - DNA, 1806 bp, Artificial Sequence
  Description of Artificial Sequence: Synthetic coding sequence
atgcccgagagagagctgtggcccgccggcaccggcagcgagcccgtgaccagagtgggcagctgcgacagcatgatgagcagcaccagcaccagaagcggcagcagcgacagcagctacgacttcctgagcaccgaggagaaggagtgcctgctgttcctggaggagaccatcggcagcctggacaccgaggccgacagcggcctgagcaccgacgagagcgagcccgccaccacccccagaggcttcagagccctgcccatcacccagcccacccccagaggcggccccgaggagaccatcacccagcagggcagaacccccagaaccgtgaccgagagcagcagcagccacccccccgagccccagggcctgggcctgagaagcggcagctacagcctgcccagaaacatccacatcgccagaagccagaacttcagaaagagcaccacccaggccagcagccacaaccccggcgagcccggcagactggcccccgagcccgagaaggagcaggtgagccagagcagccagcccagacaggcccccgccagcccccaggaggccgccctggacctggacgtggtgctgatccccccccccgaggccttcagagacacccagcccgagcagtgcagagaggccagcctgcccgagggccccggccagcagggccacaccccccagctgcacacccccagcagcagccaggagagagagcagacccccagcgaggccatgagccagaaggccaaggagaccgtgagcaccagatacacccagccccagcccccccccgccggcctgccccagaacgccagagccgaggacgcccccctgagcagcggcgaggaccccaacagcagactggcccccctgaccacccccaagcccagaaagctgccccccaacatcgtgctgaagagcagcagaagcagcttccacagcgacccccagcactggctgagcagacacaccgaggccgcccccggcgacagcggcctgatcagctgcagcctgcaggagcagagaaaggccagaaaggaggccctggagaagctgggcctgccccaggaccaggacgagcccggcctgcacctgagcaagcccaccagcagcatcagacccaaggagaccagagcccagcacctgagccccgcccccggcctggcccagcccgccgcccccgcccaggccagcgccgccatccccgccgccggcaaggccctggcccaggcccccgcccccgcccccggccccgcccagggccccctgcccatgaagagccccgcccccggcaacgtggccgccagcaagagcatgcccatcagcatccccaaggcccccagagccaacagcgccctgaccccccccaagcccgagagcggcctgaccctgcaggagagcaacacccccggcctgagacagatgaacttcaagagcaacaccctggagagaagcggcgtgggcctgagcagctacctgagcaccgagaaggacgccagccccaagaccagcaccagcctgggcaagggcagcttcctggacaagatcagccccagcgtgctgagaaacagcagacccagacccgccagcctgggcaccggcaaggacttcgccggcatccaggtgggcaagctggccgacctggagcaggagcagagcagcaagagactgagctaccagggccagagcagagacaagctgcccagacccccctgcgtgagcgtgaagatcagccccaagggcgtgcccaacgagcacagaagagaggccctgaagaagctgggcctgctgaaggagtag

SEQ ID NO: 76756 - DNA, 1068 bp, Artificial Sequence
  Description of Artificial Sequence: Synthetic coding sequence
atgagccagaaggccaaggagaccgtgagcaccagatacacccagccccagcccccccccgccggcctgccccagaacgccagagccgaggacgcccccctgagcagcggcgaggaccccaacagcagactggcccccctgaccacccccaagcccagaaagctgccccccaacatcgtgctgaagagcagcagaagcagcttccacagcgacccccagcactggctgagcagacacaccgaggccgcccccggcgacagcggcctgatcagctgcagcctgcaggagcagagaaaggccagaaaggaggccctggagaagctgggcctgccccaggaccaggacgagcccggcctgcacctgagcaagcccaccagcagcatcagacccaaggagaccagagcccagcacctgagccccgcccccggcctggcccagcccgccgcccccgcccaggccagcgccgccatccccgccgccggcaaggccctggcccaggcccccgcccccgcccccggccccgcccagggccccctgcccatgaagagccccgcccccggcaacgtggccgccagcaagagcatgcccatcagcatccccaaggcccccagagccaacagcgccctgaccccccccaagcccgagagcggcctgaccctgcaggagagcaacacccccggcctgagacagatgaacttcaagagcaacaccctggagagaagcggcgtgggcctgagcagctacctgagcaccgagaaggacgccagccccaagaccagcaccagcctgggcaagggcagcttcctggacaagatcagccccagcgtgctgagaaacagcagacccagacccgccagcctgggcaccggcaaggacttcgccggcatccaggtgggcaagctggccgacctggagcaggagcagagcagcaagagactgagctaccagggccagagcagagacaagctgcccagacccccctgcgtgagcgtgaagatcagccccaagggcgtgcccaacgagcacagaagagaggccctgaagaagctgggcctgctgaaggagtag

SEQ ID NO: 76757 - DNA, 1050 bp, Artificial Sequence
  Description of Artificial Sequence: Synthetic coding sequence
atggccggccccgccatccacaccgcccccatgctgttcctggtgctgctgctgcccctggagctgagcctggccggcgccctggcccccggcacccccgccagaaacctgcccgagaaccacatcgacctgcccggccccgccctgtggaccccccaggccagccaccacagaagaagaggccccggcaagaaggagtggggccccggcctgcccagccaggcccaggacggcgccgtggtgaccgccaccagacaggccagcagactgcccgaggccgagggcctgctgcccgagcagagccccgccggcctgctgcaggacaaggacctgctgctgggcctggccctgccctaccccgagaaggagaacagaccccccggctgggagagaaccagaaagagaagcagagagcacaagagaagaagagacagactgagactgcaccagggcagagccctggtgagaggccccagcagcctgatgaagaaggccgagctgagcgaggcccaggtgctggacgccgccatggaggagagcagcaccagcctggcccccaccatgttcttcctgaccaccttcgaggccgcccccgccaccgaggagagcctgatcctgcccgtgaccagcctgagaccccagcaggcccagcccagaagcgacggcgaggtgatgcccaccctggacatggccctgttcgactggaccgactacgaggacctgaagcccgacggctggcccagcgccaagaagaaggagaagcacagaggcaagctgagcagcgacggcaacgagaccagccccgccgagggcgagccctgcgaccaccaccaggactgcctgcccggcacctgctgcgacctgagagagcacctgtgcaccccccacaacagaggcctgaacaacaagtgcttcgacgactgcatgtgcgtggagggcctgagatgctacgccaagttccacagaaacagaagagtgaccagaagaaagggcagatgcgtggagcccgagaccgccaacggcgaccagggcagcttcatcaacgtgtag

SEQ ID NO: 76758 - DNA, 477 bp, Artificial Sequence
  Description of Artificial Sequence: Synthetic coding sequence
atgtgcttcagcagagccgacgccgccgacaactaccccttcggcacctgccagcagagaaagctgttcccccacttccacccccccaacctgatcggcaacaagttcgtgcccctgagaggcagcccccacagaggccccggctgctacttcagcgacgagatgaccccccacgccggcagataccagaaggtgagcccccagcaggagaagcacaagcagaacttcgcccccttcaacgtgctggtgcccagattcaagaactaccccaaggacacctactaccccagccccggcgcctacaaccccgagaagaagcccccccccaagatcgcctggcccatgaagttcggcagccccgactgggcccaggtgccctgcctgcagaagagaaccctgaaggccgagctgagcaccgacaaggacttcagaaagcacagaaacagagtggcctacctgagcctgtactacaactag

SEQ ID NO: 76759 - DNA, 576 bp, Artificial Sequence
  Description of Artificial Sequence: Synthetic coding sequence
atgtgcttcagcagagccgacgccgccgacaactaccccttcggcacctgccagcagagaaagctgttcccccacttccacccccccaacctgatcggcaacaagttcgtgcccctgagaggcagcccccacagaggccccggctgctacttcagcgacggctacggcctggcctacgacctgagcaagatccccaccagcatcaagggctacaccctgggcgccagaaccgccgtgagattcaagcccatccagaaggagatgaccccccacgccggcagataccagaaggtgagcccccagcaggagaagcacaagcagaacttcgcccccttcaacgtgctggtgcccagattcaagaactaccccaaggacacctactaccccagccccggcgcctacaaccccgagaagaagcccccccccaagatcgcctggcccatgaagttcggcagccccgactgggcccaggtgccctgcctgcagaagagaaccctgaaggccgagctgagcaccgacaaggacttcagaaagcacagaaacagagtggcctacctgagcctgtactacaactag

SEQ ID NO: 76760 - DNA, 2055 bp, Artificial Sequence
  Description of Artificial Sequence: Synthetic coding sequence
atgtgggtgctgctgagaagcggctaccccctgagaatcctgctgcccctgagaggcgagtggatgggcagaagaggcctgcccagaaacctggcccccggcccccccagaagaagatacagaaaggagaccctgcaggccctggacatgcccgtgctgcccgtgaccgccaccgagatcagacagtacctgagaggccacggcatccccttccaggacggccacagctgcctgagagccctgagccccttcgccgagagcagccagctgaagggccagaccggcgtgaccaccagcttcagcctgttcatcgacaagaccaccggccacttcctgtgcatgaccagcctggccgagggcagctgggaggacttccaggccagcgtggagggcagaggcgacggcgccagagagggcttcctgctgagcaaggcccccgagttcgaggacagcgaggaggtgagaagaatctggaacagagccatccccctgtgggagctgcccgaccaggaggaggtgcagctggccgacaccatgttcggcctgaccaaggtgaccgacgacaccctgaagagattcagcgtgagatacctgagacccgccagaagcctggtgttcccctggttcagccccggcggcagcggcctgagaggcctgaagctgctggaggccaagtgccagggcgacggcgtgagctacgaggagaccaccatccccagacccagcgcctaccacaacctgttcggcctgcccctgatcagcagaagagacgccgaggtggtgctgaccagcagagagctggacagcctggccctgaaccagagcaccggcctgcccaccctgaccctgcccagaggcaccacctgcctgccccccgccctgctgccctacctggagcagttcagaagaatcgtgttctggctgggcgacgacctgagaagctgggaggccgccaagctgttcgccagaaagctgaaccccaagagatgcttcctggtgagacccggcgaccagcagcccagacccctggaggccctgaacggcggcttcaacctgagcagaatcctgagaaccgccctgcccgcctggcacaagagcatcgtgagcttcagacagctgagagaggaggtgctgggcgagctgagcaacgtggagcaggccgccggcctgagatggagcagattccccgacctgaacagaatcctgaagggccacagaaagggcgagctgaccgtgttcaccggccccaccggcagcggcaagaccaccttcatcagcgagtacgccctggacctgtgcagccagggcgtgaacaccctgtggggcagcttcgagatcagcaacgtgagactggccagagtgatgctgacccagttcgccgagggcagactggaggaccagctggacaagtacgaccactgggccgacagattcgaggacctgcccctgtacttcatgaccttccacggccagcagagcatcagaaccgtgatcgacaccatgcagcacgccgtgtacgtgtacgacatctgccacgtgatcatcgacaacctgcagttcatgatgggccacgagcagctgagcaccgacagaatcgccgcccaggactacatcatcggcgtgttcagaaagttcgccaccgacaacaactgccacgtgaccctggtgatccaccccagaaaggaggacgacgacaaggagctgcagaccgccagcatcttcggcagcgccaaggccagccaggaggccgacaacgtgctgatcctgcaggacagaaagctggtgaccggccccggcaagagatacctgcaggtgagcaagaacagattcgacggcgacgtgggcgtgttccccctggagttcaacaagaacagcctgaccttcagcatcccccccaagaacaaggccagactgaagaagatcaaggacgacaccggccccgtggccaagaagcccagcagcggcaagaagggcgccaccacccagaacagcgagatctgcagcggccaggcccccacccccgaccagcccgacaccagcaagagaagcaagtag

SEQ ID NO: 76761 - DNA, 1749 bp, Artificial Sequence
  Description of Artificial Sequence: Synthetic coding sequence
atgtgggtgctgctgagaagcggctaccccctgagaatcctgctgcccctgagaggcgagtggatgggcagaagaggcctgcccagaaacctggcccccggcccccccagaagaagatacagaaaggagaccctgcaggccctggacatgcccgtgctgcccgtgaccgccaccgagatcagacagtacctgagaggccacggcatccccttccaggacggccacagctgcctgagagccctgagccccttcgccgagagcagccagctgaagggccagaccggcgtgaccaccagcttcagcctgttcatcgacaagaccaccggccacttcctgtgcatgaccagcctggccgagggcagctgggaggacttccaggccagcgtggagggcagaggcgacggcgccagagagggcttcctgctgagcaaggcccccgagttcgaggacagcgaggaggtgagaagaatctggaacagagccatccccctgtgggagctgcccgaccaggaggaggtgcagctggccgacaccatgttcggcctgaccaaggtgaccgacgacaccctgaagagattcagcgtgagatacctgagacccgccagaagcctggtgttcccctggttcagccccggcggcagcggcctgagaggcctgaagctgctggaggccaagtgccagggcgacggcgtgagctacgaggagaccaccatccccagacccagcgcctaccacaacctgttcggcctgcccctgatcagcagaagagacgccgaggtggtgctgaccagcagagagctggacagcctggccctgaaccagagcaccggcctgcccaccctgaccctgcccagaggcaccacctgcctgccccccgccctgctgccctacctggagcagttcagaagaatcgtgttctggctgggcgacgacctgagaagctgggaggccgccaagctgttcgccagaaagctgaaccccaagagatgcttcctggtgagacccggcgaccagcagcccagacccctggaggccctgaacggcggcttcaacctgagcagaatcctgagaaccgccctgcccgcctggcacaagagcatcgtgagcttcagacagctgagagaggaggtgctgggcgagctgagcaacgtggagcaggccgccggcctgagatggagcagattccccgacctgaacagaatcctgaagggccacagaaagggcgagctgaccgtgttcaccggccccaccggcagcggcaagaccaccttcatcagcgagtacgccctggacctgtgcagccagggcgtgaacaccctgtggggcagcttcgagatcagcaacgtgagactggccagagtgatgctgacccagttcgccgagggcagactggaggaccagctggacaagtacgaccactgggccgacagattcgaggacctgcccctgtacttcatgaccttccacggccagcagagcatcagaaccgtgatcgacaccatgcagcacgccgtgtacgtgtacgacatctgccacgtgatcatcgacaacctgcagttcatgatgggccacgagcagctgagcaccgacagaatcgccgcccaggactacatcatcggcgtgttcagaaagttcgccaccgacaacaactgccacgtgaccctggtgatccaccccagaaaggaggacgacgacaaggagctgcagaccgccagcatcttcggcagcgccaaggtgagcggcctgtag

SEQ ID NO: 76762 - DNA, 1029 bp, Artificial Sequence
  Description of Artificial Sequence: Synthetic coding sequence
atgcccttcctgctgggcctgagacaggacaaggaggcctgcgtgggcaccaacaaccagagctacatctgcgacaccggccactgctgcggccagagccagtgctgcaactactactacgagctgtggtggttctggctggtgtggaccatcatcatcatcctgagctgctgctgcgtgtgccaccacagaagagccaagcacagactgcaggcccagcagagacagcacgagatcaacctgatcgcctacagagaggcccacaactacagcgccctgcccttctacttcagattcctgcccaactacctgctgcccccctacgaggaggtggtgaacagaccccccacccccccccccccctacagcgccttccagctgcagcagcagcagctgctgcccccccagtgcggccccgccggcggcagcccccccggcatcgaccccaccagaggcagccagggcgcccagagcagccccctgagcgagcccagcagaagcagcaccagaccccccagcatcgccgaccccgaccccagcgacctgcccgtggacagagccgccaccaaggcccccggcatggagcccagcggcagcgtggccggcctgggcgagctggaccccggcgccttcctggacaaggacgccgagtgcagagaggagctgctgaaggacgacagcagcgagcacggcgcccccgacagcaaggagaagacccccggcagacacagaagattcaccggcgacagcggcatcgaggtgtgcgtgtgcaacagaggccaccacgacgacgacctgaaggagttcaacaccctgatcgacgacgccctggacggccccctggacttctgcgacagctgccacgtgagaccccccggcgacgaggaggagggcctgtgccagagcagcgaggagcaggccagagagcccggccacccccacctgcccagaccccccgcctgcctgctgctgaacaccatcaacgagcaggacagccccaacagccagagcagcagcagccccagctag

SEQ ID NO: 76763 - DNA, 1092 bp, Artificial Sequence
  Description of Artificial Sequence: Synthetic coding sequence
atggagagaagaagactgctgggcggcatggccctgctgctgctgcaggccctgcccagccccctgagcgccagagccgagcccccccaggacaaggaggcctgcgtgggcaccaacaaccagagctacatctgcgacaccggccactgctgcggccagagccagtgctgcaactactactacgagctgtggtggttctggctggtgtggaccatcatcatcatcctgagctgctgctgcgtgtgccaccacagaagagccaagcacagactgcaggcccagcagagacagcacgagatcaacctgatcgcctacagagaggcccacaactacagcgccctgcccttctacttcagattcctgcccaactacctgctgcccccctacgaggaggtggtgaacagaccccccacccccccccccccctacagcgccttccagctgcagcagcagcagctgctgcccccccagtgcggccccgccggcggcagcccccccggcatcgaccccaccagaggcagccagggcgcccagagcagccccctgagcgagcccagcagaagcagcaccagaccccccagcatcgccgaccccgaccccagcgacctgcccgtggacagagccgccaccaaggcccccggcatggagcccagcggcagcgtggccggcctgggcgagctggaccccggcgccttcctggacaaggacgccgagtgcagagaggagctgctgaaggacgacagcagcgagcacggcgcccccgacagcaaggagaagacccccggcagacacagaagattcaccggcgacagcggcatcgaggtgtgcgtgtgcaacagaggccaccacgacgacgacctgaaggagttcaacaccctgatcgacgacgccctggacggccccctggacttctgcgacagctgccacgtgagaccccccggcgacgaggaggagggcctgtgccagagcagcgaggagcaggccagagagcccggccacccccacctgcccagaccccccgcctgcctgctgctgaacaccatcaacgagcaggacagccccaacagccagagcagcagcagccccagctag

SEQ ID NO: 76764 - DNA, 1056 bp, Artificial Sequence
  Description of Artificial Sequence: Synthetic coding sequence
atggccaccgacgtgcagctggccgactaccccctgatgagccccaaggccgagctgaagctggagaagaagagcggcagaaagcccagaagccccagagacagcggcccccagaaggagctggtgatccccggcatcgtggacttcgagagaatcagaagagccctgagaacccccaagccccagacccccggcacctactgcttcggcagactgagccaccacagcttcttcagcagacaccacccccacccccagcacgtgacccacatccaggacctgaccggcaagcccgtgtgcgtggtgagagacttccccgcccccctgcccgagagcaccgtgttcagcggctgccagatgggcatccccaccatcagcgtgcccatcggcgacccccagagcaacagaaacccccagctgagcagcgaggcctggaagaaggagctgaaggagctggccagcagagtggccttcctgaccaaggaggacgagctgaagaagaaggagaaggagcagaaggaggagcccctgagagagcagggcgccaagtacagcgccgagaccggcagactgatccccgccagcaccagagccgtgggcagaagaagaagccaccagggccagcagagccagagcagcagcagacacgagggcgtgcaggccttcctgctgcaggaccaggagctgctggtgctggagctgctgtgcagaatcctggagaccgacctgctgagcgccatccagttctggctgctgtacgccccccccaaggagaaggacctggccctgggcctgctgcagaccgccgtggcccagctgctgccccagcccctggtgagcatccccaccgagaagctgctgagccagctgcccgaggtgcacgagcccccccaggagaagcaggagcccccctgcagccagagccccaagaagaccaagatcagccccttcaccaagagcgagaagcccgagtacatcggcgaggcccaggtgctgcagatgcacagcagccagaacaccgagaagaagaccagcaagcccagagccgagagctag

SEQ ID NO: 76765 - DNA, 321 bp, Artificial Sequence
  Description of Artificial Sequence: Synthetic coding sequence
cagtgcgccgagctgtggggcagcgtgagaaagaacagcgacaagttcctgctgagcagaaacctgcaccccagcaaggaggagtacagacagcagatcaagacccccggcgaggagtggagacagatcctggtgcactggagaagcagcagcccccccgacgccttcaagcccgagcacagagaggaggacatcgaggccgagggcagagagctgagaggccccaacacctgcacctgcctggcccaggagcagccccagggcttcagaggcgtgagcgtgagcaccaccttcaccgccgtgcccgacagcctgccctag

SEQ ID NO: 76766 - DNA, 753 bp, Artificial Sequence
  Description of Artificial Sequence: Synthetic coding sequence
atggccaccgacgtgcagctggccgactaccccctgatgagccccaaggccgagctgaagctggagaagaagagcggcagaaagcccagaagccccagagacagcggcccccagaaggagctggtgatccccggcatcgtggacttcgagagaatcagaagagccctgagaacccccaagccccagacccccggcacctactgcttcggcagactgagccaccacagcttcttcagcagacaccacccccacccccagcacgtgacccacatccaggacctgaccggcaagcccgtgtgcgtggtgagagacttccccgcccccctgcccgagagcaccgtgttcagcggctgccagatgggcatccccaccatcagcgtgcccatcggcgacccccagagcaacagaaacccccagctgagcagcgaggcctggaagaaggagctgaaggagctggccagcagagtggccttcctgaccaaggaggacgagctgaagaagaaggagaaggagcagaaggaggagcccctgagagagcagggcgccaagtacagcgccgagaccggcagactgatccccgccagcaccagagccgtgggcagaagaagaagccaccagggccagcagagccagagcagcagcagacacgagggcgtgcaggccttcctgctgcaggaccaggagctgctgaagaagaccagcctgtgggacagctgcagacagcagtggctgagcagcttccccagcccctag

SEQ ID NO: 76767 - DNA, 951 bp, Artificial Sequence
  Description of Artificial Sequence: Synthetic coding sequence
agccccaaggccgagctgaagctggagaagaagagcggcagaaagcccagaagccccagagacagcggcccccagaaggagctggtgatccccggcatcgtggacttcgagagaatcagaagagccctgagaacccccaagccccagacccccggcacctactgcttcggcagactgagccaccacagcttcttcagcagacaccacccccacccccagcacgtgacccacatccaggacctgaccggcaagcccgtgtgcgtggtgagagacttccccgcccccctgcccgagagcaccgtgttcagcggctgccagatgggcatccccaccatcagcgtgcccatcggcgacccccagagcaacagaaacccccagctgagcagcgcctggaagaaggagctgaaggagctggccagcagagtggccttcctgaccaaggaggacgagctgaagaagaaggaggacaccaccagcctgaactggaactgcaagagcagaagaccccaggcccccggcctgagcggcaccgacctgggcgccgccgagctgggcatcaagaaggagcagaaggaggagcccctgagagagcagggcgccaagtacagcgccgagaccggcagactgatccccgccagcaccagagccgtgggcagaagaagaagccaccagggccagcagagccagagcagcagcagacacgagggcgtgcaggccttcctgctgcaggaccaggagctgctgggcggcctgaccagccccggcgcccccgtgagcgaccccggcaacagactggccaagagaaaccccgtgctggccgccctgagaagcgcccagggcaagagacccagaagcggcacccccgccgacagcagcggcagcgcccccagccccgcccccagcctgcacccctacagaaaggcccccaagcccgccagcagaagcgcctag

SEQ ID NO: 76768 - DNA, 498 bp, Artificial Sequence
  Description of Artificial Sequence: Synthetic coding sequence
atgtacatcagccccaaggccgagctgaagctggagaagaagagcggcagaaagcccagaagccccagagacagcggcccccagaaggagctggtgatccccggcatcgtggacttcgagagaatcagaagagccctgagaacccccaagccccagacccccggcacctactgcttcggcagactgagccaccacagcttcttcagcagacaccacccccacccccagcacgtgacccacatccaggacctgaccggcaagcccgtgtgcgtggtgagagacttccccgcccccctgcccgagagcaccgtgttcagcggctgccagatgggcatccccaccatcagcgtgcccatcggcgacccccagagcaacagaaacccccagctgagcagcgcctggaagaaggagctgaaggagctggccagcagagtggccttcctgaccaaggaggacgagctgaagaagaaggaggtgggcgccgagcacagaagctag

SEQ ID NO: 76769 - DNA, 672 bp, Artificial Sequence
  Description of Artificial Sequence: Synthetic coding sequence
atgctgtgggtgcagagaaagagaagaagaaaggagaccagcgagtgccccagcgacaaggacaagagccccgagagccacaaggccaagaacgagagctggatcaagagccacttcagcagactgagcgaggagaagctggccctggacaacaacgccagcgccagcggcaacgccacccagaccgagagcggcagcgaggaggtgagcagcaccgtgcacatcgagaccttcaccaccagacacggcgaggtgggcagcgccctgcacagagagagcttcaccagcagacagaagaccagcggccccagcgtgatccaggagatccaccaggagagcggcaaggcccccagcaccgacgaggccacctgggccgccgtggccgcctgcaccaaggagatcgacacccagggcagacacctggcccacagcatgctgcagagagccatcgcctaccagcacagcggccacctggagagcaaggacatcaaccaggaggagctgagagccctggaggaggtggagatgaagctgcagaagaacttcctgacccagagagagaacaccatcgccggcgccaaccacacccacaccttctacggccacagccaccacagccaccacggccaccccagccaccagagccacagcctgcccaacagaagacactag

SEQ ID NO: 76770 - DNA, 399 bp, Artificial Sequence
  Description of Artificial Sequence: Synthetic coding sequence
atgggcagaacctggtgcggcatgtggagaagaagaagacccggcagaagaagcgccgtgcccagatggccccacctgagcagccagagcggcgtggagccccccgacagatggaccggcacccccggctggcccagcagagaccaggaggcccccggcagcatgatgccccccgccgccgcccagcccagcgcccacggcgccctggtgccccccgccaccgcccacgagcccgtggaccaccccgccctgcactggctggcctgctgctgctgcctgagcctgcccggccagctgcccctggccatcagactgggctgggacctggacctggaggccggccccagcagcggcaagctgtgccccagagccagaagatggcagcccctgcccagctag

SEQ ID NO: 76771 - DNA, 537 bp, Artificial Sequence
  Description of Artificial Sequence: Synthetic coding sequence
atggccagcttcctggtgtggcccctgagaaccgccctgagaggcggcaagagctgggccggccccggcgtgggctgcggcggcgacggcgccagaggcggcggcgagctgagcctgagcaacctggacctgcccggcgccggcgaggccggcctggagcaccaccccctgctgggccacctgttcatcagcgccgtgcccagatggccccacctgagcagccagagcggcgtggagccccccgacagatggaccggcacccccggctggcccagcagagaccaggaggcccccggcagcatgatgccccccgccgccgcccagcccagcgcccacggcgccctggtgccccccgccaccgcccacgagcccgtggaccaccccgccctgcactggctggcctgctgctgctgcctgagcctgcccggccagctgcccctggccatcagactgggctgggacctggacctggaggccggccccagcagcggcaagctgtgccccagagccagaagatggcagcccctgcccagctag

SEQ ID NO: 76772 - DNA, 1350 bp, Artificial Sequence
  Description of Artificial Sequence: Synthetic coding sequence
atgtggaccgccctggtgctgatctggatcttcagcctgagcctgagcgagagccacgccgccagcaacgaccccagaaacttcgtgcccaacaagatgtggaagggcctggtgaagagaaacgccagcgtggagaccgtggacaacaagaccagcgaggacgtgaccatggccgccgccagccccgtgaccctgaccaagggcaccagcgccgcccacctgaacagcatggaggtgaccaccgaggacaccagcagaaccgacgtgagcgagcccgccaccagcggcggcgccgccgacggcgtgaccagcatcgcccccaccgccgtggccagcagcaccaccgccgccagcatcaccaccgccgccagcagcatgaccgtggccagcagcgcccccaccaccgccgccagcagcaccaccgtggccagcatcgcccccaccaccgccgccagcagcatgaccgccgccagcagcacccccatgaccctggccctgcccgcccccaccagcaccagcaccggcagaacccccagcaccaccgccaccggccaccccagcctgagcaccgccctggcccaggtgcccaagagcagcgccctgcccagaaccgccaccctggccaccctggccaccagagcccagaccgtggccaccaccgccaacaccagcagccccatgagcaccagacccagccccagcaagcacatgcccagcgacaccgccgccagccccgtgccccccatgagaccccaggcccagggccccatcagccaggtgagcgtggaccagcccgtggtgaacaccaccaacaagagcacccccatgcccagcaacaccacccccgagcccgcccccacccccaccgtggtgaccaccaccaaggcccaggccagagagcccaccgccagccccgtgcccgtgccccacaccagccccatccccgagatggaggccatgagccccaccacccagcccagccccatgccctacacccagagagccgccggccccggcaccagccaggcccccgagcaggtggagaccgaggccacccccggcaccgacagcaccggccccacccccagaagcagcggcggcaccaagatgcccgccaccgacagctgccagcccagcacccagggccagtacatggtggtgaccaccgagcccctgacccaggccgtggtggacaagaccctgctgctggtggtgctgctgctgggcgtgaccctgttcatcaccgtgctggtgctgttcgccctgcaggcctacgagagctacaagaagaaggactacacccaggtggactacctgatcaacggcatgtacgccgacagcgagatgtag

SEQ ID NO: 76773 - DNA, 78 bp, Artificial Sequence
  Description of Artificial Sequence: Synthetic coding sequence
atgtggaccgccctggtgctgatctggatcttcagcctgagcctgagcgagagccacgccgccagcaacgacccctag

SEQ ID NO: 76774 - DNA, 3969 bp, Artificial Sequence
  Description of Artificial Sequence: Synthetic coding sequence
atgcccgtggtgtggcccaccctgctggacctgagcagagacgagtgcaagagaatcctgagaaagctggagctggaggcctacgccggcgtgatcagcgccctgagagcccagggcgacctgaccaaggagaagaaggacctgctgggcgagctgagcaaggtgctgagcatcagcaccgagagacacagagccgaggtgagaagagccgtgaacgacgagagactgaccaccatcgcccacaacatgagcggccccaacagcagcagcgagtggagcatcgagggcagaagactggtgcccctgatgcccagactggtgccccagaccgccttcaccgtgaccgccaacgccgtggccaacgccgccatccagcacaacgccagcctgcccgtgcccgccgagaccggcagcaaggaggtggtgtgctacagctacaccagcaccaccagcacccccaccagcacccccgtgcccagcggcagcatcgccaccgtgaagagccccagacccgccagccccgccagcaacgtggtggtgctgcccagcggcagcaccgtgtacgtgaagagcgtgagctgcagcgacgaggacgagaagcccagaaagagaagaagaaccaacagcagcagcagcagccccgtggtgctgaaggaggtgcccaaggccgtggtgcccgtgagcaagaccatcaccgtgcccgtgagcggcagccccaagatgagcaacatcatgcagagcatcgccaacagcctgcccccccacatgagccccgtgaagatcaccttcaccaagcccagcacccagaccaccaacaccaccacccagaaggtgatcatcgtgaccaccagccccagcagcaccttcgtgcccaacatcctgagcaagagccacaactacgccgccgtgaccaagctggtgcccaccagcgtgatcgccagcaccacccagaagccccccgtggtgatcaccgccagccagagcagcctggtgagcaacagcagcagcggcagcagcagcagcacccccagccccatccccaacaccgtggccgtgaccgccgtggtgagcagcacccccagcgtggtgatgagcaccgtggcccagggcgtgagcaccagcgccatcaagatggccagcaccagactgcccagccccaagagcctggtgagcgcccccacccagatcctggcccagttccccaagcagcaccagcagagccccaagcagcagctgtaccaggtgcagcagcagacccagcagcaggtggcccagcccagccccgtgagccaccagcagcagccccagcagagccccctgccccccggcatcaagcccaccatccagatcaagcaggagagcggcgtgaagatcatcacccagcaggtgcagcccagcaagatcctgcccaagcccgtgaccgccaccctgcccaccagcagcaacagccccatcatggtggtgagcagcaacggcgccatcatgaccaccaagctggtgaccacccccaccggcacccaggccacctacaccagacccaccgtgagccccagcatcggcagaatggccgccacccccggcgccgccacctacgtgaagaccaccagcggcagcatcatcaccgtggtgcccaagagcctggccaccctgggcggcaagatcatcagcagcaacatcgtgagcggcaccaccaccaagatcaccaccatccccatgaccagcaagcccaacgtgatcgtggtgcagaagaccaccggcaagggcaccaccatccagggcctgcccggcaagaacgtggtgaccaccctgctgaacgccggcggcgagaagaccatccagaccgtgcccaccggcgccaagcccgccatcctgaccgccaccagacccatcaccaagatgatcgtgacccagcccaagggcatcggcagcaccgtgcagcccgccgccaagatcatccccaccaagatcgtgtacggccagcagggcaagacccaggtgctgatcaagcccaagcccgtgaccttccaggccaccgtggtgagcgagcagaccagacagctggtgaccgagaccctgcagcaggccagcagagtggccgaggccggcaacagcagcatccaggagggcaaggaggagccccagaactacaccgacagcagcagcagcagcaccgagagcagccagagcagccaggacagccagcccgtggtgcacgtgatcgccagcagaagacaggactggagcgagcacgagatcgccatggagaccagccccaccatcatctaccaggacgtgagcagcgagagccagagcgccaccagcaccatcaaggccctgctggagctgcagcagaccaccgtgaaggagaagctggagagcaagcccagacagcccaccatcgacctgagccagatggccgtgcccatccagatgacccaggagaagagacacagccccgagagccccagcatcgccgtggtggagagcgagctggtggccgagtacatcaccaccgagagaaccgacgagggcaccgaggtggccttccccctgctggtgagccacagaagccagccccagcagcccagccagccccagagaaccctgctgcagcacgtggcccagagccagaccgccacccagaccagcgtggtggtgaagagcatccccgccagcagccccggcgccatcacccacatcatgcagcaggccctgagcagccacaccgccttcaccaagcacagcgaggagctgggcaccgaggagggcgaggtggaggagatggacaccctggacccccagaccggcctgttctacagaagcgccctgacccagagccagagcgccaagcagcagaagctgagccagccccccctggagcagacccagctgcaggtgaagaccctgcagtgcttccagaccaagcagaagcagaccatccacctgcaggccgaccagctgcagcacaagctgccccagatgccccagctgagcatcagacaccagaagctgacccccctgcagcaggagcaggcccagcccaagcccgacgtgcagcacacccagcaccccatggtggccaaggacagacagctgcccaccctgatggcccagcccccccagaccgtggtgcaggtgctggccgtgaagaccacccagcagctgcccaagctgcagcaggcccccaaccagcccaagatctacgtgcagccccagaccccccagagccagatgagcctgcccgccagcagcgagaagcagaccgccagccaggtggagcagcccatcatcacccagggcagcagcgtgaccaagatcaccttcgagggcagacagccccccaccgtgaccaagatcaccggcggcagcagcgtgcccaagctgaccagccccgtgaccagcatcagccccatccaggccagcgagaagaccgccgtgagcgacatcctgaagatgagcctgatggaggcccagatcgacaccaacgtggagcacatgatcgtggacccccccaagaaggccctggccaccagcatgctgaccggcgaggccggcagcctgcccagcacccacatggtggtggccggcatggccaacagcaccccccagcagcagaagtgcagagagagctgcagcagccccagcaccgtgggcagcagcctgaccaccagaaagatcgacccccccgccgtgcccgccaccggccagttcatgagaatccagaacgtgggccagaagaaggccgaggagagccccgccgagatcatcatccaggccatcccccagtacgccatcccctgccacagcagcagcaacgtggtggtggagcccagcggcctgctggagctgaacaacttcaccagccagcagctggacgacgaggagaccgccatggagcaggacatcgacagcagcaccgaggacggcaccgagcccagccccagccagagcagcgccgagagaagctag

SEQ ID NO: 76775 - DNA, 3468 bp, Artificial Sequence
  Description of Artificial Sequence: Synthetic coding sequence
atgcccgtggtgtggcccaccctgctggacctgagcagagacgagtgcaagagaatcctgagaaagctggagctggaggcctacgccggcgtgatcagcgccctgagagcccagggcgacctgaccaaggagaagaaggacctgctgggcgagctgagcaaggtgctgagcatcagcaccgagagacacagagccgaggtgagaagagccgtgaacgacgagagactgaccaccatcgcccacaacatgagcggccccaacagcagcagcgagtggagcatcgagggcagaagactggtgcccctgatgcccagactggtgccccagaccgccttcaccgtgaccgccaacgccgtggccaacgccgccatccagcacaacgccagcctgcccgtgcccgccgagaccggcagcaaggaggtggtgtgctacagctacaccagcaccaccagcacccccaccagcacccccgtgcccagcggcagcatcgccaccgtgaagagccccagacccgccagccccgccagcaacgtggtggtgctgcccagcggcagcaccgtgtacgtgaagagcgtgagctgcagcgacgaggacgagaagcccagaaagagaagaagaaccaacagcagcagcagcagccccgtggtgctgaaggaggtgcccaaggccgtggtgcccgtgagcaagaccatcaccgtgcccgtgagcggcagccccaagatgagcaacatcatgcagagcatcgccaacagcctgcccccccacatgagccccgtgaagatcaccttcaccaagcccagcacccagaccaccaacaccaccacccagaaggtgatcatcgtgaccaccagccccagcagcaccttcgtgcccaacatcctgagcaagagccacaactacgccgccgtgaccaagctggtgcccaccagcgtgatcgccagcaccacccagaagccccccgtggtgatcaccgccagccagagcagcctggtgagcaacagcagcagcggcagcagcagcagcacccccagccccatccccaacaccgtggccgtgaccgccgtggtgagcagcacccccagcgtggtgatgagcaccgtggcccagggcgtgagcaccagcgccatcaagatggccagcaccagactgcccagccccaagagcctggtgagcgcccccacccagatcctggcccagttccccaagcagcaccagcagagccccaagcagcagctgtaccaggtgcagcagcagacccagcagcaggtggcccagcccagccccgtgagccaccagcagcagccccagcagagccccctgccccccggcatcaagcccaccatccagatcaagcaggagagcggcgtgaagatcatcacccagcaggtgcagcccagcaagatcctgcccaagcccgtgaccgccaccctgcccaccagcagcaacagccccatcatggtggtgagcagcaacggcgccatcatgaccaccaagctggtgaccacccccaccggcacccaggccacctacaccagacccaccgtgagccccagcatcggcagaatggccgccacccccggcgccgccacctacgtgaagaccaccagcggcagcatcatcaccgtggtgcccaagagcctggccaccctgggcggcaagatcatcagcagcaacatcgtgagcggcaccaccaccaagatcaccaccatccccatgaccagcaagcccaacgtgatcgtggtgcagaagaccaccggcaagggcaccaccatccagggcctgcccggcaagaacgtggtgaccaccctgctgaacgccggcggcgagaagaccatccagaccgtgcccaccggcgccaagcccgccatcctgaccgccaccagacccatcaccaagatgatcgtgacccagcccaagggcatcggcagcaccgtgcagcccgccgccaagatcatccccaccaagatcgtgtacggccagcagggcaagacccaggtgctgatcaagcccaagcccgtgaccttccaggccaccgtggtgagcgagcagaccagacagctggtgaccgagaccctgcagcaggccagcagagtggccgaggccggcaacagcagcatccaggagggcaaggaggagccccagaactacaccgacagcagcagcagcagcaccgagagcagccagagcagccaggacagccagcccgtggtgcacgtgatcgccagcagaagacaggactggagcgagcacgagatcgccatggagaccagccccaccatcatctaccaggacgtgagcagcgagagccagagcgccaccagcaccatcaaggccctgctggagctgcagcagaccaccgtgaaggagaagctggagagcaagcccagacagcccaccatcgacctgagccagatggccgtgcccatccagatgacccaggagaagagacacagccccgagagccccagcatcgccgtggtggagagcgagctggtggccgagtacatcaccaccgagagaaccgacgagggcaccgaggtggccttccccctgctggtgagccacagaagccagccccagcagcccagccagccccagagaaccctgctgcagcacgtggcccagagccagaccgccacccagaccagcgtggtggtgaagagcatccccgccagcagccccggcgccatcacccacatcatgcagcaggccctgagcagccacaccgccttcaccaagcacagcgaggagctgggcaccgaggagggcgaggtggaggagatggacaccctggacccccagaccggcctgttctacagaagcgccctgacccagagccagagcgccaagcagcagaagctgagccagccccccctggagcagacccagctgcaggtgaagaccctgcagtgcttccagaccaagcagaagcagaccatccacctgcaggccgaccagctgcagcacaagctgccccagatgccccagctgagcatcagacaccagaagctgacccccctgcagcaggagcaggcccagcccaagcccgacgtgcagcacacccagcaccccatggtggccaaggacagacagctgcccaccctgatggcccagcccccccagaccgtggtgcaggtgctggccgtgaagaccacccagcagctgcccaagctgcagcaggcccccaaccagcccaagatctacgtgcagccccagaccccccagagccagatgagcctgcccgccagcagcgagaagcagaccgccagccaggccatcccccagtacgccatcccctgccacagcagcagcaacgtggtggtggagcccagcggcctgctggagctgaacaacttcaccagccagcagctggacgacgaggagaccgccatggagcaggacatcgacagcagcaccgaggacggcaccgagcccagccccagccagagcagcgccgagagaagctag
